(12) United States Patent
Repetti et al.

(10) Patent No.: US 10,597,667 B2
(45) Date of Patent: Mar. 24, 2020

(54) STRESS TOLERANCE IN PLANTS

(71) Applicant: Mendel Biotechnology, Inc., Hayward, CA (US)

(72) Inventors: Peter P. Repetti, Emeryville, CA (US); T. Lynne Reuber, San Mateo, CA (US); Oliver Ratcliffe, Oakland, CA (US); Karen S. Century, Chapel Hill, NC (US); Katherine Krolikowski, Oakland, CA (US); Robert A. Creelman, Castro Valley, CA (US); Frederick D. Hempel, Albany, CA (US); Roderick W. Kumimoto, Sacramento, CA (US); Luc J. Adam, Hayward, CA (US); Neal I. Gutterson, Oakland, CA (US); Roger Canales, Redwood City, CA (US); Emily L. Queen, San Leandro, CA (US); Jennifer M. Costa, Union City, CA (US)

(73) Assignee: Mendel Biotechnology, Inc., Hayward, CA (US)

( * ) Notice: Subject to any disclaimer, the term of this patent is extended or adjusted under 35 U.S.C. 154(b) by 0 days.

(21) Appl. No.: 15/347,676

(22) Filed: Nov. 9, 2016

(65) Prior Publication Data

US 2017/0121733 A1 May 4, 2017

Related U.S. Application Data

(60) Continuation of application No. 14/480,473, filed on Sep. 8, 2014, now abandoned, which is a division of application No. 13/244,288, filed on Sep. 24, 2011, now abandoned, which is a continuation-in-part of application No. 12/077,535, filed on Mar. 17, 2008, now Pat. No. 8,030,546, which is a continuation-in-part of application No. 10/286,264, filed on Nov. 1, 2002, now abandoned, which is a division of application No. 09/533,030, filed on Mar. 22, 2000, now abandoned, said application No. 12/077,535 is a continuation-in-part of application No. 10/675,852, filed on Sep. 30, 2003, now abandoned, and a continuation-in-part of application No. 11/479,226, filed on Jun. 30, 2006, now Pat. No. 7,858,848, and a continuation-in-part of application No. 10/669,824, filed on Sep. 23, 2003, now abandoned, which is a continuation-in-part of application No. 09/823,676, filed on Mar. 30, 2001, now Pat. No. 6,717,034, said application No. 12/077,535 is a continuation-in-part of application No. 11/725,235, filed on Mar. 16, 2007, now Pat. No. 7,601,893, which is a division of application No. 10/225,068, filed on Aug. 9, 2002, now Pat. No. 7,193,129, which is a continuation-in-part of application No. 09/837,944, filed on Apr. 18, 2001, now abandoned, and a continuation-in-part of application No. 10/171,469, filed on Jun. 14, 2002, now abandoned, said application No. 12/077,535 is a continuation-in-part of application No. 11/728,567, filed on Mar. 26, 2007, now Pat. No. 7,635,800, which is a division of application No. 10/225,066, filed on Aug. 9, 2002, now Pat. No. 7,238,860, which is a continuation-in-part of application No. 09/837,944, filed on Apr. 18, 2001, now abandoned, and a continuation-in-part of application No. 10/171,468, filed on Jun. 14, 2002, now abandoned, (Continued)

(51) Int. Cl.
*C12N 15/82* (2006.01)

(52) U.S. Cl.
CPC ....... *C12N 15/8242* (2013.01); *C12N 15/827* (2013.01)

(58) Field of Classification Search
None
See application file for complete search history.

(56) References Cited

U.S. PATENT DOCUMENTS 7,196,245 B2   3/2007   Jiang et al.
7,663,025 B2   2/2010   Heard et al.
(Continued)

FOREIGN PATENT DOCUMENTS

EP   1033405   6/2000
EP   1586645   10/2005
(Continued)

OTHER PUBLICATIONS

Sagasset et al. *A. thaliana* Transparent Testa 1 is involved in seed coat development and defines the WIP subfamily of plant zinc finger proteins. Genes & Development. 2002. 16: 138-149.*

(Continued)

*Primary Examiner* — Ashley K Buran
(74) *Attorney, Agent, or Firm* — Dentons US LLP; David Lanzotti, Esq.

(57) ABSTRACT

Transcription factor polynucleotides and polypeptides incorporated into nucleic acid constructs, including expression vectors, have been introduced into plants and were ectopically expressed. Transgenic plants transformed with many of these constructs have been shown to be more resistant to disease (in some cases, to more than one pathogen), or more tolerant to an abiotic stress (in some cases, to more than one abiotic stress). The abiotic stress may include, for example, salt, hyperosmotic stress, water deficit, heat, cold, drought, or low nutrient conditions.

16 Claims, 36 Drawing Sheets
Specification includes a Sequence Listing.

Related U.S. Application Data said application No. 12/077,535 is a continuation-in-part of application No. 11/375,241, filed on Mar. 13, 2006, now Pat. No. 7,598,429, which is a continuation-in-part of application No. 10/225,067, filed on Aug. 9, 2002, now Pat. No. 7,135,616, which is a continuation-in-part of application No. 09/837,944, filed on Apr. 18, 2001, now abandoned, and a continuation-in-part of application No. 10/171,468, filed on Jun. 14, 2002, now abandoned, said application No. 12/077,535 is a continuation-in-part of application No. 11/069,255, filed on Feb. 28, 2005, now Pat. No. 8,558,059, which is a continuation-in-part of application No. 10/112,887, filed on Mar. 18, 2002, now abandoned, said application No. 12/077,535 is a continuation-in-part of application No. 10/374,780, filed on Feb. 25, 2003, now Pat. No. 7,511,190, which is a continuation-in-part of application No. 09/934,455, filed on Aug. 22, 2001, now abandoned, which is a continuation-in-part of application No. 09/713,994, filed on Nov. 16, 2000, now abandoned, which is a continuation-in-part of application No. 09/837,944, filed on Apr. 18, 2001, now abandoned, said application No. 10/374,780 is a continuation-in-part of application No. 10/225,068, filed on Aug. 9, 2002, now Pat. No. 7,193,129, which is a continuation-in-part of application No. 09/837,944, filed on Apr. 18, 2001, now abandoned, said application No. 10/374,780 is a continuation-in-part of application No. 10/225,066, filed on Aug. 9, 2002, now Pat. No. 7,238,860, which is a continuation-in-part of application No. 09/837,944, filed on Apr. 18, 2001, now abandoned, and a continuation-in-part of application No. 10/171,468, filed on Jun. 14, 2002, now abandoned, said application No. 10/374,780 is a continuation-in-part of application No. 10/225,067, filed on Aug. 9, 2002, now Pat. No. 7,135,616, which is a continuation-in-part of application No. 09/837,944, filed on Apr. 18, 2001, now abandoned, and a continuation-in-part of application No. 10/171,468, filed on Jun. 14, 2002, now abandoned, said application No. 12/077,535 is a continuation-in-part of application No. 10/546,266, filed as application No. PCT/US2004/005654 on Feb. 25, 2004, now Pat. No. 7,659,446, which is a continuation-in-part of application No. 10/374,780, filed on Feb. 25, 2003, now Pat. No. 7,511,190, and a continuation-in-part of application No. 10/675,852, filed on Sep. 30, 2003, now abandoned, said application No. 12/077,535 is a continuation-in-part of application No. 10/412,699, filed on Apr. 10, 2003, now Pat. No. 7,345,217, which is a continuation-in-part of application No. 10/295,403, filed on Nov. 15, 2002, now abandoned, which is a division of application No. 09/394,519, filed on Sep. 13, 1999, now abandoned, said application No. 10/412,699 is a continuation-in-part of application No. 09/489,376, filed on Jan. 21, 2000, now abandoned, and a continuation-in-part of application No. 10/302,267, filed on Nov. 22, 2002, now Pat. No. 7,223,904, which is a division of application No. 09/506,720, filed on Feb. 17, 2000, now abandoned, said application No. 10/412,699 is a continuation-in-part of application No. 10/278,173, filed on Oct. 21, 2002, now abandoned, which is a division of application No. 09/533,392, filed on Mar. 22, 2000, now abandoned, said application No. 10/412,699 is a continuation-in-part of application No. 09/713,994, filed on Nov. 16, 2000, now abandoned, and a continuation-in-part of application No. 09/819,142, filed on Mar. 27, 2001, now abandoned, and a continuation-in-part of application No. 09/934,455, filed on Aug. 22, 2001, now abandoned, which is a continuation-in-part of application No. 09/713,994, filed on Nov. 16, 2000, now abandoned, which is a continuation-in-part of application No. 09/837,944, filed on Apr. 18, 2001, now abandoned, said application No. 10/412,699 is a continuation-in-part of application No. 10/225,068, filed on Aug. 9, 2002, now Pat. No. 7,193,129, which is a continuation-in-part of application No. 09/837,944, filed on Apr. 18, 2001, now abandoned, and a continuation-in-part of application No. 10/171,469, filed on Jun. 14, 2002, now abandoned, said application No. 10/412,699 is a continuation-in-part of application No. 10/225,066, filed on Aug. 9, 2002, now Pat. No. 7,238,860, which is a continuation-in-part of application No. 09/837,944, filed on Apr. 18, 2001, now abandoned, and a continuation-in-part of application No. 10/171,468, filed on Jun. 14, 2002, now abandoned, said application No. 10/412,699 is a continuation-in-part of application No. 10/225,067, filed on Aug. 9, 2002, now Pat. No. 7,135,616, which is a continuation-in-part of application No. 09/837,944, filed on Apr. 18, 2001, now abandoned, and a continuation-in-part of application No. 10/171,468, filed on Jun. 14, 2002, now abandoned, said application No. 10/412,699 is a continuation-in-part of application No. 10/374,780, filed on Feb. 25, 2003, now Pat. No. 7,511,190, said application No. 12/077,535 is a continuation-in-part of application No. 10/559,441, filed as application No. PCT/US2004/017768 on Jun. 4, 2004, now abandoned, which is a continuation-in-part of application No. 10/456,882, filed on Jun. 6, 2003, now abandoned, said application No. 12/077,535 is a continuation-in-part of application No. 11/642,814, filed on Dec. 20, 2006, now Pat. No. 7,825,296, which is a division of application No. 10/666,642, filed on Sep. 18, 2003, now Pat. No. 7,196,245, said application No. 12/077,535 is a continuation-in-part of application No. 10/714,887, filed on Nov. 13, 2003, now abandoned, which is a continuation-in-part of application No. 10/456,882, filed on Jun. 6, 2003, now abandoned, and a continuation-in-part of application No. 10/666,642, filed on Sep. 18, 2003, now Pat. No. 7,196,245, said application No. 12/077,535 is a continuation-in-part of application No. 11/435,388, filed on May 15, 2006, now Pat. No. 7,663,025, which is a continuation-in-part of application No. PCT/US2004/037584, filed on Nov. 12, 2004, which is a continuation-in-part of application No. 10/714,887, filed on Nov. 13, 2003, now abandoned, said application No. 12/077,535 is a continuation-in-part of application No. 11/632,390, filed as application No. PCT/US2005/025010 on Jul. 14, 2005, now abandoned, said application No. 12/077,535 is a continuation-in-part of application No. 12/064,961, filed on Dec. 22, 2008, which is a continuation-in-part of application No. PCT/US2006/034615, filed on Aug. 31, 2006, said application No. 12/077,535 is a continuation-in-part of application No. PCT/US2006/

034615, filed on Aug. 31, 2006, and a continuation-in-part of application No. 10/903,236, filed on Jul. 30, 2004, which is a continuation-in-part of application No. 10/456,882, filed on Jun. 9, 2003, now abandoned, and a continuation-in-part of application No. 10/666,642, filed on Sep. 18, 2003, now Pat. No. 7,196,245, said application No. 12/077,535 is a continuation-in-part of application No. 11/699,973, filed on Jan. 29, 2007, now abandoned, which is a continuation-in-part of application No. PCT/US2005/027151, filed on Jul. 29, 2005, which is a continuation-in-part of application No. 10/903,236, filed on Jul. 30, 2004, said application No. 12/077,535 is a continuation-in-part of application No. 10/870,198, filed on Jun. 16, 2004, now Pat. No. 7,897,843, which is a continuation-in-part of application No. 10/669,824, filed on Sep. 23, 2003, now abandoned, which is a continuation-in-part of application No. 09/823,676, filed on Mar. 30, 2001, now Pat. No. 6,717,034, said application No. 12/077,535 is a continuation-in-part of application No. 10/838,616, filed on May 4, 2004, now Pat. No. 8,283,519, and a continuation-in-part of application No. 10/685,922, filed on Oct. 14, 2003, now abandoned, and a continuation-in-part of application No. PCT/US2007/017321, filed on Aug. 7, 2006, and a continuation-in-part of application No. 11/705,903, filed on Feb. 12, 2007, now Pat. No. 7,868,229, which is a continuation-in-part of application No. PCT/US2006/034615, filed on Aug. 31, 2006, said application No. 12/077,535 is a continuation-in-part of application No. 11/821,448, filed on Jun. 22, 2007, now Pat. No. 7,692,067, and a continuation-in-part of application No. PCT/US2007/009124, filed on Apr. 12, 2007, and a continuation-in-part of application No. 11/986,992, filed on Nov. 26, 2007, now Pat. No. 8,809,630, which is a division of application No. 10/412,699, filed on Apr. 10, 2003, now Pat. No. 7,345,217, which is a continuation-in-part of application No. 09/533,029, filed on Mar. 22, 2000, now Pat. No. 6,664,446, which is a continuation-in-part of application No. 10/278,536, filed on Oct. 22, 2002, which is a division of application No. 09/532,591, filed on Mar. 22, 2000.

(60) Provisional application No. 60/961,403, filed on Jul. 20, 2007, provisional application No. 60/125,814, filed on Mar. 23, 1999, provisional application No. 60/166,228, filed on Nov. 17, 1999, provisional application No. 60/198,899, filed on Apr. 17, 2000, provisional application No. 60/227,439, filed on Aug. 22, 2000, provisional application No. 60/310,847, filed on Aug. 9, 2001, provisional application No. 60/336,049, filed on Nov. 19, 2001, provisional application No. 60/338,692, filed on Dec. 11, 2001, provisional application No. 60/713,952, filed on Aug. 31, 2005, provisional application No. 60/101,349, filed on Sep. 22, 1998, provisional application No. 60/103,312, filed on Oct. 6, 1998, provisional application No. 60/108,734, filed on Nov. 17, 1998, provisional application No. 60/113,409, filed on Dec. 22, 1998, provisional application No. 60/116,841, filed on Jan. 22, 1999, provisional application No. 60/120,880, filed on Feb. 18, 1999, provisional application No. 60/121,037, filed on Feb. 22, 1999, provisional application No. 60/124,278, filed on Mar. 11, 1999, provisional application No. 60/129,450, filed on Apr. 15, 1999, provisional application No. 60/135,134, filed on May 20, 1999, provisional application No. 60/144,153, filed on Jul. 15, 1999, provisional application No. 60/161,143, filed on Oct. 22, 1999, provisional application No. 60/162,656, filed on Nov. 1, 1999, provisional application No. 60/162,656, filed on Nov. 1, 1999, provisional application No. 60/125,814, filed on Mar. 23, 1999, provisional application No. 60/166,228, filed on Nov. 17, 1999, provisional application No. 60/197,899, filed on Apr. 17, 2000, provisional application No. 60/411,837, filed on Sep. 18, 2002, provisional application No. 60/434,166, filed on Dec. 17, 2002, provisional application No. 60/465,809, filed on Apr. 24, 2003, provisional application No. 60/527,658, filed on Dec. 5, 2003, provisional application No. 60/542,928, filed on Feb. 5, 2004, provisional application No. 60/588,405, filed on Jul. 14, 2004, provisional application No. 60/713,952, filed on Aug. 31, 2005, provisional application No. 60/565,948, filed on Apr. 26, 2004, provisional application No. 60/836,243, filed on Aug. 7, 2006, provisional application No. 60/817,886, filed on Jun. 29, 2006, provisional application No. 60/791,663, filed on Apr. 12, 2006.

(56) References Cited

U.S. PATENT DOCUMENTS

| | | | |
|---|---|---|---|
| 7,825,296 B2 | 11/2010 | Jiang et al. | |
| 7,858,848 B2 | 12/2010 | Reuber et al. | |
| 7,956,242 B2 | 6/2011 | Zhang et al. | |
| 8,030,546 B2 | 10/2011 | Reuber et al. | |
| 8,541,665 B2 | 9/2013 | Jiang et al. | |
| 8,686,226 B2 | 4/2014 | Heard et al. | |
| 2008/0313756 A1* | 12/2008 | Zhang | C07K 14/415 800/260 |
| 2009/0138981 A1* | 5/2009 | Repetti | C07K 14/415 800/263 |
| 2009/0265815 A1 | 10/2009 | Alexandrov et al. | |
| 2011/0119789 A1 | 5/2011 | Creelman et al. | |
| 2013/0061345 A1 | 3/2013 | Reuber et al. | |

FOREIGN PATENT DOCUMENTS

| | | |
|---|---|---|
| EP | 1887081 | 2/2008 |
| WO | WO 2004-031349 | 4/2004 |
| WO | WO 2005/047516 | 5/2005 |

OTHER PUBLICATIONS

GenBank Accession No. AY037202. Published Jun. 10, 2001. pp. 1-2.*
Seo et al. Modulation of sugar metabolism by an Indeterminate Domain transcription factor contributes to photoperiodic flowering in *Arabidopsis*. The Plant Journal. 2011. 65: 418-429.*
Friedberg. Automated protein function prediction—the genomic challenge. Briefings in Bioinformatics. 2006. 7(3): 225-242.*
U.S. Appl. No. 60/527,658, filed Dec. 5, 2003, Heard et al.
U.S. Appl. No. 60/336,049, filed Nov. 19, 2001, Adam et al.
U.S. Appl. No. 60/411,837, filed Sep. 18, 2002, Creelman et al.
U.S. Appl. No. 09/713,994, filed Nov. 16, 2000, Keddie et al.
NCBI Accession No. AL021633 (GI:2827513) (Jan. 29, 1998); Bevan, M., et al.; "*Arabidopsis thaliana* DNA chromosome 4, BAC clone F8F16 (ESSAII project)".
NCBI Accession No. BE922396 (GI:10448472) (Oct. 2, 2000); Van Der Hoeven, R.S., et al; "EST426165 potato leaves and petioles *Solanum tuberosum* cDNA clone cSTB20E23 5-sequence, mRNA sequence".

(56) References Cited

OTHER PUBLICATIONS

NCBI Accession No. BE462252 (GI:9508021) (Jul. 27, 2000); Van Der Hoeven, R.S., et al.; "EST324516 tomato flower buds 0-3 mm, Cornell University Solanum lycopersicum cDNA clone cTOA12121, mRNA sequence".

NCBI Accession No. AW775770 (GI:7765583( (May 9, 2000); Fedorova, M., et al.; "EST334835 DSIL Medicago truncatula cDNA clone pDSIL-3G23, mRNA sequence".

NCBI Accession No. AW831343 (GI:7925378) (May 18, 2000); Shoemaker, R., et al.; "sm23e07.y1 GM-c1028 Glycine max cDNA clone Genome Systems Clone ID: Gm-c1028-47655—similar to TR:O49577 O49577 Hypothetical 33.1 KD Protein.; mRNA sequence".

* cited by examiner

| | | |
|---|---|---|
| G3434 | (3502) | REQDRFLPIANISRIMKKAVPAN------GKIAKDAKETLQECVSEFISFVT |
| G3395 | (3484) | REQDRFLPIANISRIMKKAVPAN------GKIAKDAKETLQECVSEFISFVT |
| G3470 | (3527) | REQDRYLPIANISRIMKKALPPN------GKIAKDAKDTMQECVSEFISFIT |
| G3471 | (3528) | REQDRYLPIANISRIMKKALPPN------GKIAKDAKDTMQECVSEFISFIT |
| G481 | (2377) | REQDRYLPIANISRIMKKALPPN------GKIGKDAKDTVQECVSEFISFIT |
| G1364 | (2941) | REQDRFLPIANISRIMKRGLPAN------GKIAKDAKEIVQECVSEFISFVT |
| G2345 | (3234) | REQDRFLPIANISRIMKRGLPLN------GKIAKDAKETMQECVSEFISFIT |
| G3876 | (3681) | REQDRFLPIANISRIMKKAIPAN------GKIAKDAKETVQECVSEFISFIT |
| G3866 | (3677) | REQDRFLPIANISRIMKKAIPANGKIAKDAKETVQECVSEFISFIT |
| G3394 | (3483) | -RQDRFLPIANISRIMKKAIPAN------GKIAKDAKETVQECVSEFISFIT |
| G3435 | (3503) | REQDRFLPIANVSRIMKKALPAN------AKISKDAKETVQECVSEFISFIT |
| G3436 | (3504) | REQDRFLPIANVSRIMKKALPAN------AKISKDAKETVQECVSEFISFIT |
| G3397 | (3486) | REQDRFLPIANVSRIMKKALPAN------AKISKDAKETVQECVSEFISFIT |
| G3398 | (3487) | REQDRFLPIANVSRIMKKALPAN------AKISKDAKETVQECVSEFISFIT |
| G3475 | (3532) | REQDRFLPIANVSRIMKKALPAN------AKISKDAKETVQECVSEFISFIT |
| G3478 | (3534) | REQDRFLPIANVSRIMKKALPAN------AKISKDAKETVQECVSEFISFIT |
| G3476 | (3533) | REQDRFLPIANVSRIMKKALPAN------AKISKDAKETMQECVSEFISFIT |
| G482 | (2378) | REQDRFLPIANVSRIMKKALPAN------AKISKDAKETVQECVSEFISFVT |
| G485 | (2616) | REQDRFLPIANVSRIMKKALPAN------AKISKDAKETVQECVSEFISFIT |
| G3474 | (3531) | REQDRFLPIANVSRIMKKALPAN------AKISKEAKETVQECVSEFISFIT |
| G3472 | (3529) | REQDRFLPIANVSRIMKKALPAN------AKISKEAKETVQECVSEFISFIT |
| G3396 | (3485) | KEQDRFLPIANIGRIMRRAVPEN------GKIAKDSKESVQECVSEFISFIT |
| G3429 | (3498) | ---TNAELPMANLVRLIKKVLPGK------AKIGGAAKGLTHDCAVEFVGFVG |

FIG. 3A

| | | |
|---|---|---|
| G3434 | (3502) | SEASDKCQKEKRKTINGDDLLWAMATLGFEEYVEPLKIYLQKYK |
| G3395 | (3484) | SEASDKCQKEKRKTINGEDLLFAMGTLGFEEYVDPLKIYLHKYR |
| G3470 | (3527) | SEASEKCQKEKRKTINGDDLLWAMATLGFEDYIEPLKVYLARYR |
| G3471 | (3528) | SEASEKCQKEKRKTINGDDLLWAMATLGFEDYIEPLKVYLARYR |
| G481  | (2377) | SEASDKCQKEKRKTVNGDDLLWAMATLGFEDYLEPLKIYLARYR |
| G1364 | (2941) | SEASDKCQREKRKTINGDDLLWAMATLGFEDYMEPLKVYLMRYR |
| G2345 | (3234) | SEASDKCQREKRKTINGDDLLWAMATLGFEDYIDPLKVYLMRYR |
| G3876 | (3681) | SEASDKCQREKRKTINGDDLLWAMATLGFEDYIEPLKVYLQKYR |
| G3866 | (3677) | SEASDKCQREKRKTINGDDLLWAMATLGFEDYIEPLKVYLQKYR |
| G3394 | (3483) | SEASDKCQREKRKTINGDDLLWAMATLGFEDYIEPLKVYLQKYR |
| G3435 | (3503) | GEASDKCQREKRKTINGDDLLWAMTTLGFEDYVEPLKHYLHKFR |
| G3436 | (3504) | GEASDKCQREKRKTINGDDLLWAMTTLGFEDYIEPLKLYLHKFR |
| G3397 | (3486) | GEASDKCQREKRKTINGDDLLWAMTTLGFEDYVDPLKHYLHKFR |
| G3398 | (3487) | GEASDKCQREKRKTINGDDLLWAMTTLGFEDYIDPLKLYLHKFR |
| G3475 | (3532) | GEASDKCQREKRKTINGDDLLWAMTTLGFEDYVEPLKGYLQRFR |
| G3478 | (3534) | GEASDKCQREKRKTINGDDLLWAMTTLGFEDYVEPLKGYLQRFR |
| G3476 | (3533) | GEASDKCQREKRKTINGDDLLWAMTTLGFEDYIEPLKIYLQRFR |
| G482  | (2378) | GEASDKCQREKRKTINGDDLLWAMTTLGFEEYVEPLKVYLQRFR |
| G485  | (2616) | GEASDKCQREKRKTINGDDLLWAMTTLGFEDYVEPLKVYLQKYR |
| G3474 | (3531) | GEASDKCQREKRKTINGDDLLWAMTTLGFEDYVDPLKIYLHKYR |
| G3472 | (3529) | GEASDKCQKEKRKTINGDDLLWAMTTLGFEEYVEPLKVYLHKYR |
| G3396 | (3485) | SEASDKCLKEKRKTINGDDLIWSMGTLGFEDYVEPLKLYLRLYR |
| G3429 | (3498) | DEASEKAKAEHRRTVAPEDYLGSFGDLGFDRYVDPMDAYIHGYR |

FIG. 3B

```
G3459 (1918)  GSKNKPKPPVIITRESA--NTLRAHILEVGSGSDVFDCVTAYARRRQRGICVLSGSGT
G3459 (1920)  GSKNKPKPPVIITRESA--NTLRAHILEVGSGSDVFDCVTAYARRRQRGICVLSGSGT
G3406 (5144)  GSKNKPKPPVIITRESA--NTLRAHILEVGSGSDVFECVSTYARRRQRGVCVLSGSGV
G3407 (1876)  GSKNKPKPPVIITRESA--NALRAHILEVAAGCDVFEALTAYARRRQRGVCVLSAAGT
G1067 (798)   GSKNKAKPPIIVTRDSP--NALRSHVLEVSPGADIVESVSTYARRRGRGVSVLGGNGT
G2156 (1424)  GSKNKPKPPVIVTRDSP--NVLRSHVLEVSSGADIVESVTTYARRRGRGVSILSGNGT
G1073 (18)    GSKNKPKPTIITRDSP--NVLRSHVLEVTSGSDISEAVSTYATRRGCGVCIISGTGA
G3399 (1870)  GSKNKPKPPIIVTRDSP--NALHSHVLEVAGGADVVDCVAEYARRRGRGVCVLSGGGA
G3400 (1872)  GSKNKPKPPIIVTRDSP--NAFHSHVLEVAAGTDIVECVCEFARRRGRGVSVLSGGGA
G2153 (1420)  GSKNKPKPPIFVTRDSP--NALKSHVMEIASGTDVIETLATFARRRGRGICILSGNGT
G1069 (802)   GSKNKPKPAPIFVTRDSP--NALRSHVLEISDGSDVADTIAHFSRRRQRGVCVLSGTGS
G3401 (1874)  GSKNKPKPPIFVTRDSP--NALRSHVMEVAGGADVAESIAHFARRRQRGVCVLSGAGT
G3456 (1916)  GSRNKPKPPIFVTRDSP--NALRSHVMEIAVGADIADCVAQFARRRQRGVSILSGSGT
G3556 (2034)  GSKNKPKPPVVVTRESP--NAMRSHVLEIASGADIVEAIAGFSRRRQRGVSVLSGSGA
G2157 (1426)  GSKNKPKSPVVVTKESP--NSLQSHVLEIATGADVAESLNAFARRRGRGVSVLSGSGL
G2789 (1694)  GSKNKPKAPIIVTRDSA--NAFRCHVMEITNACDVMESLAVFARRRQRGVCVLTGNGA
G1667 (1116)  GSKNKPKPPIIVTHDSP--NSLRANAVEISSGCDICETLSDFARRKQRGLCILSANGC
G3408 (1878)  -SKNKPKPPVVITREAEPAAAMRPHVIEIPGGRDVAEALARFSSRRNLGICVLAGTGA
```

FIG. 5A

| | | | | |
|---|---|---|---|---|
| G3459 | (1918) | VTNVSLRQP------ | ------AAAGA----- | ------VVTLHGRFEILSLSGSFLPPP------ | ------A |
| G3459 | (1920) | VTNVSLRQP------ | ------AAAGA----- | ------VVRLHGRFEILSLSGSFLPPP------ | ------A |
| G3406 | (5144) | VTNVTLRQPS----- | ------APAGA----- | ------VVSLHGRFEILSLSGSFLPPP------ | ------A |
| G3407 | (1876) | VANVTLRQPQSAQPGPASPA | ------VATLHGRFEILSLAGSFLPPP------ | ------A |
| G1067 | (798) | VSNVTLRQP------ | ------VTPGNGGVSGGGVVTLHGRFEILSLTGTVLPPP | ------A |
| G2156 | (1424) | VANVSLRQP------ | ------ATTAAHGANGGTGGVVALHGRFEILSLTGTVLPPP | ------A |
| G1073 | (18) | VTNVTIRQP------ | ------AAPAG----- | ------GGVITLHGRFDILSLTGTALPPP------ | ------A |
| G3399 | (1870) | VVNVALRQPG----- | ------ASPPG----- | ------SMVATLRGRFEILSLTGTVLPPP------ | ------A |
| G3400 | (1872) | VANVALRQPG----- | ------ASPPG----- | ------SLVATMRGQFEILSLTGTVLPPP------ | ------A |
| G2153 | (1420) | VANVTLRQPSTAAVAAAPGGAA | ------VLALQGRFEILSLTGSFLPGP------ | ------A |
| G1069 | (802) | VANVTLRQ------- | ------AAAAPGG--- | ------VVSLQGRFEILSLTGAFLPGP------ | ------S |
| G3401 | (1874) | VTDVALRQ------- | ------PAAPSA---- | ------VVALRGRFEILSLTGTFLPGP------ | ------A |
| G3456 | (1916) | VVNVNLRQ------- | ------PTAPGA---- | ------VMALHGRFDILSLTGSFLPGP------ | ------S |
| G3556 | (2034) | VTNVTLRQ------- | ------PAGTGAA--- | ------AVALRGRFEILSMSGAFLPAP------ | ------A |
| G2157 | (1426) | VTNVTLRQ------- | ------PAASGG---- | ------VVSLRGQFEILSMCGAFLPTSG----- | ------S |
| G2789 | (1694) | VTNVTVRQ------- | ------PGG------- | ------GVVSLHGRFEILSLSGSFLPPP------ | ------A |
| G1667 | (1116) | VTNVTLRQP------ | ------ASSGA----- | ------IVTLHGRYEILSLLGSILPPP------ | ------A |
| G3408 | (1878) | VANVSLRHPS----- | ------PGVPGSAP-- | ------AAIVFHGRYEILSLSATFLPPAMSSVAPQA |

FIG. 5B

G3459 (1918) PPGATSLTIYLAGGQGQVVGGNVIGELTAAGPVIVIAASFTNVAYERLPLEE-
G3459 (1920) PPGATSLTIYLAGGQGQVVGGNVVGELTAAGPVIVIAASFTNVAYERLPLEE-
G3406 (5144) PPGATSLTIFLAGGQGQVVGGNVVGALYAAGPVIVIAASFANVAYERLPL---
G3407 (1876) PPGATSLAAFLAGGQGQVVGGSVAGALIAAGPVVVAASFSNVAYERLPLED-
G1067 (798)  PPGAGGLSIFLAGGQGQVVGGSVVAPLIAASAPVILMAASFSNAVFERLPIEE-
G2156 (1424) PPGSGGLSIFLSGVQGQVIGGNVVAPLVASGPVILMAASFSNATFERLPLED-
G1073 (18)   PPGAGGLTVYLAGGQGQVVGGSVVGGSLIASGPVVLMAASFANAVYDRLPIEE-
G3399 (1870) PPGASGLTVFLSGGQGQVIGGSVVGPLVAAGPVVLMAASFANAVYERLPLEG-
G3400 (1872) PPSASGLTVFLSGGQGQVVGGSVAGQLIAAGPVFLMAASFANAVYERLPLDG-
G2153 (1420) PPGSTGLTIYLAGGQGQVVGGSVVGPLMAAGPVMLIAATFSNATFSNATYERLPLEE-
G1069 (802)  PPGSTGLTVYLAGVQGQVVGGSVVGPLLAIGSVMVIAATFSNATYERLPMEE-
G3401 (1874) PPGSTGLTVYLAGGQGQVVGGSVVGTLTAAGPVMVIASTFANATYERLPLDQ
G3456 (1916) PPGATGLTIYLAGGQGQIVGGGVVGPLVAAGPVLVMAATFSNATYERLPLED-
G3556 (2034) PPGATGLAVYLAGGQGQVVGGSVMGELIASGPVMVIAATFGNATYERLPLD--
G2157 (1426) PAAAAGLTIYLAGAQGQVVGGVAGPLIASGPVIVIAATFCNATYERLPIEE-
G2789 (1694) PPAASGLKVYLAGGQGQVIGGSVVGPLTASSPVVMAASFGNASYERLPLEE-
G1667 (1116) PLGITGLTIYLIAGPQGQVVGGVVGGLIASGPVVLMAASFMNAVFDRLPMDD-
G3408 (1878) AVAAAGLSISLAGPHGQIVGGAVAGPLYAATTVVVVAAAFTNPTFHRLPADD-

FIG. 5C

| | | |
|---|---|---|
| G3864 | (3675) | RGKHFRGVRQRPWGKFAAEIRDPAKNGARVWLGTFDSAEDAAVAYDRAA |
| G3430 | (2374) | RGKHYRGVRQRPWGKFAAEIRDPAKNGARVWLGTFDSAEEAAVAYDRAA |
| G3856 | (3672) | RGKHYRGVRQRPWGKFAAEIRDPAKNGARVWLGTYDSAEDAAVAYDRAA |
| G3661 | (3596) | RGKHYRGVRQRPWGKFAAEIRDPARNGARVWLGTYDTAEDAALAYDRAA |
| G3848 | (3670) | RGKHYRGVRQRPWGKFAAEIRDPAKNGARVWLGTFDTAEDAALAYDRAA |
| G3718 | (3614) | KGKHYRGVRQRPWGKFAAEIRDPAKNGARVWLGTFETAEDAALAYDRAA |
| G3659 | (3594) | KGKHYRGVRQRPWGKFAAEIRDPAKNGARVWLGTFETAEDAALAYDRAA |
| G3660 | (3595) | KGKHYRGVRQRPWGKFAAEIRDPAKKGAREWLGTFETAEDAALAYDRAA |
| G28 | (2373) | KGKHYRGVRQRPWGKFAAEIRDPAKNGARVWLGTFETAEDAALAYDRAA |
| G1006 | (2828) | KAKHYRGVRQRPWGKFAAEIRDPAKNGARVWLGTFETAEDAALAYDIAA |
| G3717 | (3613) | KGKHYRGVRQRPWGKFAAEIRDPAKNGARVWLGTFETAEDAALAYDRAA |
| G3841 | (3665) | KGRHYRGVRQRPWGKFAAEIRDPAKNGARVWLGTYETAEEAAIAYDKAA |
| G22 | (2406) | KGMQYRGVRRRPWGKFAAEIRDPKKNGARVWLGTYETPEDAAVAYDRAA |

FIG. 7A

| | | |
|---|---|---|
| G3864 | (3675) | YRMRGSRALLNFPLRI |
| G3430 | (2374) | YRMRGSRALLNFPLRI |
| G3856 | (3672) | YRMRGSRALLNFPLRI |
| G3661 | (3596) | YRMRGSRALLNFPLRI |
| G3848 | (3670) | YRMRGSRALLNFPLRI |
| G3718 | (3614) | YRMRGSRALLNFPLRI |
| G3659 | (3595) | FRMRGSRALLNFPLRV |
| G3660 | (3595) | FRMRGSRALLNFPLRV |
| G28   | (2373) | FRMRGSRALLNFPLRV |
| G1006 | (2828) | FRMRGSRALLNFPLRV |
| G3717 | (3613) | YRMRGSRALLNFPLRV |
| G3841 | (3665) | YRMRGSKAHLNFPHRI |
| G22   | (2406) | FQLRGSKAKLNFPHLI |

FIG. 7B

G3649 (3590) EMMRYRGVRRRRWGKWVSEIRVPGTRERLWLGSYATAEAAAVAHDAAV
G3644 (3586) ERCRYRGVRRRRWGKWVSEIRVPGTRERLWLGSYATPEAAAVAHDTAV
G3650 (3591) RRCRYRGVRRRAWGKWVSEIRVPGTRERLWLGSYAAPEAAAVAHDAAA
G47   (2375) SQSKYKGIRRRKWGKWVSEIRVPGTRDRLWLGSFSTAEGAAVAHDVAF
G2133 (2376) DQSKYKGIRRRKWGKWVSEIRVPGTRQRLWLGSFSTAEGAAVAHDVAF
G3643 (3585) TNNKLKGVRRRKWGKWVSEIRVPGTQERLWLGTYATPEAAAVAHDVAV

G3649 (3590) CLLRLGGGRRAAAGGGGGLNFPARA-
G3644 (3586) YFLRGGAG--DGGGGATLNFPERA-
G3650 (3591) CLLRGCAG--------RRLNFPGRAA
G47   (2375) FCLHQPDSL-------ESLNFPHLL-
G2133 (2376) YCLHRPSSLDD-----ESFNFPHLL-
G3643 (3585) YCLSRPSSL-------DKLNFPETL-

FIG. 9

| | | |
|---|---|---|
| G3728 | (3624) | DDGFKWRKYGKKAVKNSPNPRNYYRCSSEGCGVKKRVERDRDDPRYVI |
| G3804 | (3643) | DDGFKWRKYGKKAVKNSPNPRNYYRCSSEGCGVKKRVERDRDDPRYVI |
| G3727 | (3623) | DDGFKWRKYGKKAVKSSPNPRNYYRCSSEGCGVKKRVERDRDDPRYVI |
| G3730 | (3626) | DDGFKWRKYGKKAVKSSPNPRNYYRCSAAGCGVKKRVERDGDDPRYVV |
| G3719 | (3615) | DDGFKWRKYGKKTVKSSPNPRNYYRCSAEGCGVKKRVERDSDDPRYVV |
| G3721 | (3617) | DDGFKWRKYGKKAVKNSPNPRNYYRCSTEGCNVKKRVERDREDHRYVI |
| G3726 | (3622) | DDGYKWRKYGKKSVKNSPNPRNYYRCSTEGCNVKKRVERDKDDPSYVV |
| G3720 | (3616) | DDGYKWRKYGKKSVKNSPNPRNYYRCSTEGCNVKKRVERDKDDPSYVV |
| G3725 | (3621) | DDGYKWRKYGKKSVKNSPNPRNYYRCSTEGCNVKKRVERDKNDPRYVV |
| G3722 | (3618) | DDGYKWRKYGKKSVKMSPNPRNYYRCSSEGCRVKKRVERARDDARFVV |
| G3729 | (3625) | DDGYKWRKYGKKMVKNSPNPRNYYRCSGEGCNVKKRVERDRDDSNYVL |
| G3803 | (3642) | DDGYKWRKYGKKTVKNPNPRNYYKCSGEGCDVKKRVERDRDDSNYVL |
| G3723 | (3619) | DDGYKWRKYGKKTVKSSPNPRNYYKCSSEGCSVKKRVERDGDDAAYVI |
| G1274 | (2384) | DDGFKWRKYGKKSVKNNINKRNYYKCSSEGCSVKKRVERDGDDAAYVI |
| G3724 | (3620) | DDGYKWRKYGKKSVKSSPNLRNYYKCSSGGCSVKKRVERDDYSYVI |
| G1275 | (2908) | DDGFKWRKYGKKMVKNSPHPRNYYKCSVDGCPVKKRVERDRDDPSFVI |

FIG. 11A

| | | |
|---|---|---|
| G3728 | (3624) | TTYDGVHNH |
| G3804 | (3643) | TTYDGVHNH |
| G3727 | (3623) | TTYDGVHNH |
| G3730 | (3626) | TTYDGVHNH |
| G3719 | (3615) | TTYDGVHNH |
| G3721 | (3617) | TTYDGVHNH |
| G3726 | (3622) | TTYEGTHNH |
| G3720 | (3616) | TTYEGMHNH |
| G3725 | (3621) | TMYEGIHNH |
| G3722 | (3618) | TMYEGVHNH |
| G3729 | (3625) | TTYDGVHNH |
| G3803 | (3642) | TTYDGVHNH |
| G3723 | (3619) | TTYDGVHNH |
| G1274 | (2384) | TTYEGVHNH |
| G3724 | (3620) | TTYEGVHNH |
| G1275 | (2908) | TTYEGSHNH |

FIG. 11B

| ID | SEQ ID | Sequence |
|---|---|---|
| G3515 | (3554) | SSSSYRGVRKRPWGKFAAEIRDPERGGARVWLGTFDTAEEAARAYDRAA |
| G3516 | (3555) | KEGKYRGVRKRPWGKFAAEIRDPERGGSRVWLGTFDTAEEAARAYDRAA |
| G3737 | (3627) | AASKYRGVRRRPWGKFAAEIRDPERGGSRVWLGTFDTAEEAARAYDRAA |
| G3383 | (3475) | TATKYRGVRRRPWGKFAAEIRDPERGGARVWLGTFDTAEEAARAYDRAA |
| G3517 | (3556) | EPTKYRGVRRRPWGKYAAAEIRDSSRHGVRIWLGTFDTAEEAARAYDRSA |
| G3739 | (3628) | EPTKYRGVRRRPWGKYAAAEIRDSSRHGVRIWLGTFDTAEEAARAYDRSA |
| G3381 | (3474) | LVAKYRGVRRRPWGKFAAAEIRDSSRHGVRVWLGTFDTAEEAARAYDRSA |
| G3380 | (3473) | ETTKYRGVRRRPSGKFAAEIRDSSRQSVRVWLGTFDTAEEAARAYDRAA |
| G3794 | (3641) | EPTKYRGVRRRPSGKFAAAEIRDSSRQSVRMWLGTFDTAEEAARAYDRAA |
| G1795 | (2387) | EHGKYRGVRRRPWGKYAAEIRDSRKHGERVWLGTFDTAEEAARAYDQAA |
| G30 | (2411) | EQGKYRGVRRRPWGKFAAEIRDSRKHGERVWLGTFDTAEDAARAYDRAA |
| G1791 | (3064) | NEMKYRGVRKRPWGKYAAEIRDSARHGARVWLGTFNTAEDAARAYDRAA |
| G3519 | (3558) | CEVRYRGIRRRPWGKFAAEIRDPTRKGTRIWLGTFDTAEQAARAYDAAA |
| G3518 | (3557) | VEVRYRGIRRRPWGKFAAEIRDPTRKGTRIWLGTFDTAEQAARAYDAAA |
| G1792 | (2386) | KQARFRGVRRRPWGKFAAEIRDPSRNGARLWLGTFETAEEAARAYDRAA |
| G3520 | (3559) | EEPRYRGVRRRPWGKFAAEIRDPARHGARVWLGTFLTAEEAARAYDRAA |

FIG. 13A

| | | |
|---|---|---|
| G3515 | (3554) | FAMKGATAMLNFPGDH |
| G3516 | (3555) | FAMKGATAVLNFPASG |
| G3737 | (3627) | FAMKGAMAVLNFPGRT |
| G3383 | (3475) | YAQRGAAAVLNFPAAA |
| G3517 | (3556) | NSMRGANAVLNFPEDA |
| G3739 | (3628) | YSMRGANAVLNFPEDA |
| G3381 | (3474) | YSMRGANAVLNFPADA |
| G3380 | (3473) | YAMRGHLAVLNFPAEA |
| G3794 | (3641) | YAMRGQIAVLNFPAEA |
| G1795 | (2387) | YSMRGQAAILNFPHEY |
| G30 | (2411) | YSMRGKAAILNFPHEY |
| G1791 | (3064) | FGMRGQRAILNFPHEY |
| G3519 | (3558) | FHFRGHRAILNFPNEY |
| G3518 | (3557) | FHFRGHRAILNFPNEY |
| G1792 | (2386) | FNLRGHLAILNFPNEY |
| G3520 | (3559) | YEMRGALAVLNFPNEY |

FIG. 13B

| | | |
|---|---|---|
| G3515 | (5136) | KVELECLDDKVLEDLL |
| G3516 | (5137) | KVELECLDDRVLEELL |
| G3737 | (5135) | KVELVYLDDKVLDELL |
| G3383 | (5131) | KIEFEYLDDKVLDDLL |
| G1795 | (5129) | VFEFEYLDDSVLEELL |
| G30   | (5130) | VFEFEYLDDSVLDELL |
| G1792 | (5128) | VFEFEYLDDKVLEELL |
| G3519 | (5133) | TEELEYLDNKLLEELL |
| G3518 | (5140) | TFEELEYFDNKLLEELL |
| G1791 | (5132) | VIEFEYLDDSLLEELL |
| G3520 | (5138) | VIEFECLDDKLLEDLL |
| G3517 | (5139) | VIEFEYLDDEVLQEML |
| G3739 | (5141) | VIELEYLDDEVLQEML |
| G3380 | (5142) | VIELECLDDQVLQEML |
| G3794 | (5143) | VIELECLDDQVLQEML |
| G3381 | (5134) | PIEFEYLDDHVLQEML |

FIG. 14

| | | |
|---|---|---|
| G4297 | (3761) | CELCGGAAAAVHCAADSAFLCPRCDAKVHGANFLASRHVRRRL---- |
| G4000 | (3712) | CELCGGAAAAVHCAADSAFLCLRCDAKVHGANFLASRHVRRRL---- |
| G4012 | (3718) | CELCGGVAAAVHCAADSAFLCLVCDDKVHGANFLASRHRRRRL---- |
| G4298 | (3762) | CELCGGVAAAVHCAADSAFLCLVCDDKVHGANFLASRHRRRRL---- |
| G4011 | (3717) | CALCGAAAAVHCEADAAFLCAACDAKVHGANFLASRHHRRRV---- |
| G1988 | (2389) | CELCGAEADLHCAADSAFLCRSCDAKFHASNELFARHFRRVICPNC |
| G4005 | (3714) | CELCDQQASLYCPSDSAFLCSDCDAAVHAANFLVARHLRRLLCSKC |
| G4004 | (3713) | CELCHQLASLYCPSDSAFLCFHCDAAVHAANFLVARHLRRLLCSKC |
| G4299 | (3763) | CELCNDQAALFCPSDSAFLCFHCDAKVHQANFLVARHLRLTLCSHC |
| G4007 | (3715) | CELCSQEAALHCASDEAFLCFDCDDRVHKANFLVARHVRQTLCSQC |
| G4009 | (3716) | CELCKGEAGVYCDSDAAYLCFDCDSNVHNANFLVARHIRRVICSGC |

FIG. 16

| ID | Sequence |
|---|---|
| G1760 (2385) | GRGKIVIQRIDDSTSRQVTFSKRRKGLIKKAKELAILCDAEVGLIIFSST |
| G152 (2433) | GRGKIVIQKIDDSTSRQVTFSKRRKGLIKKAKELAILCDAEVCLIIFSNT |
| G3982 (5163) | GRGKIVIQRIDKSTSRQVTFSKRRSGLLKKAKELAILCDAEVGVIFSST |
| G3980 (3710) | GRGKIVIRRIDNSTSRQVTFSKRRNGLIKKAKELAILCDAEVGVMIFSST |
| G3981 (3711) | GRGKIVIRRIDNSTSRQVTFSKRRNGLIKKAKELAILCDAEVGVMIFSST |
| G3485 (3541) | GRGKIVIRRIDNSTSRQVTFSKRRNGLIKKAKELAILCDAEVGVMIFSST |
| G860 (2756) | GRGKIAIKRINNSTSRQVTFSKRRNGLIKKAKELAILCDAEVGVIIFSST |
| G153 (2434) | GRGKIVIRRIDNSTSRQVTFSKRRSGLLKKAKELSILCDAEVGVIIFSST |
| G3479 (3535) | GRGKIVIRRIDNSTSRQVTFSKRRNGIFKKAKELAILCDAEVGLVIFSST |
| G3489 (3544) | GRGKIVIRRIDNSTSRQVTFSKRRNGIFKKAKELAILCDAEVGLVIFSST |
| G3488 (3543) | GRGKIVIRRIDNSTSRQVTFSKRRNGIFKKARELAILCDAEVGLVIFSST |
| G3480 (3536) | GRGKIVIRRIDNSTSRQVTFSKRRNGIFKKAKELAILCDAEVGLMIFSST |
| G3487 (3542) | GRGKIEIKRIDNATSRQVTFSKRRGGLFKKAKELAILCDAEVGLVVFSST |
| G3483 (3539) | GRGKIEIKRIDNATSRQVTFSKRRSGLFKKARELSILCDAEVGLLVFSST |
| G3481 (3537) | GRGKIVIRRIDNSTSRQVTFSKRRNGLLKKAKELSILCDAEVGLVVFSST |
| G3484 (3540) | GRGKIAIRRIDNSTSRQVTFSKRRNGLLKKARELSILCDAEVGLMVFSST |

FIG. 18A

| | | |
|---|---|---|
| G1760 | (2385) | GKLYDF |
| G152 | (2433) | DKLYDF |
| G3982 | (5163) | GKLYEF |
| G3980 | (3710) | GKLYDF |
| G3981 | (3711) | GKLYDF |
| G3485 | (3541) | GKLYDF |
| G860 | (2756) | GRLYDF |
| G153 | (2434) | GKLYDY |
| G3479 | (3535) | GRLYEY |
| G3489 | (3544) | GRLYEY |
| G3488 | (3543) | GRLYEY |
| G3480 | (3536) | GRLYEY |
| G3487 | (3542) | GRLYHF |
| G3483 | (3539) | SRLYDF |
| G3481 | (3537) | GRLYEF |
| G3484 | (3540) | GKLYDY |

FIG. 18B

```
G2514 (3277)  DPVYRGIRCRSGKWVSEIREPRKTTTRIWLGTYPMAEMAAAAYDVAAMALK
G976  (2806)  NPVYRGIRCRSGKWVSEIREPKKTTRVWLGTYPTPEMAAAAYDVAALALK
G913  (2781)  HSIFRGIRLRNGKWVSEIREPRKTTRIWLGTYPVPEMAAAAYDVAALALK

G2514 (3277)  GREAVLNFPGSVGSYPV
G976  (2806)  GGDTLLNFPDSLGSYPI
G913  (2781)  GPDAVLNFPGLALTYVA
```

FIG. 20

| ID | | Sequence |
|---|---|---|
| G3510 | (3553) | PHRPKKLRLSKEQSRLLEESFRLNHTLTPKQKEALAIKLKLRPRQVEVWFQNRRARTKLKQ |
| G4370 | (17838) | PHRPKKLRLSKEQSRLLEESFRLNHTLSPKQKEALAIKLKLRPRQVEVWFQNRRARTKLKH |
| G3490 | (3545) | PHRAKKLRLSKEQSRLLEESFRLNHTLTPKQKEALAVKLKLRPRQVEVWFQNRRARTKLKQ |
| G4369 | (17834) | PHRAKKLRLSKEQSRLLEESFRLNHTLTPKQKEALAVKLKLRPRQVEVWFQNRRARTKLKQ |
| G3524 | (3560) | EPPRKKLRLTKEQSRLLEESFRQNHTLNPKQKESLAMQLKLRPRQVEVWFQNRRARSKLKQ |
| G4371 | (17830) | EPPRKKLRLTKEQSLLLEESFRQNHTLNPKQKESLAMQLKLRPRQVEVWFQNRRARSKLKQ |
| G1543 | (3004) | APPRKKLRLTREQSRLLEDSFRQNHTLNPKQKEVLAKHLMLRPQIEVWFQNRRARSKLKH |
| G2712 | (17842) | GRRRKKLRLTKEQSHLLEESFIQNHTLTPKQKKDLATFLKLSQRQVEVWFQNRRARSKLKH |
| | | **::*.::*:*::. **:. :: * * ::****:::*:* |

Figure 21

```
G3490  (17827)  -KQTELECEYLKRCFGSLTEENRRLQREVEELRAMRVAPPTVLS-
G4369  (17835)  -KQTELECEYLKRCFGSLTEENRRLQREVEELRAMRVAPPTVLS-
G3510  (17826)  -KQTEMECEYLKRCFGSLTEENRRLQREVEELRAMRVAPPTVLS-
G4370  (17839)  -KHTEMECEYLKRCFGSLTEENRRLQREVEELRAMRMAPPTVLS-
G3524  (17825)  GKQTEMECEYLKRWFGSLTEQNRRLQREVEELRAMRLAIKVGPPTVIS-
G4371  (17831)  -KQTEMECEYLKRWFGSLTEQNRRLQREVEELRAIKVGPPTVIS-
G1543  (17824)  -KQTEMECEYLKRWFGSLTEENHRLHREVEELRAIKVGPTTVNSA
G2712  (17843)  -KHTEMECEYLKRWFGSLKEQNRRLQIEVEELRALKPSSTS---
                 *  ****:*******:***: *:**  *****:*: .. .
```

Figure 22

```
G1266  (2902)   EKSYRGVRKRPWGKFAAEIRDSTRNGIRVWLGTFESAEEAALAYDQAAFSMRGSSAILNF
G5184 (17935)   EKSYRGVRKRPWGKFAAEIRDSTRNGIRVWLGTFDSAEAAALAYDQAAFSMRGSAAILNF
G1752  (3045)   ERSYRGVRKRPWGKFAAEIRDSTRHGMRVWLGTFDSAEAAALAYDQAAFATKGSLATLNF
G2512  (3275)   EKSYRGVRKRPWGKFAAEIRDSTRNGIRVWLGTFDKAEEAALAYDQAAFALKGSLAVLNF
G5183 (17934)   QQAFRGVRKRPWGKFAAEIRDSTRKGIRVWLGTFDTAEAAALAYDQAAFAMRGSAAVLNF
G5186 (17936)   KRPFRGVRKRPWGKFAAEIRDSTRNGVRVWLGTFDSAEEAALAYDQAALSTRGSMAVLNF
G5185 (17933)   PAPYIGVRKRPWGKFAAEIRDSTRKGARVWLGTFDSPEAAAMAYDQAAFSVRGAAAVLNF
G5170 (17937)   EKHYIGVRKRPWGKYASEIRDSTRNGIRVWLGTFDTAEEAALAYDQAALSMRGPWSLLNF
                    **:****** ** .******:*:*****:**:: **  .****** .*: *  ::**

G1266  (2902)   SAERVQESL
G5184 (17935)   PAEIVRESL
G1752  (3045)   PVEVVRESL
G2512  (3275)   PADVVEESL
G5183 (17934)   PMEQVRRSM
G5186 (17936)   PEEVVRESL
G5185 (17933)   PVERVQESL
G5170 (17937)   PMEHVKKSL
                  *  ::*:
```

Figure 23

| | | |
|---|---|---|
| G2933 | (17956) | PVVVKKLNHNASERDRRKKINTLFSSLRSCLPASDQSKKLSIPETVSKSLKYIPELQQQVK |
| G2932 | (17957) | PVVVKKLNHNASERDRRKKINSLFSSLRSCLPASGQSKKLSIPATVSRSLKYIPELQEQVK |
| G2928 | (17958) | PVVMKKLNHNASERERRKKINTMFSSLRSCLPPTNQTKKLSVSATVSQALKYIPELQEQVK |
| G5192 | (17961) | PTMVKKLNHNASERDRRKKINSLYSSLRSLLPAADQAKKLSIPSTVSRVLKYIPELQKQVK |
| G5191 | (17963) | ----KKLSHNASERDRRKKVNHLVSSLRSLLPGPDQTKKMSIPATVSRVLKYIPELQHQVQ |
| G5190 | (17960) | ----RKLSHNAYERDRRKQLNDLYSSLRSLLPDADHTKKLSIPTTVSRVLKYIPELQKQV- |
| G5189 | (17962) | ----RKLSHNAYERDRRKQLNELYSSLRALLPDADHTKKLSIPTTVSRVLKYIPELQKQVE |
| G5193 | (17959) | ----RKISHNAYERDRRKQLNELYSDLRSLLPDSDHTKKLSIPITVSRVLKYIPELQKQV- |
| G2936 | (17964) | VVLEKKLNHNASERDRRKKLNALYSSLRALLPLSDQKRKLSIPMTVARVVKYIPEQKQELQ |
| | | .: *.:.* *::: : :: . .. :: *:*.:*:::* |

Figure 24

```
G154   (17993)  VRGKTQMKRIENATSRQVTFSKRRNGLLKKAFELSVLCDAEVSLIIFSPKGKLYEF
G5306  (18002)  VRGKTQMKRIENATSRQVTFSKRRNGLLKKAFELSVLCDAEVSLIIFSPKGKLYEF
G5307  (18020)  VRGKTQMKRIENATSRQVTFSKRRNGLLKKAFELSVLCDAEVSLIIFSPRGKLYEF
G4062  (18001)  VRGKTQMKRIENATSRQVTFSKRRNGLLKKAFELSVLCDAEVSLIIFSPKAKLYEF
G4064  (18014)  VRGKTQMKRIENATSRQVTFSKRRNGLLKKAFELSVLCDAEVALIIFSPRGKLYEF
G5315  (18017)  VRGKTQMRRIENATSRQVTFSKRRNGLLKKAFELSVLCDAEVALIIFSPRGKLYEF
G5311  (18005)  VRGKTQMRRIENATSRQVTFSKRRNGLFKKAFELSVLCDAEVALIIFSPRGKLSEF
G5313  (18006)  VRGKTQMRRIENATSRQVTFSKRRNGLLKKAFELSVLCDAEVAVIIFSPRGKLYEF
G4063  (18013)  VRGKTQLRRIENATSRQVTFSKRRNGLLKKAFELSVLCDAEVALIIFSPRGKLYEF
G5309  (18000)  VRGKTQMRRIENATSRQVTFSKRRNGLLKKAFELSVLCDAEVGLIIFSPRGKLYEF
G5319  (18010)  VRGKTQMRRIENATSRQVTFSKRRNGLLKKAFELSVLCDAEVGLVIFSPRGKLYEF
G5310  (18018)  VRGKTQMRRIENATSRQVTFSKRRNGLLKKAFELSVLCDAQVGLVIFSPRGKQYEF
G5318  (18009)  VRGKTQMRRIENATSRQVTFSKRRNGLLKKAFELSVLCDAEVSLIIFSTRGKLYEF
G5317  (18008)  VRGKTQMRRIENATSRQVTFSKRRNGLLKKAFELSVLCDAEVALIIFSPRGKLYEF
G5314  (18064)  VRGKTQMKRIENATSRQVTFSKRRNGLLKKAFELSVLCDAEVALIVFSPRGKLYEF
G5303  (18015)  VRGKTQMKRIENATSRQVTFSKRRNGLLKKAFELSVLCDAEVALIVFSPRGRLYEF
G5312  (17994)  VRGRTELKRIENPTSRQVTFSKRRNGLLKKAFELSVLCDAEVALIVFSPRGKLYEF
G4067  (18012)  VRGKTQMKRIENPTSRQVTFSKRRNGLLKKAFELSVLCDAEVALIVFSPRGKLYEF
G4065  (18003)  VRGKTQMKRIENPTSRQVTFSKRRNGLLKKAFELSVLCDVEVALIVFSPRGKPYEF
G4066  (18011)  VRGKTQMKRIENPTSRQVTFSKRRNGLLKKAFELSVLCDVEVALIIFSPRGKPYEF
G5305  (18004)  VRGKVEMKRIENSTSRQVTFSKRRNGLLKKAFELSVLCDAEVALIIFSPRGKLYEF
G149   (17995)  VRGKTEMKRIENATSRQVTFSKRRNGLTKKAYELSVLCDAEVAFIIFSHKGRLYEF
G627   (17996)  VRGKTEMKRIENATSRQVTFSKRRNGMLKKAYELSVLCDAEVAVIIFSQKGRLYEF
G5304  (18016)  VRGKTQIKRIENATSRQVTFSKRRSGLFKKAHELSVLCDAQLSLIIFSQRGRLYEF
G4061  (18019)  VRGKIEMKKIENDTSRQVTFSKRRNGLFKKAHELSVLCDAEVAAMIFSQKGRLYEF
G5316  (18007)  VRGKIEMKKIENATSRQVTFSKRRSGLFKKAHELSVLCDAQVAAIVFSQRGRLYEF
G1011  (17997)  VRGKIEIKKIENVTSRQVTFSKRRSGLFKKAHELSVLCDAQVAAIVFSQSGRLHEY
G1797  (17998)  VRGKIEIKKIENVTSRQVTFSKRRSGLFKKAHELSVLCDAQVAAIVFSQSGRLHEY
G1798  (17999)                                                          *
                *** :    ** .***********.**:***: *******.::.::::**   ::: .
```

Figure 25

| | |
|---|---|
| G1782 (3060) | -EPIFVNAKQYHAILRRKHRAKLEAQNKLIKCRKPYLHESRHLHALKRARGSGGRFLNTK |
| G1363 (2940) | -EPIFVNAKQYQAILRRERRAKLEAQNKLIKVRKPYLHESRHLHALKRVRGSGGRFLNTK |
| G4262 (3748) | -EPIYVNAKQYHAILRRQLRAKLEAENKLVKSRKPYLHESRHLHAMKRARGTGGRFLNTK |
| G4263 (3749) | -EPIYVNAKQYHAILRRQLRAKLEAENKLVKSRKPYLHESRHLHAMKRARGTGGRFLNTK |
| G3925 (3701) | -EPIYVNAKQYHAILRRQLRAKLEAENKLVKNRKPYLHESRHQHAMKRARGTGGRFLNTK |
| G3922 (5117) | -EPIYVNAKQYHAILRRQTRAKLEAQNKMVKNRKPYLHESRHRHAMKRARGSGGRFLNTK |
| G3920 (3698) | -EPVYVNAKQYHGILRRQSRAKAEIEKKVIKNRKPYLHESRHLHAMRRARGNGGRFLNTK |
| G4270 (3755) | EAPIYVNAKQYDAIMRRCARAKAERENRLVKGRKPYLHESRHQHALRRPRGSGGRFLNTK |
| |  ******   *:.   *:**   :*::* *******:  :*:* *:***** |

Figure 26

| ID | Sequence |
|---|---|
| G5472 (17864) | -GRGRVELKRIENKINRQVTFSKRRNGLLKKAYELSVLCDAEVALIIFSSRGKLYEF |
| G5487 (17911) | -GRGRVQLRRIENKINRQVTFSKRRNGLLKKAYELSVLCDAEVALIIFSTRGKLYEF |
| G5480 (17917) | -GRGRVQLRRIENKINRQVTFSKRRNGLLKKAYELSVLCDAEVALIIFSTRGKLYEF |
| G5471 (17861) | -GRGRVELKRIENKINRQVTFSKRRNGLLKKAYELSVLCDAEVALIIFSGRGKLYEF |
| G5483 (17846) | -GRGRVELKRIENKINRQVTFSKRRNGLLKKAYELSVLCDAEVALIVFSSRGKLYEF |
| G5484 (17849) | -GRGRVEMKRIENKINRQVTFSKRRNGLLKKAYELSVLCDAEVALIIFSSRGKLYEF |
| G142 (2427) | -GRGRVEMKRIENKINRQVTFSKRRNGLLKKAYELSVLCDAEVALIIFSSRGKLYEF |
| G5485 (17920) | -GRGRVELKRIENKINRQVTFSKRRNGLLKKAYELSVLCDAEVALIIFSSRGKLYEF |
| G5486 (17921) | -GRGRVELKRIENKINRQVTFSKRRNGLLKKAYELSVLCDAEVALIIFSSRGKLYEF |
| G5481 (17918) | -GRGRVELKRIENKINRQVTFSKRRNGLLKKAYELSVLCDAEVALIIFSSRGKLYEF |
| G5478 (17915) | -GRGRVELKRIENKINRQVTFSKRRNGLLKKAYELSVLCDAEVALIIFSSRGKLYEF |
| G5477 (17914) | -GRGRVELKRIENKINRQVTFSKRRNGLLKKAYELSVLCDAEVALIIFSSRGKLYEF |
| G5474 (17913) | -GRGRVELKRIENKINRQVTFSKRRNGLLKKAYELSVLCDAEVALIIFSSRGKLYEF |
| G5473 (17912) | -GRGRVELKRIENKINRQVTFSKRRNGLLKKAYELSVLCDAEVALIIFSSRGKLYEF |
| G5472 (17864) | -GRGRVELKRIENKINRQVTFSKRRNGLLKKAYELSVLCDAEVALIIFSSRGKLYEF |
| G5470 (17858) | -GRGRVELKRIENKINRQVTFSKRRNGLLKKAYELSVLCDAEVALIIFSSRGKLYEF |
| G5476 (17855) | -GRGRVELKRIENKINRQVTFSKRRNGLLKKAYELSVLCDAEVALIIFSSRGKLYEF |
| G5475 (17852) | -GRGRVELKRIENKINRQVTFSKRRNGLLKKAYELSVLCDAEVGLIIFSSRGKLYEF |
| G5479 (17916) | -GRGRVELKRIENKINRQVTFSKRRNGLLKKAYELSVLCDAEVGLIIFSSRDKLYEF |
| G5488 (17910) | -GRGRVELKRIENKINRQVTFSKRRNGLLKKAYELSVLCDAEVALIIFSSRGKLYEF |
| G5482 (17919) | -GRGKVELKRIENKINRQVTFSKRRNGLLKKAYELSVLCDAEVALIIFSSRGKLYEF |
| G148 (2431) | MGRGKVEVKRIENKITRQVTFSKRKSGLLKKAYELSVLCDAEVSLIIFSTGGKLYEF |
|  | .*:** :**********.********** . *..**** |

Figure 27

```
G3401  (3493)   GSKNKPKPPIFVTRDSPNALRSHVMEVAGGADVAESIAHFARRRQRGVCVLSGAGTVEDV
G3403 (17879)   GSKNKPKPPIFVTRDSPNALRSHVMEVAGGADVAESIAHFARRRQRGVCVLSGAGTVANV
G3932 (17886)   GSKNKPKPPIFVTRDSPNSLRSHVMEVAGGADVADAIAQFSRRRQRGVCVLSGAGTVANV
G3456  (3522)   GSRNKPKPPIFVTRDSPNALRSHVMEIAVGADVAESVAQFARRRQRGVSILSGSGTVVNV
G1069  (5149)   GSKNKPKAPIFVTRDSPNALRSHVLEISDGSDVADTIAHFSRRRQRGVCVLSGTGSVANV
G2153  (3203)   GSKNKPKPPIFVTRDSPNALKSHVMEIASGTDVIETLATFARRRQRGICILSGNGTVANV
G3462 (17882)   GSKNKPKPPIVIFLSPNALRSHVLEIASGRDVAESIAAFANRRHRGVSVLSGSGIVANV
G3556  (3584)   GSKNKPKPPVVTRESPNAMRSHVLETASGADIVEAIAGFSRRRQRGVSVLSGSGAVTNV
                *.:****. **     :  ::*: *  *  ..*  *:: *  . *:***: ** : ::

G3401  (3493)   ALRQ--------PAAPSA--VVALRGRFEILSLTGTFLPGPAPPGSTGLTVYLAGGQGQVVG
G3403 (17879)   ALRQ--------PSAPGA--VVALHGRFEILSLTGTFLPGPAPPGSTGLTVYLAGGQGQVVG
G3932 (17886)   TLRQ--------PSAPGA--VVALHGRFEILSLTGAFLPGAPPGATGLTVYLAGGQGQVVG
G3456  (3522)   NLRQ--------PTAPGA--VMALHGRFDILSLTGSFLPGSPPGATGLTIYLAGGQGQIVG
G1069  (5149)   TLRQ--------AAAPGG--VVSLQGRFEILSLTGAFLPGSPPGSTGLTVYLAGVQGQVVG
G2153  (3203)   TLRQPSTAAVAAPGGAAVLALQGRFEILSLTGAFLPSPSPSGAFLPSPSGAFLPSPSPSGAFLPSPSGA
G3462 (17882)   TLRQ--------PAAP-AG-VITLHGRFEILSLSGAFLPSPSPSGAFLPAPAPPGATGLAVYLAGGQGQVVG
G3556  (3584)   TLRQ--------PAGTGAA-AVALRGRFEILSMSGAFLPAPAPPGATGLAVYLAGGQGQVVG
                 **            .    . :* **:**::.*:**.      .*:**:: ** :*::*

G3401  (3493)   GSVVGTLTAAGPVMVIASTFANATYERLPLDQ
G3403 (17879)   GSVVGSLIAAGPVMVIASTFANATYERLPLEE
G3932 (17886)   GSVVGSLVAAGPVMVIAATFANATYERLPLEE
G3456  (3522)   GSVVGPLVAAGPVLVMAATFSNATFANATYERLPLED
G1069  (5149)   GSVVGPLLAIGSVMVIAATFSNATYERLPMEE
G2153  (3203)   GSVVGPLMAAGPVMLIAATFSNATYERLPLEE
G3462 (17882)   GNVAGSLVASGPVMVIAATFANATFANATYERLPLED
G3556  (3584)   GSVMGELIASGPVMVIAATFGNATYERLPLD-
                *.: *  :*.*.*: :*:**.**: :*** . 
```

Figure 28

| | | |
|---|---|---|
| G202 | (180061) | KGAWTTEEDKKLISYIHDHGEGGWRDIPQKAGLKRCGKSCRLRWTNYLKPEIKRGEFS |
| G243 | (180063) | KGAWTTEEDKKLISYIHDHGEGGWRDIPEKAGLKRCGKSCRLRWTNYLKPDIKRGEFS |
| G201 | (180051) | KGAWTAEEDKKLISYIHEHGGGWRDIPQKAGLKRCGKSCRLRWANYLKPDIKRGEFS |
| G671 | (180059) | KGAWTPEEDQKLLSYLNRHGEGGWRTLPEKAGLKRCGKSCRLRWANYLRPDIKRGEFT |
| G2340 | (180052) | KGAWTQEEDQKLIAYVQRHGEGGWRTLPDKAGLKRCGKSCRLRWANYLRPDIKRGEFS |
| G656 | (180060) | KGAWTPEEDQKLIAYLHLHGEGGWRTLPEKAGLKRCGKSCRLRWANYLRPDIKRGEFS |
| | | ** *:*: :*.: ***:*:* *.******.***** :*:*:**** |

| | | |
|---|---|---|
| G202 | (180061) | SEEEQIIIMLHASRGNKWSVIARHLPRRTDNEIKNYWNTHLKK |
| G243 | (180063) | YEEEQIIIMLHASRGNKWSVIARHLPKRTDNEVKNYWNTHLKK |
| G201 | (180051) | YEEEQIIIMLHASRGNKWSVIARHLPKRTDNEIKNYWNTHLKK |
| G671 | (180059) | EDEERSIISLHALHGNKWSAIARGLPGRTDNEIKNYWNTHIKK |
| G2340 | (180052) | QDEEDSIINLHAIHGNKWSAIARKIPRRTDNEIKNHWNTHIKK |
| G656 | (180060) | PEEDDTIIKLHALKGNKWAAIATSLAGRTDNEIKNYWNTNLKK |
| | | ** * *: : .: . ***::*.: |

Figure 29

STRESS TOLERANCE IN PLANTS

RELATIONSHIP TO COPENDING APPLICATIONS

This application is a continuation of co-pending U.S. application Ser. No. 14/480,473, filed Sep. 8, 2014, which is a divisional of U.S. application Ser. No. 13/244,288, filed Sep. 24, 2011, which is a continuation in part of U.S. application Ser. No. 12/077,535 (issued as U.S. Pat. No. 8,030,546), which claims the benefit of Application No. 60/961,403, filed Jul. 20, 2007. Application Ser. No. 12/077,535 is a continuation-in-part of application Ser. No. 10/286,264, filed Nov. 1, 2002, which is a divisional of application Ser. No. 09/533,030, filed Mar. 22, 2000, which claims the benefit of Application No. 60/125,814, filed Mar. 23, 1999. Application Ser. No. 12/077,535 is a continuation-in-part of application Ser. No. 10/675,852, filed Sep. 30, 2003. Application Ser. No. 12/077,535 is a continuation-in-part of application Ser. No. 11/479,226, filed Jun. 30, 2006 (issued as U.S. Pat. No. 7,858,848), which is a continuation-in-part of application Ser. No. 09/713,994, filed Nov. 16, 2000, which claims the benefit of Application No. 60/166,228, filed Nov. 17, 1999, which also claims the benefit of Application No. 60/197,899, filed Apr. 17, 2000, which also claims the benefit of Application No. 60/227,439, filed Aug. 22, 2000. Application Ser. No. 12/077,535 is a continuation-in-part of application Ser. No. 10/669,824, filed Sep. 23, 2003, which is a continuation-in-part of, Ser. No. 09/823,676, filed Mar. 30, 2001 (issued as U.S. Pat. No. 6,717,034). Application Ser. No. 12/077,535 is a continuation-in-part of application Ser. No. 11/725,235, filed Mar. 16, 2007 (issued as U.S. Pat. No. 7,601,893), which is a divisional of application Ser. No. 10/225,068, filed Aug. 9, 2002 (issued as U.S. Pat. No. 7,193,129), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001; application Ser. No. 10/225,068 is also a continuation-in-part of application Ser. No. 09/837,944, filed Apr. 18, 2001, and is also a continuation-in-part of application Ser. No. 10/171,468, filed Jun. 14, 2002. Application Ser. No. 12/077,535 is a continuation-in-part of application Ser. No. 11/728,567, filed Mar. 26, 2007 (issued as U.S. Pat. No. 7,635,800), which is a divisional of application Ser. No. 10/225,066, filed Aug. 9, 2002 (issued as U.S. Pat. No. 7,238,860), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001. Application Ser. No. 10/225,066 is also a continuation-in-part of application Ser. No. 09/837,944, filed Apr. 18, 2001, and is a continuation-in-part of application Ser. No. 10/171,468, filed Jun. 14, 2002. Application Ser. No. 12/077,535 is a continuation-in-part of application Ser. No. 11/375,241, filed Mar. 16, 2006 (issued as U.S. Pat. No. 7,598,429), which claims the benefit of Application No. 60/713,952, filed Aug. 31, 2005. Application Ser. No. 11/375,241 is also a continuation-in-part of application Ser. No. 10/225,067, filed Aug. 9, 2002 (issued as U.S. Pat. No. 7,135,616), which claims the benefit of Application No. 60/310,847, filed Aug. 9, 2001, which also claims the benefit of Application No. 60/336,049, filed Nov. 19, 2001, and also claims the benefit of Application No. 60/338,692, filed Dec. 11, 2001. Application Ser. No. 10/225,067 is also a continuation-in-part of application Ser. No. 09/837,944, filed Apr. 18, 2001, and is also a continuation-in-part of application Ser. No. 10/171,468, filed Jun. 14, 2002. Application Ser. No. 12/077,535 is a continuation-in-part of application Ser. No. 11/069,255, filed Feb. 28, 2005 (issued as U.S. Pat. No. 8,558,059), which is a continuation-in-part of application Ser. No. 10/112,887, filed Mar. 18, 2002. Application Ser. No. 12/077,535 is a continuation-in-part of application Ser. No. 10/374,780, filed Feb. 25, 2003 (issued as U.S. Pat. No. 7,511,190), which is a continuation-in-part of application Ser. No. 09/934,455, filed Aug. 22, 2001, which is a continuation-in-part of application Ser. No. 09/713,994, Nov. 16, 2000, which is also a continuation-in-part of application Ser. No. 09/837,944, filed Apr. 18, 2001, which also claims priority to Application No. 60/227,439, filed Aug. 22, 2000. Application Ser. No. 10/374,780 is also a continuation-in-part of application Ser. No. 10/225,068, filed Aug. 9, 2002 (issued as U.S. Pat. No. 7,193,129), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001. Application Ser. No. 10/225,068 is also a continuation-in-part of application Ser. No. 09/837,944, filed Apr. 18, 2001, and is also a continuation-in-part of application Ser. No. 10/171,468, filed Jun. 14, 2002. Application Ser. No. 10/374,780 is also a continuation-in-part of application Ser. No. 10/225,066, filed Aug. 9, 2002 (issued as U.S. Pat. No. 7,238,860), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; application Ser. No. 10/225,066 is also a continuation-in-part of application Ser. No. 09/837,944, filed Apr. 18, 2001, and is also a continuation-in-part of application Ser. No. 10/171,468, filed Jun. 14, 2002. Application Ser. No. 10/374,780 is also a continuation-in-part of application Ser. No. 10/225,067, filed Aug. 9, 2002 (issued as U.S. Pat. No. 7,135,616), which claims the benefit of Application No. 60/310,847, filed Aug. 9, 2001, and also claims the benefit of Application No. 60/336,049, filed Nov. 19, 2001, and also claims the benefit of Application No. 60/338,692, filed Dec. 11, 2001; application Ser. No. 10/225,067 is also a continuation-in-part of application Ser. No. 09/837,944, filed Apr. 18, 2001, and is also a continuation-in-part of application Ser. No. 10/171,468, filed Jun. 14, 2002. Application Ser. No. 12/077,535 is a continuation-in-part of application Ser. No. 10/546,266, filed Aug. 19, 2005 (issued as U.S. Pat. No. 7,659,446), which is a '371 National Stage filing of International Application No. PCT/US2004005654, filed Feb. 25, 2004 (converted), which is a continuation-in-part of application Ser. No. 10/374,780, filed Feb. 25, 2003 (issued as U.S. Pat. No. 7,511,190), and is also a continuation-in-part of application Ser. No. 10/675,852, filed Sep. 30, 2003. Application Ser. No. 12/077,535 is also a continuation-in-part of application Ser. No. 10/412,699, filed Apr. 10, 2003 (issued as U.S. Pat. No. 7,345,217), which is a continuation-in-part of application Ser. No. 10/295,403, filed Nov. 15, 2002, which is a divisional of application Ser. No. 09/394,519, filed Sep. 13, 1999, which claims the benefit of Application No. 60/101,349, filed Sep. 22, 1998, which also claims the benefit of Application No. 60/103,312, filed Oct. 6, 1998, which also claims the benefit of Application No. 60/108,734, filed Nov. 17, 1998, which also claims the benefit of Application No. 60/113,409, filed Dec. 22, 1998. Application Ser. No. 10/412,699 is also a continuation-in-part of application Ser. No. 09/489,376, filed Jan. 21, 2000, which claimed priority to Application No. 60/116,841, filed Jan. 22, 1999. Application Ser. No. 10/412,699 is also a continuation-in-part of application Ser. No. 10/302,267, filed Nov. 22, 2002 (issued as U.S. Pat. No. 7,223,904), which is a divisional of application Ser. No. 09/506,720, filed Feb. 17, 2000, which claims the benefit of Application No. 60/120,880, filed Feb. 18, 1999, which also claims the benefit of Application No. 60/121,037, filed Feb. 22, 1999, which also claims the benefit of Application No. 60/124,278, filed Mar. 11, 1999, which also claims the benefit of Application No. 60/129,450, filed Apr. 15, 1999, which also claims the benefit of Application No. 60/135,134, filed May 20, 1999, which also claims the benefit of Application No. 60/144,153, filed Jul. 15, 1999, which also claims the benefit of Application No. 60/161,143, filed Oct. 22, 1999, which also claims the benefit of Application No. 60/162,656, filed Nov. 1, 1999. Application Ser. No. 10/412,699 is also a continuation-in-part of application Ser. No. 10/278,173, filed Oct. 21, 2002, which is a divisional of application Ser. No. 09/533,392, filed Mar. 22, 2000, which claims the benefit of Application No. 60/125,814, filed Mar. 23, 1999. Application Ser. No. 10/412,699 is also a continuation-in-part of application Ser. No. 09/533,029, filed Mar. 22, 2000 (issued as U.S. Pat. No. 6,664,446), which claims the benefit of Application No. 60/125,814, filed Mar. 23, 1999. Application Ser. No. 10/412,699 is also a continuation-in-part of application Ser. No. 10/278,536, filed Oct. 22, 2002, which is a divisional of application Ser. No. 09/532,591, filed Mar. 22, 2000, which claims priority to Application No. 60/125,814, filed Mar. 23, 1999. Application Ser. No. 10/412,699 is also a continuation-in-part of application Ser. No. 09/713,994, filed Nov. 16, 2000, which claims the benefit of Application No. 60/166,228, filed Nov. 17, 1999, which also claims the benefit of Application No. 60/197,899, filed Apr. 17, 2000, which also claims the benefit of Application No. 60/227,439, filed Aug. 22, 2000. Application Ser. No. 10/412,699 is also a continuation-in-part of application Ser. No. 09/819,142, filed Mar. 27, 2001. Application Ser. No. 10/412,699 is also a continuation-in-part of application Ser. No. 09/934,455, filed Aug. 22, 2001, which is a continuation-in-part of application Ser. No. 09/713,994, filed Nov. 16, 2000, which is also a continuation-in-part of application Ser. No. 09/837,944, filed Apr. 18, 2001, which also claim the benefit of Application No. 60/227,439, filed Aug. 22, 2000. Application Ser. No. 10/412,699 is also a continuation-in-part of application Ser. No. 10/225,068, filed Aug. 9, 2002 (issued as U.S. Pat. No. 7,193,129), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,068 is also a continuation-in-part of application Ser. No. 09/837,944, filed Apr. 18, 2001, and is also a continuation-in-part of application Ser. No. 10/171,468, filed Jun. 14, 2002. Application Ser. No. 10/412,699 is also a continuation-in-part of application Ser. No. 10/225,066, filed Aug. 9, 2002 (issued as U.S. Pat. No. 7,238,860), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,066 is also a continuation-in-part of application Ser. No. 09/837,944, filed Apr. 18, 2001, and is also a continuation-in-part of application Ser. No. 10/171,468, filed Jun. 14, 2002. Application Ser. No. 10/412,699 is also a continuation-in-part of application Ser. No. 10/225,067, filed Aug. 9, 2002 (issued as U.S. Pat. No. 7,135,616), which claims the benefit of Application No. 60/310,847, filed Aug. 9, 2001, which also claims the benefit of Application No. 60/336,049, filed Nov. 19, 2001, which also claims the benefit of Application No. 60/338,692, filed Dec. 11, 2001; and, application Ser. No. 10/225,067 is also a continuation-in-part of application Ser. No. 09/837,944, filed Apr. 18, 2001, and is also a continuation-in-part of application Ser. No. 10/171,468, filed Jun. 14, 2002. Application Ser. No. 10/412,699 is also a continuation-in-part of application Ser. No. 10/374,780, filed Feb. 25, 2003 (issued as U.S. Pat. No. 7,511,190). Application Ser. No. 12/077,535 is a continuation-in-part of application Ser. No. 10/559,441, filed Dec. 2, 2005, which is a '371 National Stage filing of International Application No. PCT/US2004/017768, filed Jun. 4, 2004 (converted), which is a continuation-in-part of application Ser. No. 10/456,882, filed Jun. 6, 2003. Application Ser. No. 12/077,535 is a continuation-in-part of application Ser. No. 11/642,814, filed Dec. 20, 2006 (issued as U.S. Pat. No. 7,825,296), which is a divisional of application Ser. No. 10/666,642, filed Sep. 18, 2003 (issued as U.S. Pat. No. 7,196,245), which claims the benefit of Application No. 60/411,837, filed Sep. 18, 2002, and also claims the benefit of Application No. 60/434,166, filed Dec. 17, 2002, and also claims the benefit of Application No. 60/465,809, filed Apr. 24, 2003. Application Ser. No. 12/077,535 is a continuation-in-part of application Ser. No. 10/714,887, filed Nov. 13, 2003, which is a continuation-in-part of application Ser. No. 10/456,882, filed Jun. 6, 2003; and application Ser. No. 10/714,887 is also a continuation-in-part of application Ser. No. 10/666,642, filed Sep. 18, 2003 (issued as U.S. Pat. No. 7,196,245), which claims the benefit of Application No. 60/411,837, filed Sep. 18, 2002, which also claims the benefit of Application No. 60/434,166, filed Dec. 17, 2002, which also claims the benefit of Application No. 60/465,809, filed Apr. 24, 2003. Application Ser. No. 12/077,535 is a continuation-in-part of application Ser. No. 11/435,388, filed May 15, 2006 (issued as U.S. Pat. No. 7,663,025), which is a continuation-in-part of International Application No. PCT/US04/37584, filed Nov. 12, 2004 (converted), which is a continuation-in-part of application Ser. No. 10/714,887, filed Nov. 13, 2003, and also claims the benefit of Application No. 60/527,658, filed Dec. 5, 2003, and also claims the benefit of Application No. 60/542,928, filed Feb. 5, 2004. Application Ser. No. 12/077,535 is a continuation-in-part of application Ser. No. 11/632,390, filed Jan. 11, 2007, which is a '371 National Stage filing of International Application No. PCT/US2005/025010, filed Jul. 14, 2005 (converted), which claims the benefit of Application No. 60/588,405, filed Jul. 14, 2004. Application Ser. No. 12/077,535 is a continuation-in-part of application Ser. No. 12/064,961, filed Feb. 26, 2008, which is a continuation-in-part of PCT application PCT/US06/34615, filed Aug. 31, 2006, which claims the benefit of Application No. 60/713,952, filed Aug. 31, 2005. Application Ser. No. 12/077,535 is a continuation-in-part of International Application no. PCT/US2006/34615, filed Aug. 31, 2006, which claims the benefit of Application No. 60/713,952, filed Aug. 31, 2005. Application Ser. No. 12/077,535 is a continuation-in-part of application Ser. No. 10/903,236, filed Jul. 30, 2004, which is a continuation-in-part of application Ser. No. 10/456,882, filed Jun. 6, 2003, and is also a continuation-in-part of application Ser. No. 10/666,642, filed Sep. 18, 2003 (issued as U.S. Pat. No. 7,196,245), which claims the benefit of Application No. 60/411,837, filed Sep. 18, 2002, and also claims the benefit of Application No. 60/465,809, filed Apr. 24, 2003. Application Ser. No. 12/077,535 is a continuation-in-part of application Ser. No. 11/699,973, filed Jan. 29, 2007, which is a continuation-in-part of International Application No. PCT/US2005-027151, filed Jul. 29, 2005 (converted), which is a continuation-in-part of application Ser. No. 10/903,236, filed Jul. 30, 2004. Application Ser. No. 12/077,535 is a continuation-in-part of application Ser. No. 10/870,198, filed Jun. 16, 2004 (issued as U.S. Pat. No. 7,897,843), which claims the benefit of Application No. 60/565,948, filed Apr. 26, 2004, which also claims the benefit of Application No. 60/527,658, filed Dec. 5, 2003, which also claims the benefit of Application No. 60/542,928, filed Feb. 5, 2005; and, application Ser. No. 10/870,198 is also a continuation-in-part of application Ser. No. 10/669,824, filed Sep. 23, 2003, which is a continuation-in-part of application Ser. No. 09/823,676, filed Mar. 30, 2001 (issued as U.S. Pat. No. 6,717,034). Application Ser. No. 12/077,535 is a continuation-in-part of application Ser. No. 10/838,616, filed May 4, 2004 (issued as U.S. Pat. No. 8,283,519), which claims the benefit of Application No. 60/565,948, filed Apr. 26, 2004, and is a continuation-in-part of application Ser. No. 10/685,922, filed Oct. 14, 2003. Application Ser. No. 12/077,535 is a continuation-in-part of International Application No. PCT/US2007/17321, filed Aug. 7, 2006, which claims the benefit of Application No. 60/836,243, filed Aug. 7, 2006. Application Ser. No. 12/077,535 is a continuation-in-part of application Ser. No. 11/705,903, filed Feb. 12, 2007 (issued as U.S. Pat. No. 7,868,229), which is a continuation-in-part of International Application No. PCT/US2006/34615, filed Aug. 31, 2006 (converted), which claims the benefit of Application No. 60/713,952, filed Aug. 31, 2005. Application Ser. No. 12/077,535 is a continuation-in-part of application Ser. No. 11/821,448, filed Jun. 22, 2007 (issued as U.S. Pat. No. 7,692,067), which claims priority to Application No. 60/817,886, filed Jun. 29, 2006. Application Ser. No. 12/077,535 is a continuation-in-part of International Application No. PCT/US2007/09124, filed Apr. 12, 2007, which claims priority to Application No. 60/791,663, filed Apr. 12, 2006. Application Ser. No. 12/077,535 is a continuation-in-part of application Ser. No. 11/986,992, filed Nov. 26, 2007 (issued as U.S. Pat. No. 8,809,630), which is a division of application Ser. No. 10/412,699, filed Apr. 10, 2003 (issued as U.S. Pat. No. 7,345,217). The contents of all applications herein are incorporated by referenced in their entirety.

JOINT RESEARCH AGREEMENT

The claimed invention, in the field of functional genomics and the characterization of plant genes for the improvement of plants, was made by or on behalf of Mendel Biotechnology, Inc. and Monsanto Company as a result of activities undertaken within the scope of a joint research agreement, and in effect on or before the date the claimed invention was made.

FIELD OF THE INVENTION

The present invention relates to plant genomics and plant improvement.

BACKGROUND OF THE INVENTION

Abiotic Stress and Impact on Yield.

Water deficit is a common component of many plant stresses. Water deficit occurs in plant cells when the whole plant transpiration rate exceeds the water uptake. In addition to drought, other stresses, such as salinity and low temperature, produce cellular dehydration (McCue and Hanson, 1990).

Salt (and drought) stress signal transduction consists of ionic and osmotic homeostasis signaling pathways. The ionic aspect of salt stress is signaled via the SOS pathway where a calcium-responsive SOS3-SOS2 protein kinase complex controls the expression and activity of ion transporters such as SOS1. The pathway regulating ion homeostasis in response to salt stress has been reviewed recently by Xiong and Zhu (2002a).

The osmotic component of salt-stress involves complex plant reactions that are possibly overlapping with drought- and/or cold-stress responses. Common aspects of drought-, cold- and salt-stress response have been reviewed by Xiong and Zhu (2002). These include:

Abscisic acid (ABA) biosynthesis is regulated by osmotic stress at multiple steps. Both ABA-dependent and -independent osmotic stress signaling first modify constitutively expressed transcription factors, leading to the expression of early response transcriptional activators, which then activate downstream stress tolerance effector genes.

Based on the commonality of many aspects of cold, drought, and salt stress responses, it can be concluded that genes that increase tolerance to cold or salt stress can also improve drought stress protection. In fact, this has already been demonstrated for transcription factors (in the case of AtCBF/DREB1) and for other genes such as OsCDPK7 (Saijo et al. (2000)), or AVP1 (a vacuolar pyrophosphatase-proton-pump, Gaxiola et al. (2001)).

Heat stress often accompanies conditions of low water availability. Heat itself is seen as an interacting stress and adds to the detrimental effects caused by water deficit conditions. Evaporative demand exhibits near exponential increases with increases in daytime temperatures and can result in high transpiration rates and low plant water potentials (Hall et al. (2000)). High-temperature damage to pollen almost always occurs in conjunction with drought stress, and rarely occurs under well-watered conditions. Thus, separating the effects of heat and drought stress on pollination is difficult. Combined stress can alter plant metabolism in novel ways; therefore, understanding the interaction between different stresses may be important for the development of strategies to enhance stress tolerance by genetic manipulation.

Plant Pathogens and Impact on Yield.

While a number of plant pathogens exist that may significantly impact yield or affect the quality of plant products, specific attention is being given in this application to a small subset of these microorganisms. These include:

*Sclerotinia.*

*Sclerotinia sclerotiorum* is a necrotrophic ascomycete that causes destructive rots of numerous plants (Agrios (1997)). *Sclerotinia* stem rot is a significant pathogen of soybeans in the northern U.S. and Canada.

*Botrytis.*

*Botrytis* causes blight or gray mold, a disease of plants that infects a wide array of herbaceous annual and perennial plants. Environmental conditions favorable to this pathogen can significantly impact ornamental plants, vegetables and fruit. *Botrytis* infections generally occur in spring and summer months following cool, wet weather, and may be particularly damaging when these conditions persist for several days.

*Fusarium.*

*Fusarium* or vascular wilt may affect a variety of plant host species. Seedlings of developing plants may be infected with *Fusarium*, resulting in the grave condition known as "damping-off". *Fusarium* species also cause root, stem, and corn rots of growing plants and pink or yellow molds of fruits during post-harvest storage. The latter affect ornamentals and vegetables, particularly root crops, tubers, and bulbs.

Drought-Disease Interactions.

Plant responses to biotic and abiotic stresses are governed by complex signal transduction networks. There appears to be significant interaction between these networks, both positive and negative. An understanding of the complexity of these interactions will be necessary to avoid unintended consequences when altering plant signal transduction pathways to engineer drought or disease resistance.

Transcription Factors (TFs) and Other Genes Involved in Both Abiotic and Biotic Stress Resistance.

Despite the evidence for negative cross-talk between drought and disease response pathways, a number of genes have been shown to function in both pathways, indicating possible convergence of the signal transduction pathways. There are numerous examples of genes that are inducible by multiple stresses. For instance, a global TxP (transcriptional profile) analysis revealed classes of transcription factor that are mainly induced by abiotic stresses or disease, but also a class of transcription factors induced both by abiotic stress and bacterial infection (Chen et al. (2002a)).

Implications for Crop Improvement.

Plant responses to drought and disease interact at a number of levels. Although dry conditions do not favor most pathogens, plant defenses may be weakened by metabolic stress or hormonal cross-talk, increasing vulnerability to pathogens that can infect under drought conditions. However, there is also evidence for convergence of abiotic and biotic stress response pathways, based on genes that confer tolerance to multiple stresses. Given our incomplete understanding of these signaling interactions, plants with positive alterations in one stress response should be examined carefully for possible alterations in other stress responses.

SUMMARY OF THE INVENTION

The present invention pertains to expression vectors, transgenic plants comprising the expression vectors of the invention, and methods for making and using the transgenic plants of the invention. The expression vectors and transgenic plants each comprise a recombinant polynucleotide of the invention that encodes a transcription factor polypeptide. The recombinant polynucleotide or the transcription factor polypeptide are encompassed by the present invention in that it shares an amino acid or nucleotide percentage identity with any of SEQ ID NO: 1 to 5086 or SEQ ID NO: 5102-5107, or a polypeptide sequence of any of SEQ ID NO: SEQ ID NO 2n-1, where n=1 to 1186, or SEQ ID NO: 2373-3791, or SEQ ID NO: 5107-5111, or SEQ ID NO: 5113-5114, or SEQ ID NO: 5116-5117, or SEQ ID NO: 5119-5120, or SEQ ID NO: 5122-5123, or SEQ ID NO: 5125-5143, or SEQ ID NO: 5145-5149, or SEQ ID NO: 5151-5153, or SEQ ID NO: 5155-5157, or SEQ ID NO: 5159-5160, or SEQ ID NO: 5162-5163, or SEQ ID NO: 17824-17827, or SEQ ID NO: 17829-17831, or SEQ ID NO: 17833-17835, or SEQ ID NO: 17837-17839, or SEQ ID NO: 17841-17843, or SEQ ID NO: 17845-17846, or SEQ ID NO: 17848-17849, or SEQ ID NO: 17851-17852, or SEQ ID NO: 17854-17855, or SEQ ID NO: 17857-17858, or SEQ ID NO: 17860-17861, or SEQ ID NO: 17863-17866, or SEQ ID NO: 17868-17869, or SEQ ID NO: 17871-17872, or SEQ ID NO: 17874-17875, or SEQ ID NO: 17877-17882, or SEQ ID NO: 17884-17898, or SEQ ID NO: 17905, or SEQ ID NO: 17911-17922, or SEQ ID NO: 17928-17937, or SEQ ID NO: 17944-17945, or SEQ ID NO: 17947-17964, or SEQ ID NO: 17993-18049, or SEQ ID NO: 18055-18065, and said percentage identity may be at least about 54%, at least about 55%, at least about 56%, at least about 57%, at least about 58%, at least about 59%, at least about 60%, at least about 61%, at least about 62%, at least about 63%, at least about 64%, at least about 65%, at least about 66%, at least about 67%, at least about 68%, at least about 69%, at least about 70%, at least about 71%, at least about 72%, at least about 73%, at least about 74%, at least about 75%, at least about 76%, at least about 77%, at least about 78%, at least about 79%, at least about 80%, at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or about 100%; or the recombinant nucleic acid sequence the encodes the polypeptide specifically hybridizes to the complement of a DNA sequence set forth in the Sequence Listing, such as SEQ ID NO 2n-1, where n=1 to 1186, or SEQ ID NO: 3792-5086 or 5102-5106, SEQ ID NO: 17828, 17832, 17836, 17840, 17844, 17847, 17850, 17853, 17856, 17859, 17862, 17867, 17870, 17873, 17876, 17883, 17899-17904, 17906-17910, 17923-17927, 17938-17943, 17946, 17965-17992, or 18050-18054, under stringent conditions comprising two wash steps at least as stringent as 6×SSC at 65° C. of 10-30 minutes for each wash step; or 0.2× to 2×SSC and 0.1% SDS at 50° C. to 65° C. for 10-30 minutes per wash step.

The recombinant polypeptides described herein can share an amino acid identity to any of the listed full-length sequence and also share an amino acid sequence identity to one or more conserved domains of the full-length sequence.

When the polypeptide is overexpressed in a plant, the polypeptide is capable of regulating transcription in the plant and confers to the plant at least one regulatory activity. This results in the plant having an altered trait, as compared to a control plant (e.g., a wild-type plant of the same species, or a non-transformed plant, or a plant transformed with an "empty vector" that does not comprise a recombinant nucleic acid sequence encoding a polypeptide of the invention). The altered trait that is conferred to the plant as a result of expressing the polypeptide may be one (or more) of the following, or any trait listed in Table 20: greater resistance to *Erysiphe*; greater resistance to *Sclerotinia*; greater resistance to *Botrytis*; greater resistance to *Fusarium*; greater susceptibility to *Sclerotinia*; greater susceptibility to *Botrytis*; greater tolerance to *Pseudomonas*; greater tolerance to dehydration; greater tolerance to drought; greater tolerance to salt; greater tolerance to water deficit conditions; greater tolerance to hyperosmotic stress; greater tolerance to low nitrogen conditions; greater tolerance to low phosphate conditions; greater tolerance to low potassium conditions; greater tolerance to cold; greater tolerance to heat; greater tolerance to sucrose; greater tolerance to mannitol; greater tolerance to glucose; greater tolerance to polyethylene glycol; greater tolerance to glyphosate; greater tolerance to oxidative stress; greater tolerance to freezing; better recovery from drought; more sensitive to cold; more sensitive to low nitrogen conditions; more sensitive to low phosphate conditions; more sensitive to sucrose; more sensitive to mannitol; more sensitive to glucose; more sensitive to drought; more sensitive to heat; more sensitive to hyperosmotic stress; more sensitive to oxidative stress; more sensitive to ethylene; ethylene insensitive when germinated in the dark on 1-aminocyclopropane 1-carboxylic acid; hypersensitive to 1-aminocyclopropane 1-carboxylic acid; decreased sensitivity to ABA; altered C/N sensing; higher starch level; higher proline level; decreased proline level; darker green color; lighter green color; gray color; greater photosynthetic capacity; reduced photosynthesis; increased chlorophyll level; more chlorophyll a and b; higher total nitrogen concentration level; decreased chlorophyll level; more pigment; greater anthocyanin level; greater leaf anthocyanin level; more anthocyanin in leaf petioles; decreased anthocyanin level; greater carotenoid level; greater ABA level; greater seed oil content; greater seed protein content; greater seed oil content; greater seed protein content; greater total seed oil and protein content; increased seed alpha-tocopherol level; higher seed lutein content; decreased seed lutein content; increased seed xanthophyll 1 level; increase in seed 16:1 fatty acids level; increased seed 18:1 fatty acids level; increased seed 18:2 fatty acids and decrease in seed 18:3 fatty acids level; increased seed 18:1 and 18:2 fatty acids level; increased seed 16:0, 18:0, 20:0, and 18:3 fatty acids, decreased seed 18:2, 20:1, 22:1 fatty acids level; decreased seed 20:1 and 22:1 fatty acids level; decrease in seed 18:1 seed fatty acids level; decrease in 18:2 fatty acids level; altered seed glucosinolate profile; up-regulation of genes involved in secondary metabolism; altered leaf prenyl lipids; reduced chlorophyll a and b levels; increased leaf insoluble sugars level; decreased leaf insoluble sugars level; increased galactose level in leaf cell wall; increased leaf xanthophyll; increased leaf rhamnose level; increased leaf mannose; increased leaf fucose level; increased leaf glucosinolate M39480 level; increased leaf glucosinolate M39481 level; decreased leaf rhamnose level; decreased leaf lutein level; more leaf fatty acids; altered leaf fatty acid composition; reduced leaf 16:3 fatty acids; increased in percentage of 16:0 leaf fatty acids; leaf 16:0 level decreased and leaf 16:3 level increased; greater seedling vigor; faster seedling growth; slower growth; late flowering; late developing; early flowering; early developing; glossy leaves; waxy leaves; more lignin; reduced lignin; reduced internode elongation; short internodes; long internodes; defect in cell elongation; greater internode distance; altered cotyledon shape; elongated cotyledons; cotyledon fusion; thicker stem; altered distribution of stem vascular bundles; reduced branching; curled leaves; serrated leaves; curled leaves; ovoid leaves; flat leaves; heart-shaped leaves; longer leaves; narrower leaves; wrinkled leaves; lobed leaves; light green leaves; larger, flatter leaves at late stage of development; greater number of leaves; altered flowers; abnormal flowers; sporadic defects in flower development; reduced fertility; flowers that do not open; floral organs with bract-like features; bolts that terminate without an inflorescence; aerial rosettes; reduced floral organ abscission; delayed floral organ abscission; reductions in flower organ size; larger floral organs; long flower organs; long sepal and petal; poor anther dehiscence; little pollen production; no pollen production; poor filament elongation; homeotic transformations; bushy inflorescences; altered inflorescences; flowers bunched together; short inflorescence stems; stunted inflorescence growth; numerous secondary inflorescence meristems; altered inflorescence determinacy; homeotic transformation; terminal flower formation; increased carpel size; wider carpels; ectopic carpel tissue; filamentous carpelloid growths on flower pedicels; loss of flower determinacy; floral organ abscission delayed; altered seed color; pale seeds; smaller seeds; rounded seeds; wrinkled seeds; wrinkled sickle-shaped siliques; reduced flower petal number; reduced flower sepal number; reduced flower stamen number; smaller petals and sepals; delayed senescence; premature senescence; premature leaf senescence; premature flower senescence; trilocular silique; more root mass; reduced secondary root growth; greater leaf and hypocotyl necrosis; short pedicels; short inflorescence stems; altered leaf cell expansion; reduced cell differentiation in meristem; increased necrosis; lethal when constitutively overexpressed; embryo lethal; altered light response; long cotyledons; open cotyledons; oval cotyledons; long hypocotyls; long petioles; leaves in a more upright orientation; constitutive photomorphogenesis; more root growth in the dark; greater biomass; larger plants; large darker green rosettes at late stage of development; larger seeds; larger leaves; smaller plants; more root hairs; fewer trichomes; greater trichome size and density; greater trichome density; ectopic trichome formation; ectopic formation of trichomes on abaxial leaf surfaces; greater trichome density on sepals and ectopic trichomes on carpels.

For the methods encompassed by the present invention, an expression vector of the invention may be introduced into a target plant, thus transforming the target plant and producing a transgenic plant having the altered trait as compared to the control plant.

BRIEF DESCRIPTION OF THE SEQUENCE LISTING AND DRAWINGS

The Sequence Listing provides exemplary polynucleotide and polypeptide sequences of the invention. The traits associated with the use of the sequences are included in the Examples.

The Sequence Listing provides exemplary polynucleotide and polypeptide sequences of the invention. The traits associated with the use of the sequences are included in the Examples. The sequence listing was created on Sep. 7, 2011 and is 25,845,198 bytes (24.6 MB) as measured in windows MS-DOS. The entire content of the sequence listing is hereby incorporated by reference.

FIGS. 1-29 show the phylogenetic relationships and sequence comparisons among some of the listed sequences or conserved domains. SEQ ID NOs are shown in parentheses. Identical amino acid residues are indicated by asterisks. Conservative substitutions are indicated by colons. Semiconservative or similar substitutions are indicated by periods.

FIG. 1 shows a conservative estimate of phylogenetic relationships among the orders of flowering plants (modified from Soltis et al. (1997)). Those plants with a single cotyledon (monocots) are a monophyletic clade nested within at least two major lineages of dicots; the eudicots are further divided into rosids and asterids. *Arabidopsis* is a rosid eudicot classified within the order Brassicales; rice is a member of the monocot order Poales. FIG. 1 was adapted from Daly et al. (2001).

For the phylogenetic trees presented in the present Figures, the trees were generally based on a ClustalW alignment of full-length proteins using Mega 2 software (protein sequences are provided in the Sequence Listing). The parameters used include a Gap Opening Penalty:10.00; a Gap Extension Penalty:0.20; Delay divergent sequences: 30%; DNA Transitions Weight:0.50; Protein weight matrix: Gonnet series; DNA weight matrix:IUB; Use negative matrix:OFF. A FastA formatted alignment was then used to generate each phylogenetic tree in MEGA2 using the neighbor joining algorithm and a p-distance model. A test of phylogeny was done via bootstrap with 1000 replications and Random Seed set to default. Cut off values of the bootstrap tree were set to 50%.

For alignments presented in the Figures.

FIG. 2 shows a phylogenetic tree of CCAAT family proteins. There are three main sub-classes within the family: the HAP2 (also known as the NF-YA subclass), HAP3 (NF-YB subclass) and HAP5 (NF-YC subclass) related proteins. Three additional proteins were identified that did not clearly cluster with any of the three main groups and we have designated these as "HAP-like" proteins.

FIGS. 3A-3B are an alignment of various G481 clade member conserved B domains.

FIGS. 5A-5C show an alignment of a major portion of various G1073 clade member second conserved domains.

FIGS. 7A-7B show an alignment of various G28 clade member conserved AP2 domains.

Figure 8:
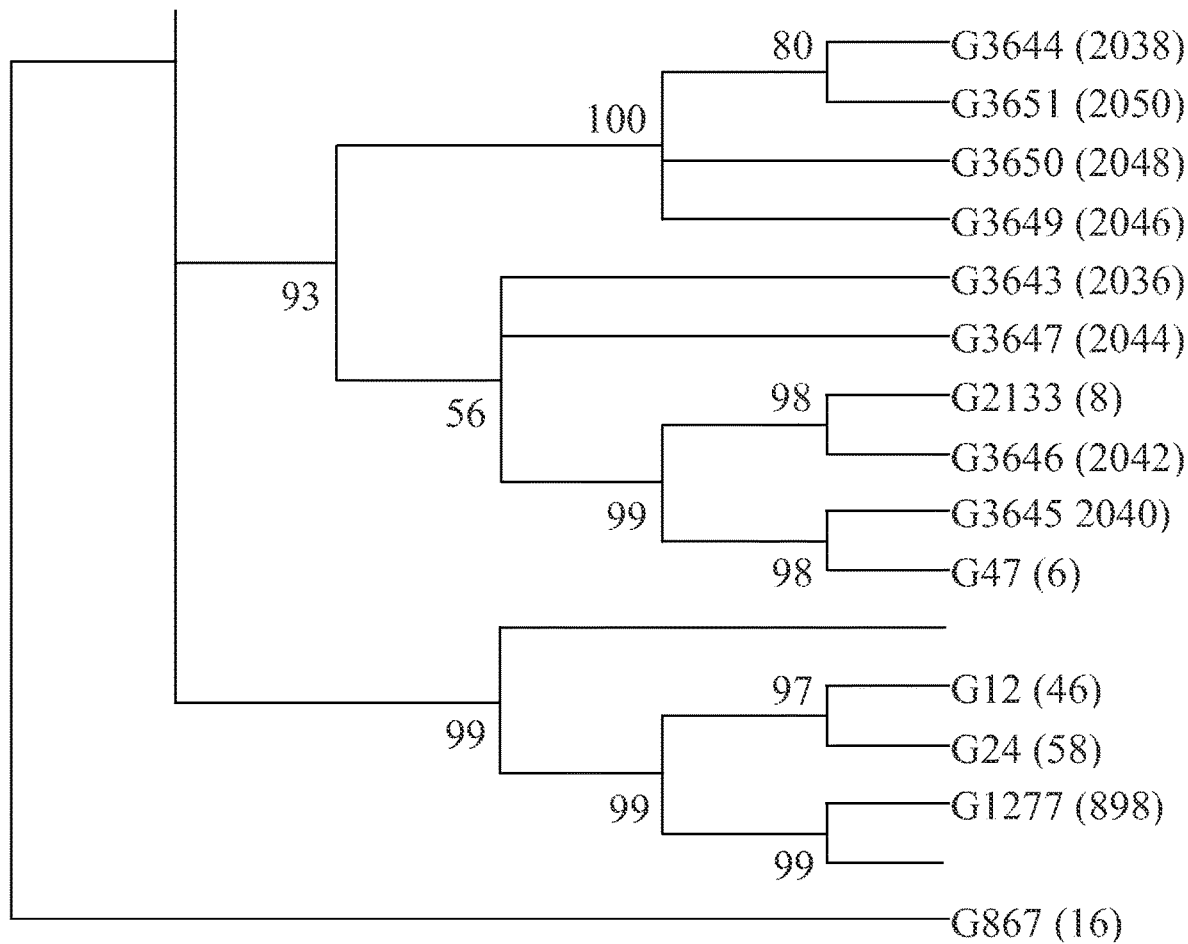

FIG. 8 presents a portion of a phylogenetic tree showing the ancestral relationships of the G47 clade and other related AP2 sequences.

FIG. 9 provides an alignment of various G47 clade member conserved AP2 domains.

Figure 10:
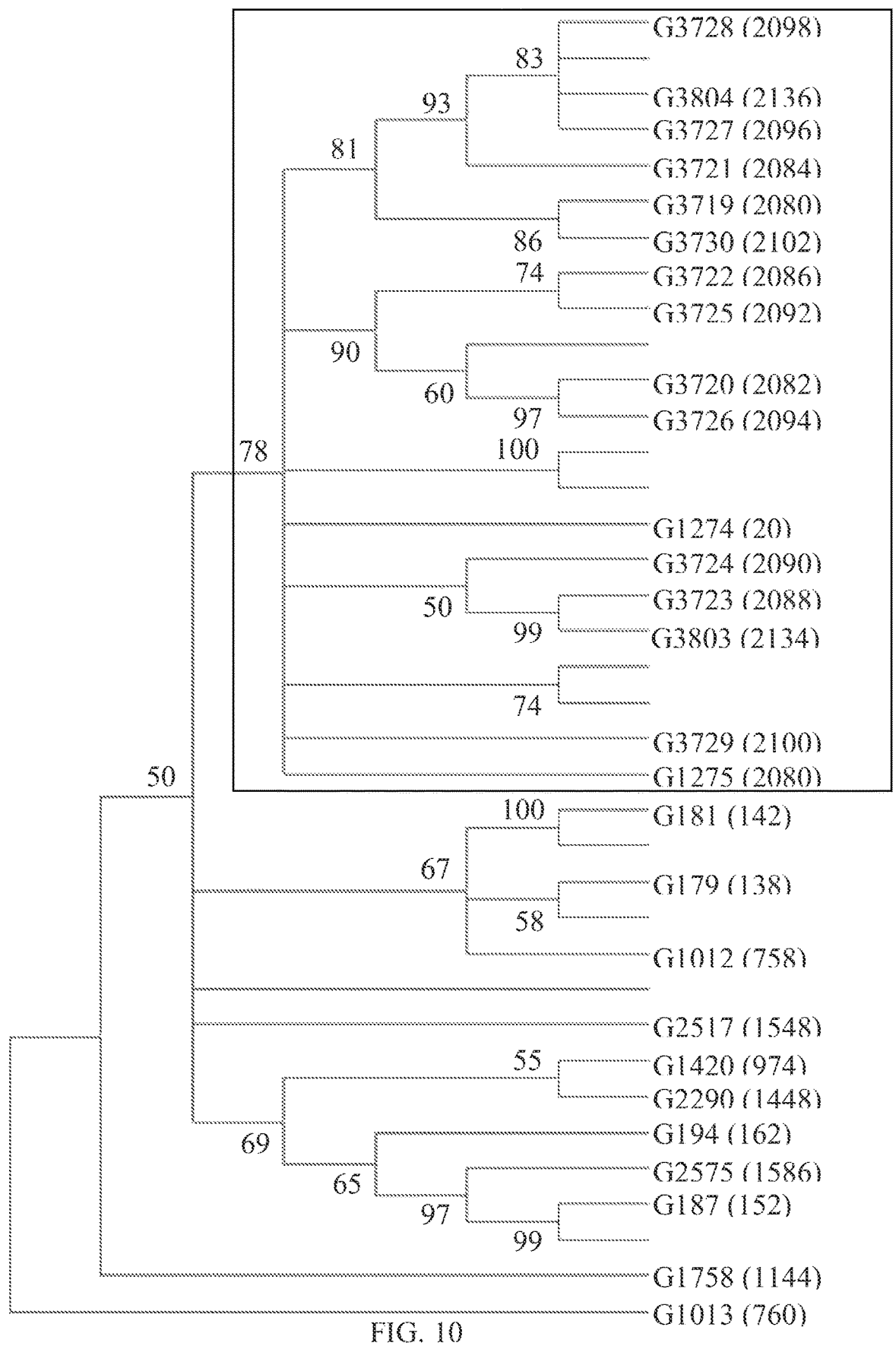

FIG. 10 shows a phylogenetic tree of G1274 clade member sequences. Clade member WRKY sequences are found within the large box.

FIGS. 11A-11B show an alignment of various G1274 clade member conserved WRKY domains.

Figure 12:
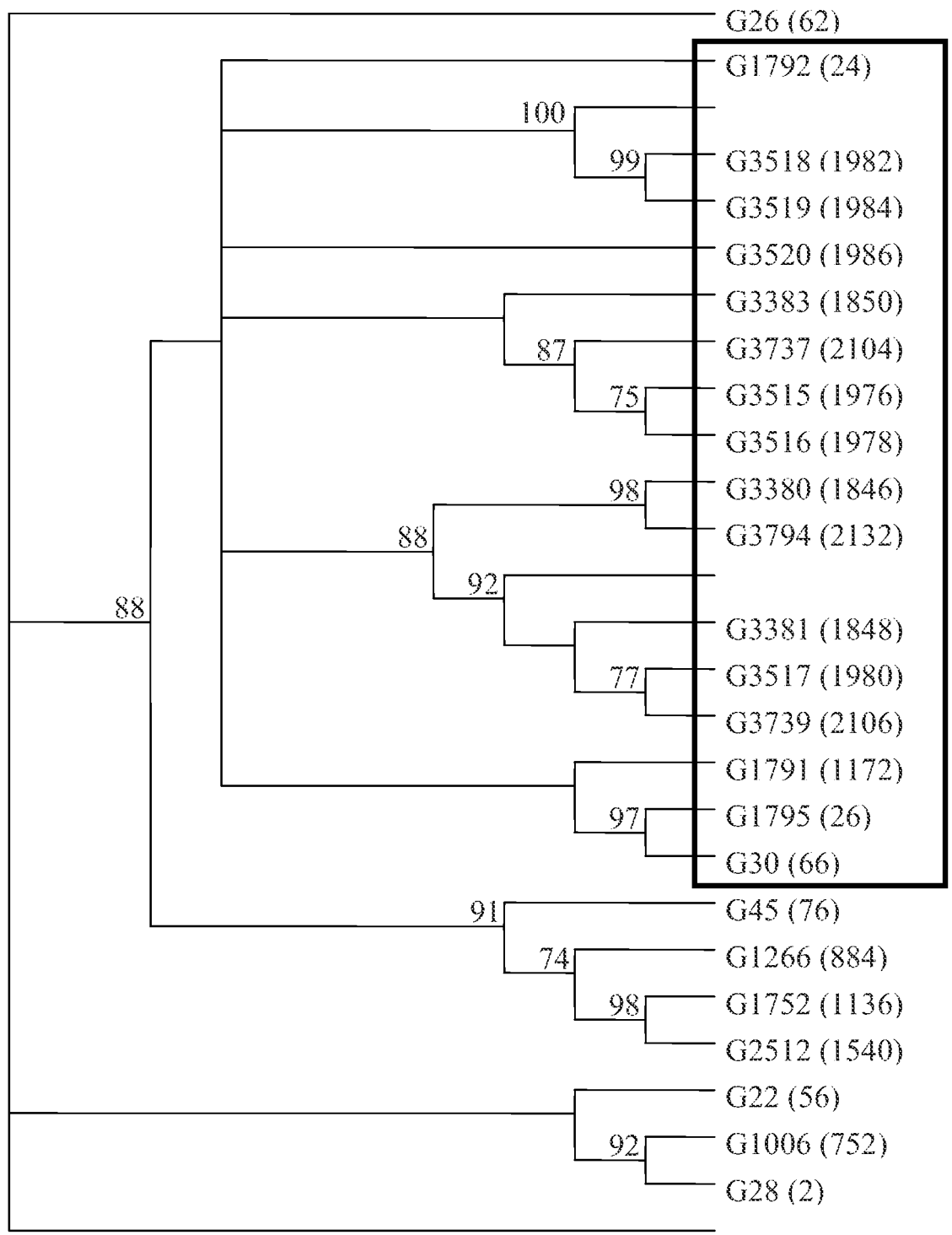

FIG. 12 illustrates phylogenetic relationships in the G1792 clade. Clade member AP2 sequences are found within the large box.

FIGS. 13A-13B show an alignment of various G1792 clade member conserved AP2 domains.

FIG. 14 shows an alignment of various G1792 clade member conserved EDLL domains, said domains being characteristic of these related sequences.

Figure 15:
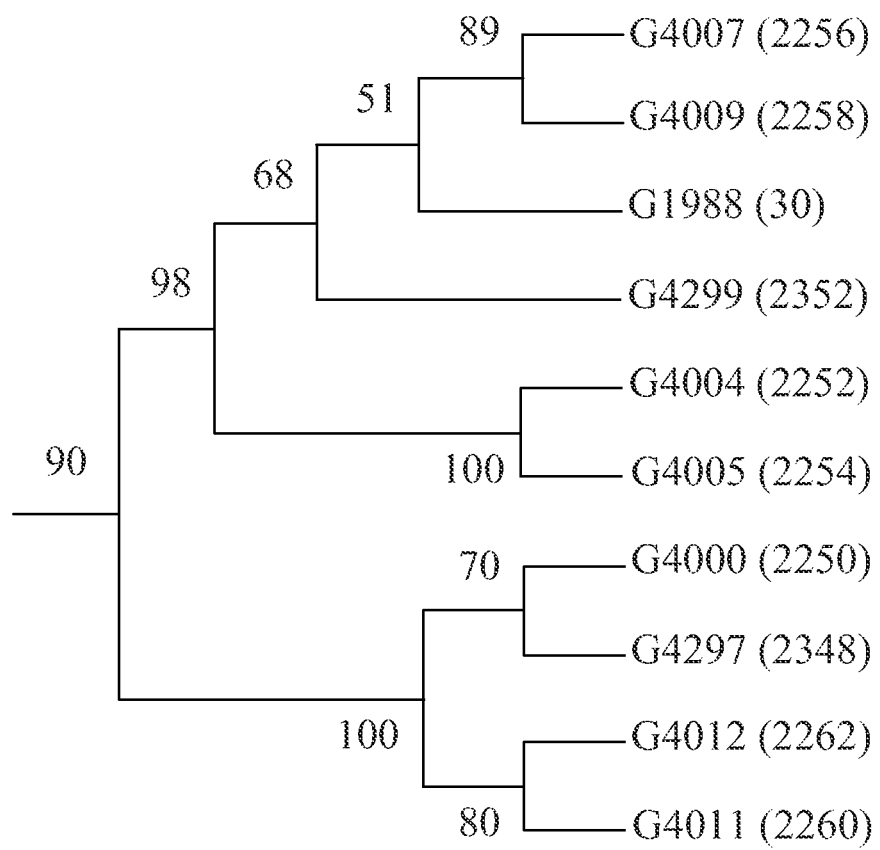

FIG. 15 is a phylogenetic tree of G1988 clade member Z-CO-like (CONSTANS-like) sequences.

FIG. 16 provides an alignment of various G1988 clade member conserved B-box domains.

Figure 17:
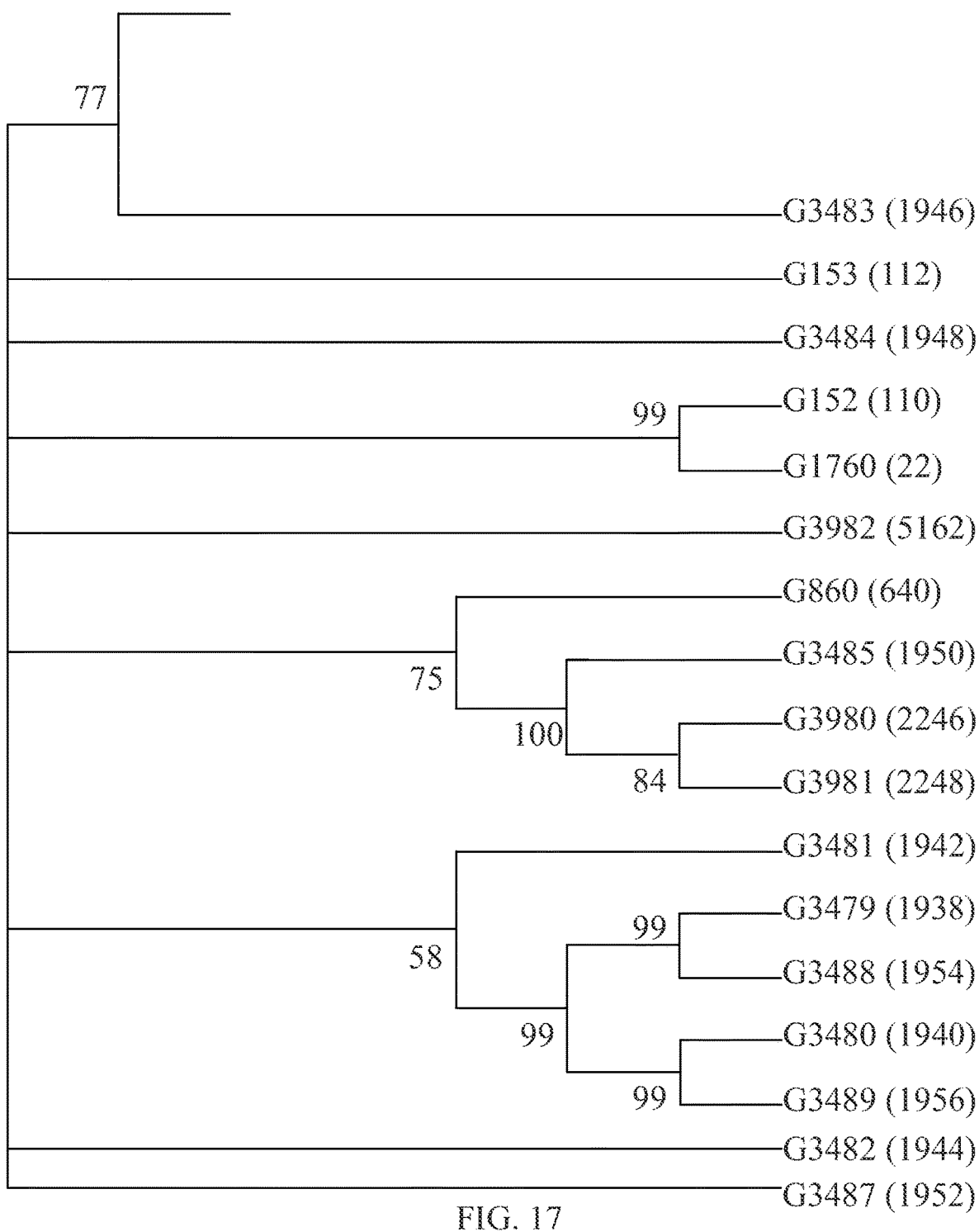

FIG. 17 is a phylogenetic tree of G1760 clade member MADS-box sequences.

FIGS. 18A-18B present an alignment of various G1760 clade member conserved MADS domains.

Figure 19:

FIG. 19 is a phylogenetic tree of the G913 clade member AP2 sequences.

FIG. 20 shows an alignment of various G913 clade member conserved AP2 domains.

FIG. 21 shows an alignment of various G1543 clade member HB domains.

FIG. 22 shows an alignment of various G1543 clade member HALZ domains.

FIG. 23 shows an alignment of various G1266 clade member AP2 domains.

FIG. 24 shows an alignment of the conserved HLH/MYC domains of various G2932 clade members.

FIG. 25 shows an alignment of the conserved MADS domains of various G154 clade members.

FIG. 26 shows an alignment of the conserved CCAAT-binding domains of G1782.

FIG. 27 shows an alignment of the MADS domain of various G142 clade members

FIG. 28 shows an alignment of the second conserved domain of various G2153 clade members.

FIG. 29 shows an alignment of the conserved MYB-(R1) R2R3 domain of G671 clade members

DETAILED DESCRIPTION OF THE INVENTION

The present invention relates to polynucleotides and polypeptides for modifying phenotypes of plants, particularly those associated with greater biomass, increased disease resistance, and/or abiotic stress tolerance. Throughout this disclosure, various information sources are referred to and/or are specifically incorporated. The information sources include scientific journal articles, patent documents, textbooks, and World Wide Web browser-inactive page addresses. While the reference to these information sources clearly indicates that they can be used by one of skill in the art, each and every one of the information sources cited herein are specifically incorporated in their entirety, whether or not a specific mention of "incorporation by reference" is noted. The contents and teachings of each and every one of the information sources can be relied on and used to make and use embodiments of the invention.

As used herein and in the appended claims, the singular forms "a", "an", and "the" include the plural reference unless the context clearly dictates otherwise. Thus, for example, a reference to "a host cell" includes a plurality of such host cells, and a reference to "a stress" is a reference to one or more stresses and equivalents thereof known to those skilled in the art, and so forth.

Definitions

"Nucleic acid molecule" refers to an oligonucleotide, polynucleotide or any fragment thereof. It may be DNA or RNA of genomic or synthetic origin, double-stranded or single-stranded, and combined with carbohydrate, lipids, protein, or other materials to perform a particular activity such as transformation or form a useful composition such as a peptide nucleic acid (PNA).

"Polynucleotide" is a nucleic acid molecule comprising a plurality of polymerized nucleotides, e.g., at least about 15 consecutive polymerized nucleotides. A polynucleotide may be a nucleic acid, oligonucleotide, nucleotide, or any fragment thereof. In many instances, a polynucleotide comprises a nucleotide sequence encoding a polypeptide (or protein) or a domain or fragment thereof. Additionally, the polynucleotide may comprise a promoter, an intron, an enhancer region, a polyadenylation site, a translation initiation site, 5' or 3' untranslated regions, a reporter gene, a selectable marker, or the like. The polynucleotide can be single-stranded or double-stranded DNA or RNA. The polynucleotide optionally comprises modified bases or a modified backbone. The polynucleotide can be, e.g., genomic DNA or RNA, a transcript (such as an mRNA), a cDNA, a PCR product, a cloned DNA, a synthetic DNA or RNA, or the like. The polynucleotide can be combined with carbohydrate, lipids, protein, or other materials to perform a particular activity such as transformation or form a useful composition such as a peptide nucleic acid (PNA). The polynucleotide can comprise a sequence in either sense or antisense orientations. "Oligonucleotide" is substantially equivalent to the terms amplimer, primer, oligomer, element, target, and probe and is preferably single-stranded.

"Gene" or "gene sequence" refers to the partial or complete coding sequence of a gene, its complement, and its 5' or 3' untranslated regions. A gene is also a functional unit of inheritance, and in physical terms is a particular segment or sequence of nucleotides along a molecule of DNA (or RNA, in the case of RNA viruses) involved in producing a polypeptide chain. The latter may be subjected to subsequent processing such as chemical modification or folding to obtain a functional protein or polypeptide. A gene may be isolated, partially isolated, or found with an organism's genome. By way of example, a transcription factor gene encodes a transcription factor polypeptide, which may be functional or require processing to function as an initiator of transcription.

Operationally, genes may be defined by the cis-trans test, a genetic test that determines whether two mutations occur in the same gene and that may be used to determine the limits of the genetically active unit (Rieger et al. (1976)). A gene generally includes regions preceding ("leaders"; upstream) and following ("trailers"; downstream) the coding region. A gene may also include intervening, non-coding sequences, referred to as "introns", located between individual coding segments, referred to as "exons". Most genes have an associated promoter region, a regulatory sequence 5' of the transcription initiation codon (there are some genes that do not have an identifiable promoter). The function of a gene may also be regulated by enhancers, operators, and other regulatory elements.

A "recombinant polynucleotide" is a polynucleotide that is not in its native state, e.g., the polynucleotide comprises a nucleotide sequence not found in nature, or the polynucleotide is in a context other than that in which it is naturally found, e.g., separated from nucleotide sequences with which it typically is in proximity in nature, or adjacent (or contiguous with) nucleotide sequences with which it typically is not in proximity. For example, the sequence at issue can be cloned into a vector, or otherwise recombined with one or more additional nucleic acid.

An "isolated polynucleotide" is a polynucleotide, whether naturally occurring or recombinant, that is present outside the cell in which it is typically found in nature, whether purified or not. Optionally, an isolated polynucleotide is subject to one or more enrichment or purification procedures, e.g., cell lysis, extraction, centrifugation, precipitation, or the like.

A "polypeptide" is an amino acid sequence comprising a plurality of consecutive polymerized amino acid residues e.g., at least about 15 consecutive polymerized amino acid residues. In many instances, a polypeptide comprises a polymerized amino acid residue sequence that is a transcription factor or a domain or portion or fragment thereof. Additionally, the polypeptide may comprise: (i) a localization domain; (ii) an activation domain; (iii) a repression domain; (iv) an oligomerization domain; (v) a DNA-binding domain; or the like. The polypeptide optionally comprises modified amino acid residues, naturally occurring amino acid residues not encoded by a codon, non-naturally occurring amino acid residues.

"Protein" refers to an amino acid sequence, oligopeptide, peptide, polypeptide or portions thereof whether naturally occurring or synthetic.

"Portion", as used herein, refers to any part of a protein used for any purpose, but especially for the screening of a library of molecules which specifically bind to that portion or for the production of antibodies.

A "recombinant polypeptide" is a polypeptide produced by translation of a recombinant polynucleotide. A "synthetic polypeptide" is a polypeptide created by consecutive polymerization of isolated amino acid residues using methods well known in the art. An "isolated polypeptide," whether a naturally occurring or a recombinant polypeptide, is more enriched in (or out of) a cell than the polypeptide in its natural state in a wild-type cell, e.g., more than about 5% enriched, more than about 10% enriched, or more than about 20%, or more than about 50%, or more, enriched, i.e., alternatively denoted: 105%, 110%, 120%, 150% or more, enriched relative to wild type standardized at 100%. Such an enrichment is not the result of a natural response of a wild-type plant. Alternatively, or additionally, the isolated polypeptide is separated from other cellular components with which it is typically associated, e.g., by any of the various protein purification methods herein.

"Homology" refers to sequence similarity between a reference sequence and at least a fragment of a newly sequenced clone insert or its encoded amino acid sequence.

"Identity" or "similarity" refers to sequence similarity between two polynucleotide sequences or between two polypeptide sequences, with identity being a more strict comparison. The phrases "percent identity" and "% identity" refer to the percentage of sequence similarity found in a comparison of two or more polynucleotide sequences or two or more polypeptide sequences. Closely-related polynucleotides of the invention encoded presently disclosed transcription factors that will have at least about 38% sequence identity including conservative substitutions, or at least about 55% sequence identity, or at least about 56%, or at least about 57%, or at least about 58%, or at least about 59%, or at least about 60%, or at least about 61%, or at least about 62% sequence identity, or at least about 63%, or at least about 64%, or at least about 65%, or at least about 66%, or at least about 67%, or at least about 68%, or at least about 69%, or at least about 70%, or at least about 71%, or at least about 72%, or at least about 73%, or at least about 74%, or at least about 75%, or at least about 76%, or at least about 77%, or at least about 78%, or at least about 79%, or at least about 80%, or at least about 81%, or at least about 82%, or at least about 83%, or at least about 84%, or at least about 85%, or at least about 86%, or at least about 87%, or at least about 88%, or at least about 89%, or at least about 90%, or at least about 91%, or at least about 92%, or at least about 93%, or at least about 94%, or at least about 95%, or at least about 96%, or at least about 97%, or at least about 98%, or at least about 99%, or 100% amino acid residue sequence identity, to a polypeptide of the invention listed in the Sequence Listing or in the present Tables 1-18.

"Sequence similarity" refers to the percent similarity in base pair sequence (as determined by any suitable method) between two or more polynucleotide sequences. Two or more sequences can be anywhere from 0-100% similar, or any integer value therebetween. Identity or similarity can be determined by comparing a position in each sequence that may be aligned for purposes of comparison. When a position in the compared sequence is occupied by the same nucleotide base or amino acid, then the molecules are identical at that position. A degree of similarity or identity between polynucleotide sequences is a function of the number of identical, matching or corresponding nucleotides at positions shared by the polynucleotide sequences. A degree of identity of polypeptide sequences is a function of the number of identical amino acids at corresponding positions shared by the polypeptide sequences. A degree of homology or similarity of polypeptide sequences is a function of the number of amino acids at corresponding positions shared by the polypeptide sequences.

"Alignment" refers to a number of nucleotide bases or amino acid residue sequences aligned by lengthwise comparison so that components in common (i.e., nucleotide bases or amino acid residues at corresponding positions) may be visually and readily identified. The fraction or percentage of components in common is related to the homology or identity between the sequences. Alignments such as those of FIGS. 11A-11B may be used to identify conserved domains and relatedness within these domains. An alignment may suitably be determined by means of computer programs known in the art, such as MACVECTOR software (1999) (Accelrys, Inc., San Diego, Calif.).

Two or more sequences may be "optimally aligned" with a similarity scoring method using a defined amino acid substitution matrix such as the BLOSUM62 scoring matrix. The preferred method uses a gap existence penalty and gap extension penalty that arrives at the highest possible score for a given pair of sequences. See, for example, Dayhoff et al. (1978) and Henikoff and Henikoff (1992). The BLOSUM62 matrix is often used as a default scoring substitution matrix in sequence alignment protocols such as Gapped BLAST 2.0. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. Optimal alignment may be accomplished manually or with a computer-based alignment algorithm, such as gapped BLAST 2.0 (Altschul et al, (1997); or at www.ncbi.nlm.nih.gov. See U.S. Patent Application US20070004912.

A "conserved domain" or "conserved region" as used herein refers to a region in heterologous polynucleotide or polypeptide sequences where there is a relatively high degree of sequence identity between the distinct sequences. For example, an "AT-hook" domain", such as is found in a polypeptide member of AT-hook transcription factor family, is an example of a conserved domain. An "AP2" domain", such as is found in a polypeptide member of AP2 transcription factor family, is another example of a conserved domain With respect to polynucleotides encoding presently disclosed transcription factors, a conserved domain is preferably at least nine base pairs (bp) in length. A conserved domain with respect to presently disclosed polypeptides refers to a domain within a transcription factor family that exhibits a higher degree of sequence homology, such as at least about 38% amino acid sequence identity including conservative substitutions, or at least about 42% sequence identity, or at least about 45% sequence identity, or at least about 48% sequence identity, or at least about 50% sequence identity, or at least about 51% sequence identity, or at least about 52% sequence identity, or at least about 53% sequence identity, or at least about 54% sequence identity, or at least about 55% sequence identity, or at least about 56% sequence identity, or at least about 57% sequence identity, or at least about 58% sequence identity, or at least about 59% sequence identity, or at least about 60% sequence identity, or at least about 61% sequence identity, or at least about 62% sequence identity, or at least about 63% sequence identity, or at least about 64% sequence identity, or at least about 65% sequence identity, or at least about 66% sequence identity, or at least about 67% sequence identity, or at least about 68% sequence identity, or at least about 69% sequence identity, or at least about 70% sequence identity, or at least about 71% sequence identity, or at least about 72% sequence identity, or at least about 73% sequence identity, or at least about 74% sequence identity, or at least about 75% sequence identity, or at least about 76% sequence identity, or at least about 77% sequence identity, or at least about 78% sequence identity, or at least about 79% sequence identity, or at least about 80% sequence identity, or at least about 81% sequence identity, or at least about 82% sequence identity, or at least about 83% sequence identity, or at least about 84% sequence identity, or at least about 85% sequence identity, or at least about 86% sequence identity, or at least about 87% sequence identity, or at least about 88% sequence identity, or at least about 89% sequence identity, or at least about 90% sequence identity, or at least about 91% sequence identity, or at least about 92% sequence identity, or at least about 93% sequence identity, or at least about 94% sequence identity, or at least about 95% sequence identity, or at least about 96% sequence identity, or at least about 97% sequence identity, or at least about 98% sequence identity, or at least about 99% sequence identity, or 100% amino acid residue sequence identity, to a conserved domain of a polypeptide of the invention, such as those listed in the present tables or Sequence Listing (e.g., SEQ ID NOs: 2373-3791 or SEQ ID NO: 5107-5111, or SEQ ID NO: 5114, or SEQ ID NO: 5117, or SEQ ID NO: 5120, or SEQ ID NO: 5123, or SEQ ID NO: 5126-5143, or SEQ ID NO: 5146-5149, or SEQ ID NO: 5152-5153, or SEQ ID NO: 5156-5157, or SEQ ID NO: 5160, or SEQ ID NO: 5163, or SEQ ID NO: 17824-17827, SEQ ID NO: 17830, SEQ ID NO: 17831, SEQ ID NO: 17834, SEQ ID NO: 17835, SEQ ID NO: 17838, SEQ ID NO: 17839, SEQ ID NO: 17842, SEQ ID NO: 17843, SEQ ID NO: 17846, SEQ ID NO: 17849, SEQ ID NO: 17852, SEQ ID NO: 17855, SEQ ID NO: 17858, SEQ ID NO: 17861, SEQ ID NO: 17864, SEQ ID NO: 17865, SEQ ID NO: 17866, SEQ ID NO: 17869, SEQ ID NO: 17872, SEQ ID NO: 17875, SEQ ID NO: 17878, SEQ ID NO: 17879, SEQ ID NO: 17882, SEQ ID NO: 17885, SEQ ID NO: 17886, SEQ ID NO: 17911-17922, SEQ ID NO: 17933-17937, SEQ ID NO: 17956-17964, SEQ ID NO: 17993-18020, or SEQ ID NO: 18059-18065). Sequences that possess or encode for conserved domains that meet these criteria of percentage identity, and that have comparable biological activity to the present transcription factor sequences, thus being members of a clade of transcription factor polypeptides, are encompassed by the invention. A fragment or domain can be referred to as outside a conserved domain, outside a consensus sequence, or outside a consensus DNA-binding site that is known to exist or that exists for a particular transcription factor class, family, or sub-family. In this case, the fragment or domain will not include the exact amino acids of a consensus sequence or consensus DNA-binding site of a transcription factor class, family or sub-family, or the exact amino acids of a particular transcription factor consensus sequence or consensus DNA-binding site. Furthermore, a particular fragment, region, or domain of a polypeptide, or a polynucleotide encoding a polypeptide, can be "outside a conserved domain" if all the amino acids of the fragment, region, or domain fall outside of a defined conserved domain(s) for a polypeptide or protein. Sequences having lesser degrees of identity but comparable biological activity are considered to be equivalents.

As one of ordinary skill in the art recognizes, conserved domains may be identified as regions or domains of identity to a specific consensus sequence (see, for example, Riechmann et al. (2000a, 2000b)). Thus, by using alignment methods well known in the art, the conserved domains of the plant transcription factors, for example, for the AT-hook proteins (Reeves and Beckerbauer (2001); and Reeves (2001)), may be determined.

The conserved domains for many of the transcription factor sequences of the invention are listed in Tables 1-18. Also, the polypeptides of Tables 1-18 have conserved domains specifically indicated by amino acid coordinate start and stop sites. A comparison of the regions of these polypeptides allows one of skill in the art (see, for example, Reeves and Nissen (1995)) to identify domains or conserved domains for any of the polypeptides listed or referred to in this disclosure.

"Complementary" refers to the natural hydrogen bonding by base pairing between purines and pyrimidines. For example, the sequence A-C-G-T (5'->3') forms hydrogen bonds with its complements A-C-G-T (5'->3') or A-C-G-U (5'->3'). Two single-stranded molecules may be considered partially complementary, if only some of the nucleotides bond, or "completely complementary" if all of the nucleotides bond. The degree of complementarity between nucleic acid strands affects the efficiency and strength of hybridization and amplification reactions. "Fully complementary" refers to the case where bonding occurs between every base pair and its complement in a pair of sequences, and the two sequences have the same number of nucleotides.

The terms "highly stringent" or "highly stringent condition" refer to conditions that permit hybridization of DNA strands whose sequences are highly complementary, wherein these same conditions exclude hybridization of significantly mismatched DNAs. Polynucleotide sequences capable of hybridizing under stringent conditions with the polynucleotides of the present invention may be, for example, variants of the disclosed polynucleotide sequences, including allelic or splice variants, or sequences that encode orthologs or paralogs of presently disclosed polypeptides. Nucleic acid hybridization methods are disclosed in detail by Kashima et al. (1985), Sambrook et al. (1989), and by Haymes et al. (1985), which references are incorporated herein by reference.

In general, stringency is determined by the temperature, ionic strength, and concentration of denaturing agents (e.g., formamide) used in a hybridization and washing procedure (for a more detailed description of establishing and determining stringency, see the section "Identifying Polynucleotides or Nucleic Acids by Hybridization", below). The degree to which two nucleic acids hybridize under various conditions of stringency is correlated with the extent of their similarity. Thus, similar nucleic acid sequences from a variety of sources, such as within a plant's genome (as in the case of paralogs) or from another plant (as in the case of orthologs) that may perform similar functions can be isolated on the basis of their ability to hybridize with known transcription factor sequences. Numerous variations are possible in the conditions and means by which nucleic acid hybridization can be performed to isolate transcription factor sequences having similarity to transcription factor sequences known in the art and are not limited to those explicitly disclosed herein. Such an approach may be used to isolate polynucleotide sequences having various degrees of similarity with disclosed transcription factor sequences, such as, for example, encoded transcription factors having 38% or greater identity with the conserved domain of disclosed transcription factors.

The terms "paralog" and "ortholog" are defined below in the section entitled "Orthologs and Paralogs". In brief, orthologs and paralogs are evolutionarily related genes that have similar sequences and functions. Orthologs are structurally related genes in different species that are derived by a speciation event. Paralogs are structurally related genes within a single species that are derived by a duplication event.

The term "equivalog" describes members of a set of homologous proteins that are conserved with respect to function since their last common ancestor. Related proteins are grouped into equivalog families, and otherwise into protein families with other hierarchically defined homology types. This definition is provided at the Institute for Genomic Research (TIGR) World Wide Web (www) website, "tigr.org" under the heading "Terms associated with TIGRFAMs".

In general, the term "variant" refers to molecules with some differences, generated synthetically or naturally, in their base or amino acid sequences as compared to a reference (native) polynucleotide or polypeptide, respectively. These differences include substitutions, insertions, deletions or any desired combinations of such changes in a native polynucleotide of amino acid sequence.

With regard to polynucleotide variants, differences between presently disclosed polynucleotides and polynucleotide variants are limited so that the nucleotide sequences of the former and the latter are closely similar overall and, in many regions, identical. Due to the degeneracy of the genetic code, differences between the former and latter nucleotide sequences may be silent (i.e., the amino acids encoded by the polynucleotide are the same, and the variant polynucleotide sequence encodes the same amino acid sequence as the presently disclosed polynucleotide. Variant nucleotide sequences may encode different amino acid sequences, in which case such nucleotide differences will result in amino acid substitutions, additions, deletions, insertions, truncations or fusions with respect to the similar disclosed polynucleotide sequences. These variations may result in polynucleotide variants encoding polypeptides that share at least one functional characteristic. The degeneracy of the genetic code also dictates that many different variant polynucleotides can encode identical and/or substantially similar polypeptides in addition to those sequences illustrated in the Sequence Listing.

Also within the scope of the invention is a variant of a transcription factor nucleic acid listed in the Sequence Listing, that is, one having a sequence that differs from the one of the polynucleotide sequences in the Sequence Listing, or a complementary sequence, that encodes a functionally equivalent polypeptide (i.e., a polypeptide having some degree of equivalent or similar biological activity) but differs in sequence from the sequence in the Sequence Listing, due to degeneracy in the genetic code. Included within this definition are polymorphisms that may or may not be readily detectable using a particular oligonucleotide probe of the polynucleotide encoding polypeptide, and improper or unexpected hybridization to allelic variants, with a locus other than the normal chromosomal locus for the polynucleotide sequence encoding polypeptide.

"Allelic variant" or "polynucleotide allelic variant" refers to any of two or more alternative forms of a gene occupying the same chromosomal locus. Allelic variation arises naturally through mutation, and may result in phenotypic polymorphism within populations. Gene mutations may be "silent" or may encode polypeptides having altered amino acid sequence. "Allelic variant" and "polypeptide allelic variant" may also be used with respect to polypeptides, and in this case the terms refer to a polypeptide encoded by an allelic variant of a gene.

"Splice variant" or "polynucleotide splice variant" as used herein refers to alternative forms of RNA transcribed from a gene. Splice variation naturally occurs as a result of alternative sites being spliced within a single transcribed RNA molecule or between separately transcribed RNA molecules, and may result in several different forms of mRNA transcribed from the same gene. Thus, splice variants may encode polypeptides having different amino acid sequences, which may or may not have similar functions in the organism "Splice variant" or "polypeptide splice variant" may also refer to a polypeptide encoded by a splice variant of a transcribed mRNA.

As used herein, "polynucleotide variants" may also refer to polynucleotide sequences that encode paralogs and orthologs of the presently disclosed polypeptide sequences. "Polypeptide variants" may refer to polypeptide sequences that are paralogs and orthologs of the presently disclosed polypeptide sequences.

Differences between presently disclosed polypeptides and polypeptide variants are limited so that the sequences of the former and the latter are closely similar overall and, in many regions, identical. Presently disclosed polypeptide sequences and similar polypeptide variants may differ in amino acid sequence by one or more substitutions, additions, deletions, fusions and truncations, which may be present in any combination. These differences may produce silent changes and result in a functionally equivalent transcription factor. Thus, it will be readily appreciated by those of skill in the art, that any of a variety of polynucleotide sequences is capable of encoding the transcription factors and transcription factor homolog polypeptides of the invention. A polypeptide sequence variant may have "conservative" changes, wherein a substituted amino acid has similar structural or chemical properties. Deliberate amino acid substitutions may thus be made on the basis of similarity in polarity, charge, solubility, hydrophobicity, hydrophilicity, and/or the amphipathic nature of the residues, as long as a significant amount of the functional or biological activity of the transcription factor is retained. For example, negatively charged amino acids may include aspartic acid and glutamic acid, positively charged amino acids may include lysine and arginine, and amino acids with uncharged polar head groups having similar hydrophilicity values may include leucine, isoleucine, and valine; glycine and alanine; asparagine and glutamine; serine and threonine; and phenylalanine and tyrosine. More rarely, a variant may have "non-conservative" changes, e.g., replacement of a glycine with a tryptophan. Similar minor variations may also include amino acid deletions or insertions, or both. Related polypeptides may comprise, for example, additions and/or deletions of one or more N-linked or O-linked glycosylation sites, or an addition and/or a deletion of one or more cysteine residues. Guidance in determining which and how many amino acid residues may be substituted, inserted or deleted without abolishing functional or biological activity may be found using computer programs well known in the art, for example, DNASTAR software (see U.S. Pat. No. 5,840,544).

"Fragment", with respect to a polynucleotide, refers to a clone or any part of a polynucleotide molecule that retains a usable, functional characteristic. Useful fragments include oligonucleotides and polynucleotides that may be used in hybridization or amplification technologies or in the regulation of replication, transcription or translation. A "polynucleotide fragment" refers to any subsequence of a polynucleotide, typically, of at least about 9 consecutive nucleotides, preferably at least about 30 nucleotides, more preferably at least about 50 nucleotides, of any of the sequences provided herein. Exemplary polynucleotide fragments are the first sixty consecutive nucleotides of the transcription factor polynucleotides listed in the Sequence Listing. Exemplary fragments also include fragments that comprise a region that encodes an conserved domain of a transcription factor. Exemplary fragments also include fragments that comprise a conserved domain of a transcription factor. Exemplary fragments include fragments that comprise an conserved domain of a transcription factor, for example, amino acid residues 30-126 of G3866 (SEQ ID NO: 3677).

Fragments may also include subsequences of polypeptides and protein molecules, or a subsequence of the polypeptide. Fragments may have uses in that they may have antigenic potential. In some cases, the fragment or domain is a subsequence of the polypeptide which performs at least one biological function of the intact polypeptide in substantially the same manner, or to a similar extent, as does the intact polypeptide. For example, a polypeptide fragment can comprise a recognizable structural motif or functional domain such as a DNA-binding site or domain that binds to a DNA promoter region, an activation domain, or a domain for protein-protein interactions, and may initiate transcription. Fragments can vary in size from as few as 3 amino acid residues to the full length of the intact polypeptide, but are preferably at least about 30 amino acid residues in length and more preferably at least about 60 amino acid residues in length.

The invention also encompasses production of DNA sequences that encode transcription factors and transcription factor derivatives, or fragments thereof, entirely by synthetic chemistry. After production, the synthetic sequence may be inserted into any of the many available expression vectors and cell systems using reagents well known in the art. Moreover, synthetic chemistry may be used to introduce mutations into a sequence encoding transcription factors or any fragment thereof.

"Derivative" refers to the chemical modification of a nucleic acid molecule or amino acid sequence. Chemical modifications can include replacement of hydrogen by an alkyl, acyl, or amino group or glycosylation, pegylation, or any similar process that retains or enhances biological activity or lifespan of the molecule or sequence.

The term "plant" includes whole plants, shoot vegetative organs/structures (for example, leaves, stems and tubers), roots, flowers and floral organs/structures (for example, bracts, sepals, petals, stamens, carpels, anthers and ovules), seed (including embryo, endosperm, and seed coat) and fruit (the mature ovary), plant tissue (for example, vascular tissue, ground tissue, and the like) and cells (for example, guard cells, egg cells, and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, horsetails, psilophytes, lycophytes, bryophytes, and multicellular algae.

A "control plant" as used in the present invention refers to a plant cell, seed, plant component, plant tissue, plant organ or whole plant used to compare against transgenic or genetically modified plant for the purpose of identifying an enhanced phenotype in the transgenic or genetically modified plant. A control plant may in some cases be a transgenic plant line that comprises an empty vector or marker gene, but does not contain the recombinant polynucleotide of the present invention that is expressed in the transgenic or genetically modified plant being evaluated. In general, a control plant is a plant of the same line or variety as the transgenic or genetically modified plant being tested. A suitable control plant would include a genetically unaltered or non-transgenic plant of the parental line used to generate a transgenic plant herein.

A "transgenic plant" refers to a plant that contains genetic material not found in a wild-type plant of the same species, variety or cultivar. The genetic material may include a transgene, an insertional mutagenesis event (such as by transposon or T-DNA insertional mutagenesis), an activation tagging sequence, a mutated sequence, a homologous recombination event or a sequence modified by chimeraplasty. Typically, the foreign genetic material has been introduced into the plant by human manipulation, but any method can be used as one of skill in the art recognizes.

A transgenic plant may contain an expression vector or cassette. The expression cassette typically comprises a polypeptide-encoding sequence operably linked (i.e., under regulatory control of) to appropriate inducible or constitutive regulatory sequences that allow for the controlled expression of polypeptide. The expression cassette can be introduced into a plant by transformation or by breeding after transformation of a parent plant. A plant refers to a whole plant as well as to a plant part, such as seed, fruit, leaf, or root, plant tissue, plant cells or any other plant material, e.g., a plant explant, as well as to progeny thereof, and to in vitro systems that mimic biochemical or cellular components or processes in a cell.

"Wild type" or "wild-type", as used herein, refers to a plant cell, seed, plant component, plant tissue, plant organ or whole plant that has not been genetically modified or treated in an experimental sense. Wild-type cells, seed, components, tissue, organs or whole plants may be used as controls to compare levels of expression and the extent and nature of trait modification with cells, tissue or plants of the same species in which a transcription factor expression is altered, e.g., in that it has been knocked out, overexpressed, or ectopically expressed.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g. by measuring tolerance to water deprivation or particular salt or sugar concentrations, or by the observation of the expression level of a gene or genes, e.g., by employing Northern analysis, RT-PCR, microarray gene expression assays, or reporter gene expression systems, or by agricultural observations such as hyperosmotic stress tolerance or yield. Any technique can be used to measure the amount of, comparative level of, or difference in any selected chemical compound or macromolecule in the transgenic plants, however.

"Trait modification" refers to a detectable difference in a characteristic in a plant ectopically expressing a polynucleotide or polypeptide of the present invention relative to a plant not doing so, such as a wild-type plant. In some cases, the trait modification can be evaluated quantitatively. For example, the trait modification can entail at least about a 2% increase or decrease, or an even greater difference, in an observed trait as compared with a control or wild-type plant. It is known that there can be a natural variation in the modified trait. Therefore, the trait modification observed entails a change of the normal distribution and magnitude of the trait in the plants as compared to control or wild-type plants.

When two or more plants have "similar morphologies", "substantially similar morphologies", "a morphology that is substantially similar", or are "morphologically similar", the plants have comparable forms or appearances, including analogous features such as overall dimensions, height, width, mass, root mass, shape, glossiness, color, stem diameter, leaf size, leaf dimension, leaf density, internode distance, branching, root branching, number and form of inflorescences, and other macroscopic characteristics, and the individual plants are not readily distinguishable based on morphological characteristics alone.

"Modulates" refers to a change in activity (biological, chemical, or immunological) or lifespan resulting from specific binding between a molecule and either a nucleic acid molecule or a protein.

The term "transcript profile" refers to the expression levels of a set of genes in a cell in a particular state, particularly by comparison with the expression levels of that same set of genes in a cell of the same type in a reference state. For example, the transcript profile of a particular transcription factor in a suspension cell is the expression levels of a set of genes in a cell knocking out or overexpressing that transcription factor compared with the expression levels of that same set of genes in a suspension cell that has normal levels of that transcription factor. The transcript profile can be presented as a list of those genes whose expression level is significantly different between the two treatments, and the difference ratios. Differences and similarities between expression levels may also be evaluated and calculated using statistical and clustering methods.

With regard to transcription factor gene knockouts as used herein, the term "knockout" refers to a plant or plant cell having a disruption in at least one transcription factor gene in the plant or cell, where the disruption results in a reduced expression or activity of the transcription factor encoded by that gene compared to a control cell. The knockout can be the result of, for example, genomic disruptions, including transposons, tilling, and homologous recombination, antisense constructs, sense constructs, RNA silencing constructs, or RNA interference. A T-DNA insertion within a transcription factor gene is an example of a genotypic alteration that may abolish expression of that transcription factor gene.

"Ectopic expression or altered expression" in reference to a polynucleotide indicates that the pattern of expression in, e.g., a transgenic plant or plant tissue, is different from the expression pattern in a wild-type plant or a reference plant of the same species. The pattern of expression may also be compared with a reference expression pattern in a wild-type plant of the same species. For example, the polynucleotide or polypeptide is expressed in a cell or tissue type other than a cell or tissue type in which the sequence is expressed in the wild-type plant, or by expression at a time other than at the time the sequence is expressed in the wild-type plant, or by a response to different inducible agents, such as hormones or environmental signals, or at different expression levels (either higher or lower) compared with those found in a wild-type plant. The term also refers to altered expression patterns that are produced by lowering the levels of expression to below the detection level or completely abolishing expression. The resulting expression pattern can be transient or stable, constitutive or inducible. In reference to a polypeptide, the term "ectopic expression or altered expression" further may relate to altered activity levels resulting from the interactions of the polypeptides with exogenous or endogenous modulators or from interactions with factors or as a result of the chemical modification of the polypeptides.

The term "overexpression" as used herein refers to a greater expression level of a gene in a plant, plant cell or plant tissue, compared to expression of that gene in a wild-type plant, cell or tissue, at any developmental or temporal stage. Overexpression can occur when, for example, the genes encoding one or more transcription factors are under the control of a regulatory control element such as a strong or constitutive promoter (e.g., the cauliflower mosaic virus 35S transcription initiation region). Overexpression may also be achieved by placing a gene of interest under the control of an inducible or tissue specific promoter, or may be achieved through integration of transposons or engineered T-DNA molecules into regulatory regions of a target gene. Thus, overexpression may occur throughout a plant, in specific tissues of the plant, or in the presence or absence of particular environmental signals, depending on the promoter or overexpression approach used.

Overexpression may take place in plant cells normally lacking expression of polypeptides functionally equivalent or identical to the present transcription factors. Overexpression may also occur in plant cells where endogenous expression of the present transcription factors or functionally equivalent molecules normally occurs, but such normal expression is at a lower level. Overexpression thus results in a greater than normal production, or "overproduction" of the transcription factor in the plant, cell or tissue.

The term "transcription regulating region" refers to a DNA regulatory sequence that regulates expression of one or more genes in a plant when a transcription factor having one or more specific binding domains binds to the DNA regulatory sequence. Transcription factors of the present invention possess an conserved domain. The transcription factors of the invention also comprise an amino acid subsequence that forms a transcription activation domain that regulates expression of one or more abiotic stress tolerance genes in a plant when the transcription factor binds to the regulating region.

Transcription Factors Modify Expression of Endogenous Genes

A transcription factor may include, but is not limited to, any polypeptide that can activate or repress transcription of a single gene or a number of genes. As one of ordinary skill in the art recognizes, transcription factors can be identified by the presence of a region or domain of structural similarity or identity to a specific consensus sequence or the presence of a specific consensus DNA-binding site or DNA-binding site motif (see, for example, Riechmann et al. (2000a)). The plant transcription factors of the present invention belong to particular transcription factor families indicated in the Tables found herein (see, for example, Riechmann (2000a, 2000b), Reeves and Beckerbauer (2001); and Reeves (2001)).

Generally, the transcription factors encoded by the present sequences are involved in cell differentiation and proliferation and the regulation of growth. Accordingly, one skilled in the art would recognize that by expressing the present sequences in a plant, one may change the expression of autologous genes or induce the expression of introduced genes. By affecting the expression of similar autologous sequences in a plant that have the biological activity of the present sequences, or by introducing the present sequences into a plant, one may alter a plant's phenotype to one with improved traits related to osmotic stresses. The sequences of the invention may also be used to transform a plant and introduce desirable traits not found in the wild-type cultivar or strain. Plants may then be selected for those that produce the most desirable degree of over- or under-expression of target genes of interest and coincident trait improvement.

The sequences of the present invention may be from any species, particularly plant species, in a naturally occurring form or from any source whether natural, synthetic, semisynthetic or recombinant. The sequences of the invention may also include fragments of the present amino acid sequences. Where "amino acid sequence" is recited to refer to an amino acid sequence of a naturally occurring protein molecule, "amino acid sequence" and like terms are not meant to limit the amino acid sequence to the complete native amino acid sequence associated with the recited protein molecule.

In addition to methods for modifying a plant phenotype by employing one or more polynucleotides and polypeptides of the invention described herein, the polynucleotides and polypeptides of the invention have a variety of additional uses. These uses include their use in the recombinant production (i.e., expression) of proteins; as regulators of plant gene expression, as diagnostic probes for the presence of complementary or partially complementary nucleic acids (including for detection of natural coding nucleic acids); as substrates for further reactions, e.g., mutation reactions, PCR reactions, or the like; as substrates for cloning e.g., including digestion or ligation reactions; and for identifying exogenous or endogenous modulators of the transcription factors. The polynucleotide can be, e.g., genomic DNA or RNA, a transcript (such as an mRNA), a cDNA, a PCR product, a cloned DNA, a synthetic DNA or RNA, or the like. The polynucleotide can comprise a sequence in either sense or antisense orientations.

Expression of genes that encode transcription factors that modify expression of endogenous genes, polynucleotides, and proteins are well known in the art. In addition, transgenic plants comprising isolated polynucleotides encoding transcription factors may also modify expression of endogenous genes, polynucleotides, and proteins. Examples include Peng et al. (1997) and Peng et al. (1999). In addition, many others have demonstrated that an *Arabidopsis* transcription factor expressed in an exogenous plant species elicits the same or very similar phenotypic response. See, for example, Fu et al. (2001); Nandi et al. (2000); Coupland (1995); and Weigel and Nilsson (1995)).

In another example, Mandel et al. (1992), and Suzuki et al. (2001), teach that a transcription factor expressed in another plant species elicits the same or very similar phenotypic response of the endogenous sequence, as often predicted in earlier studies of *Arabidopsis* transcription factors in *Arabidopsis* (see Mandel et al. (1992); Suzuki et al. (2001)). Other examples include Müller et al. (2001); Kim et al. (2001); Kyozuka and Shimamoto (2002); Boss and Thomas (2002); He et al. (2000); and Robson et al. (2001).

In yet another example, Gilmour et al. (1998) teach an *Arabidopsis* AP2 transcription factor, CBF1, which, when overexpressed in transgenic plants, increases plant freezing tolerance. Jaglo et al. (2001) further identified sequences in *Brassica napus* which encode CBF-like genes and that transcripts for these genes accumulated rapidly in response to low temperature. Transcripts encoding CBF-like proteins were also found to accumulate rapidly in response to low temperature in wheat, as well as in tomato. An alignment of the CBF proteins from *Arabidopsis*, *B. napus*, wheat, rye, and tomato revealed the presence of conserved consecutive amino acid residues, PKK/RPAGRxKFxETRHP (SEQ ID NO: 17865) and DSAWR (SEQ ID NO: 17866), which bracket the AP2/EREBP DNA binding domains of the proteins and distinguish them from other members of the AP2/EREBP protein family. (Jaglo et al. (2001))

Transcription factors mediate cellular responses and control traits through altered expression of genes containing cis-acting nucleotide sequences that are targets of the introduced transcription factor. It is well appreciated in the art that the effect of a transcription factor on cellular responses or a cellular trait is determined by the particular genes whose expression is either directly or indirectly (e.g., by a cascade of transcription factor binding events and transcriptional changes) altered by transcription factor binding. In a global analysis of transcription comparing a standard condition with one in which a transcription factor is overexpressed, the resulting transcript profile associated with transcription factor overexpression is related to the trait or cellular process controlled by that transcription factor. For example, the PAP2 gene and other genes in the MYB family have been shown to control anthocyanin biosynthesis through regulation of the expression of genes known to be involved in the anthocyanin biosynthetic pathway (Bruce et al. (2000); and Borevitz et al. (2000)). Further, global transcript profiles have been used successfully as diagnostic tools for specific cellular states (e.g., cancerous vs. non-cancerous; Bhattacharjee et al. (2001); and Xu et al. (2001)). Consequently, it is evident to one skilled in the art that similarity of transcript profile upon overexpression of different transcription factors would indicate similarity of transcription factor function.

Polypeptides and Polynucleotides of the Invention

The present invention provides, among other things, transcription factors (TFs), and transcription factor homolog polypeptides, and isolated or recombinant polynucleotides encoding the polypeptides, or novel sequence variant polypeptides or polynucleotides encoding novel variants of transcription factors derived from the specific sequences provided in the Sequence Listing. Also provided are methods for modifying a plant's biomass by modifying the size or number of leaves or seed of a plant by controlling a number of cellular processes, and for increasing a plant's resistance or tolerance to disease or abiotic stresses, respectively. These methods are based on the ability to alter the expression of critical regulatory molecules that may be conserved between diverse plant species. Related conserved regulatory molecules may be originally discovered in a model system such as *Arabidopsis* and homologous, functional molecules then discovered in other plant species. The latter may then be used to confer increased biomass, disease resistance or abiotic stress tolerance in diverse plant species.

Exemplary polynucleotides encoding the polypeptides of the invention were identified in the *Arabidopsis thaliana* GenBank database using publicly available sequence analysis programs and parameters. Sequences initially identified were then further characterized to identify sequences comprising specified sequence strings corresponding to sequence motifs present in families of known transcription factors. In addition, further exemplary polynucleotides encoding the polypeptides of the invention were identified in the plant GenBank database using publicly available sequence analysis programs and parameters. Sequences initially identified were then further characterized to identify sequences comprising specified sequence strings corresponding to sequence motifs present in families of known transcription factors. Polynucleotide sequences meeting such criteria were confirmed as transcription factors.

Additional polynucleotides of the invention were identified by screening *Arabidopsis thaliana* and/or other plant cDNA libraries with probes corresponding to known transcription factors under low stringency hybridization conditions. Additional sequences, including full length coding sequences, were subsequently recovered by the rapid amplification of cDNA ends (RACE) procedure using a commercially available kit according to the manufacturer's instructions. Where necessary, multiple rounds of RACE are performed to isolate 5' and 3' ends. The full-length cDNA was then recovered by a routine end-to-end polymerase chain reaction (PCR) using primers specific to the isolated 5' and 3' ends. Exemplary sequences are provided in the Sequence Listing.

Many of the sequences in the Sequence Listing, derived from diverse plant species, have been ectopically expressed in overexpressor plants. The changes in the characteristic(s) or trait(s) of the plants were then observed and found to confer increased disease resistance, increase biomass and/or increased abiotic stress tolerance. Therefore, the polynucleotides and polypeptides can be used to improve desirable characteristics of plants.

The polynucleotides of the invention were also ectopically expressed in overexpressor plant cells and the changes in the expression levels of a number of genes, polynucleotides, and/or proteins of the plant cells observed. Therefore, the polynucleotides and polypeptides can be used to change expression levels of a genes, polynucleotides, and/or proteins of plants or plant cells.

The data presented herein represent the results obtained in experiments with transcription factor polynucleotides and polypeptides that may be expressed in plants for the purpose of reducing yield losses that arise from biotic and abiotic stress.

The G482 Clade, Including G481 and Related Sequences

Figure 1:
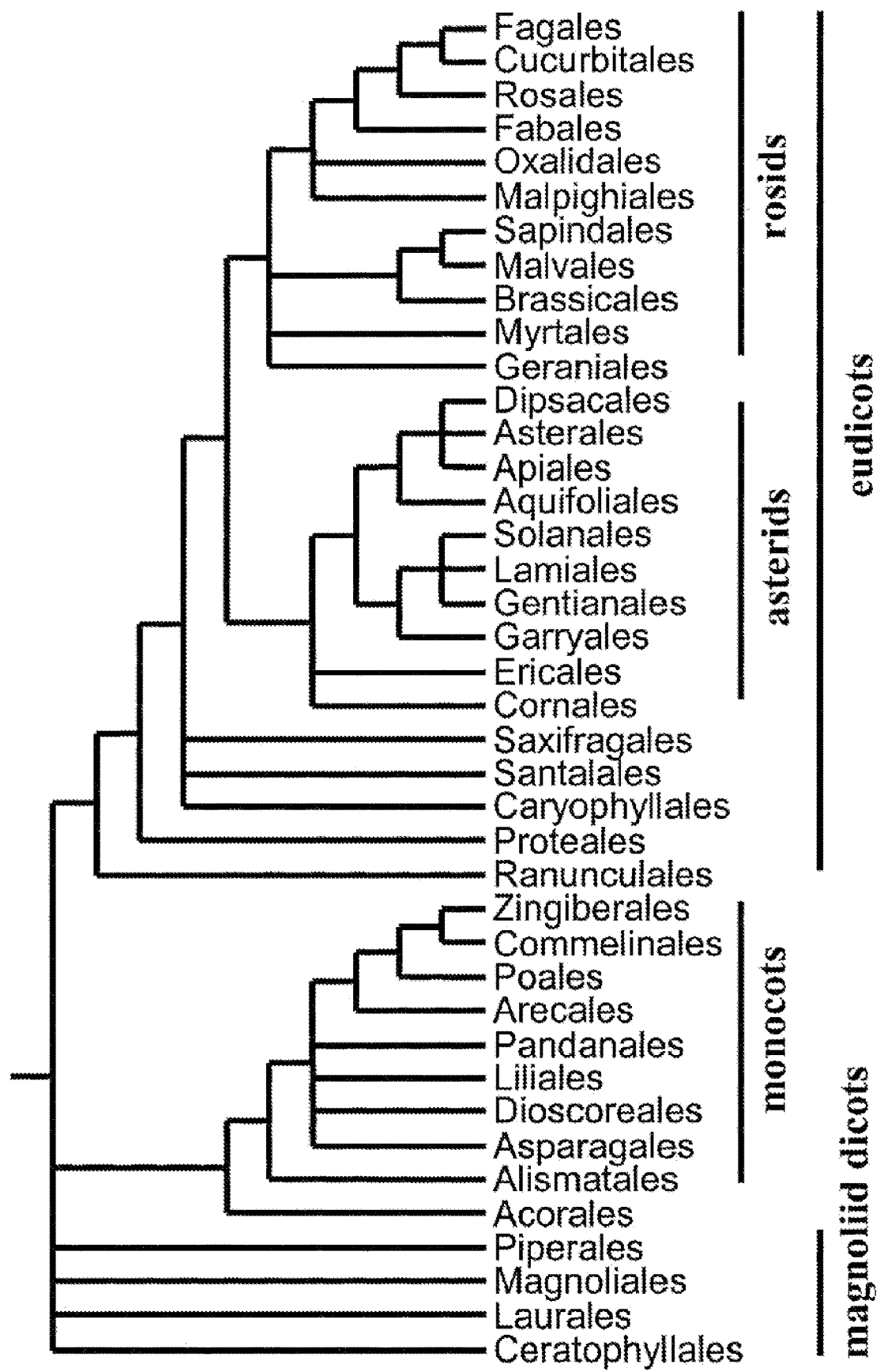
Figure 2:
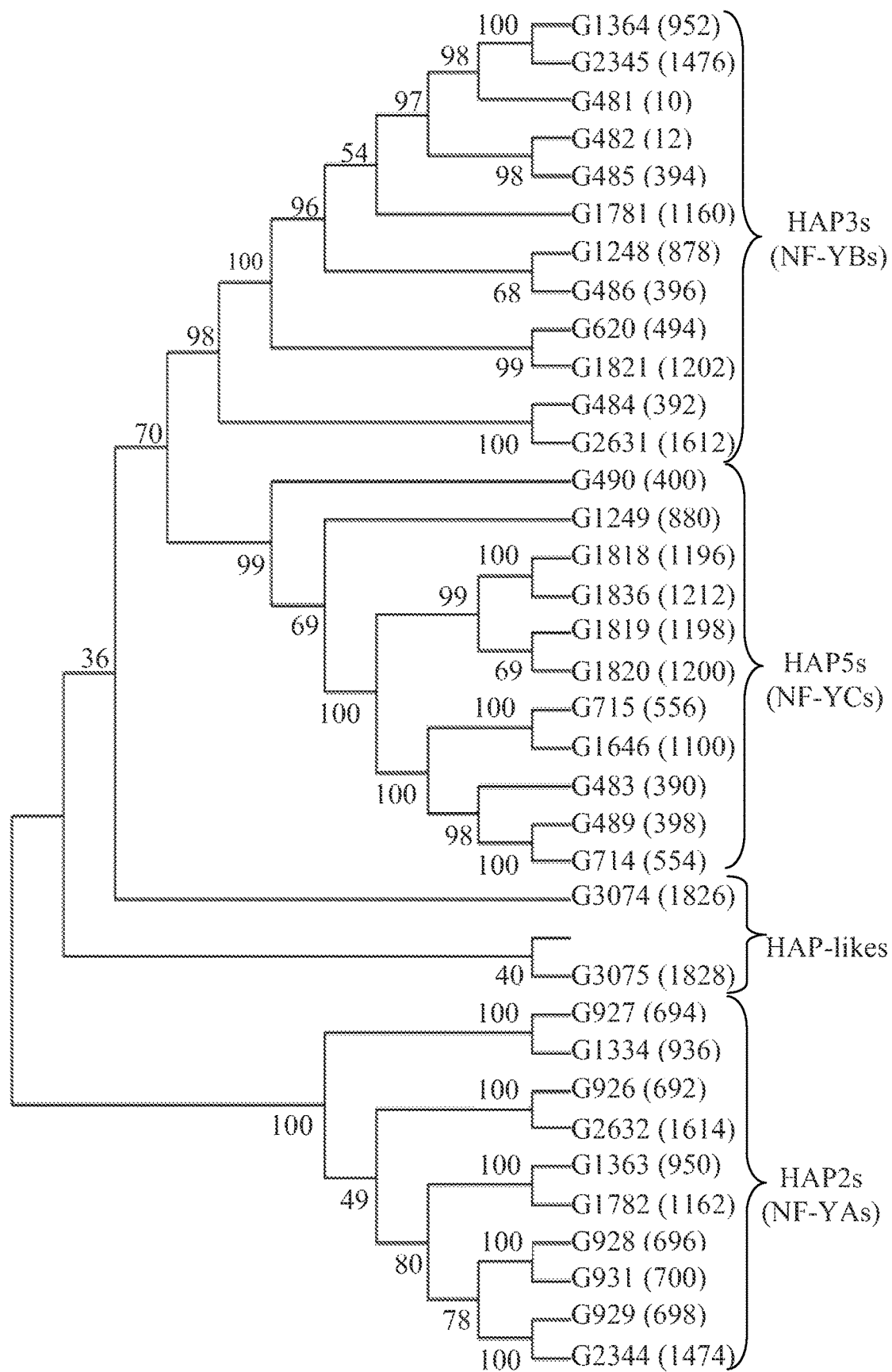
Figure 4:
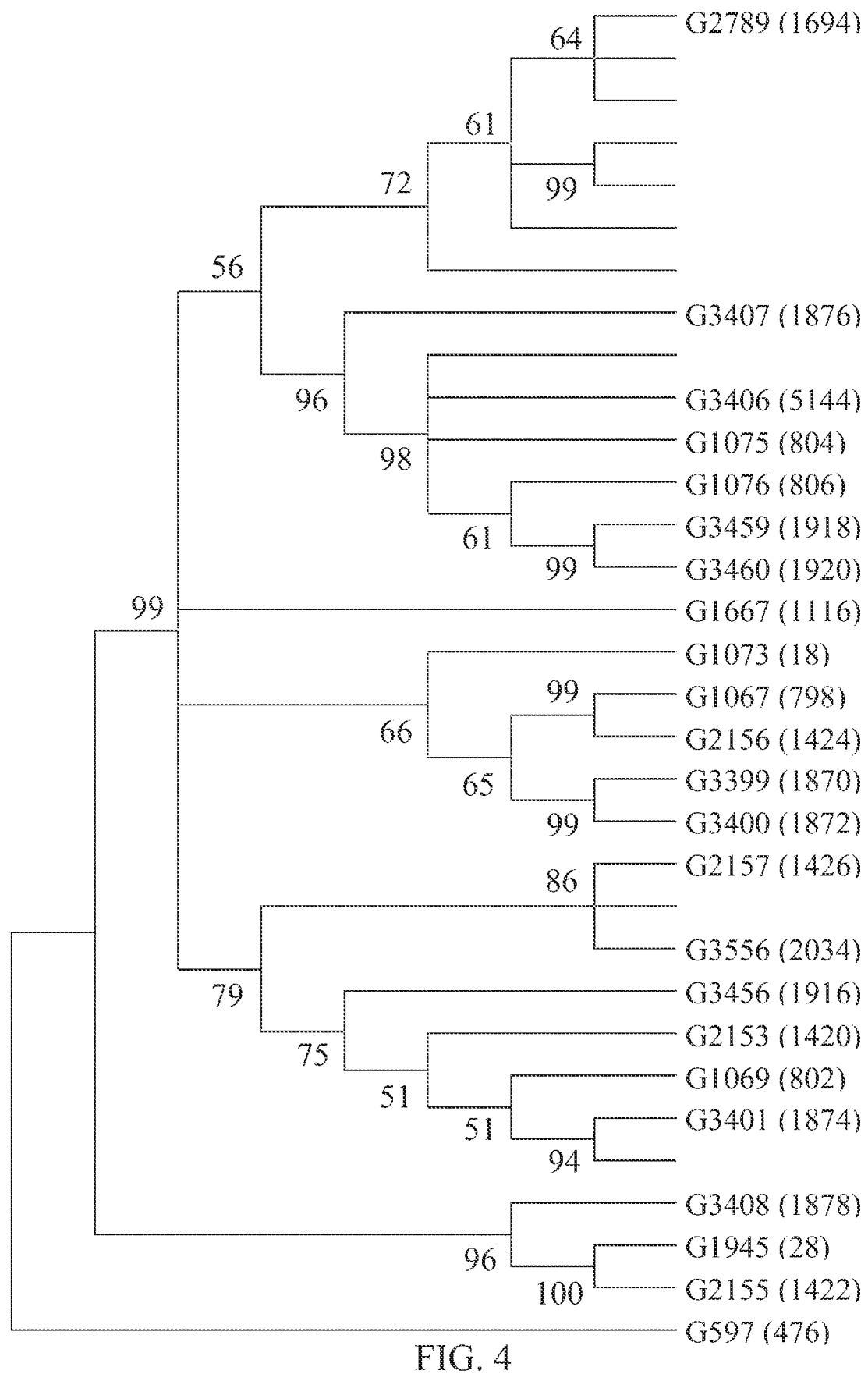
FIG. 4 is a phylogenetic tree of G1073 clade member sequences and include numerous sequences within the clade that have similar functions of conferring, for example, greater biomass and hyperosmotic stress tolerance. The clade is represented by the bracket.
Figure 6:
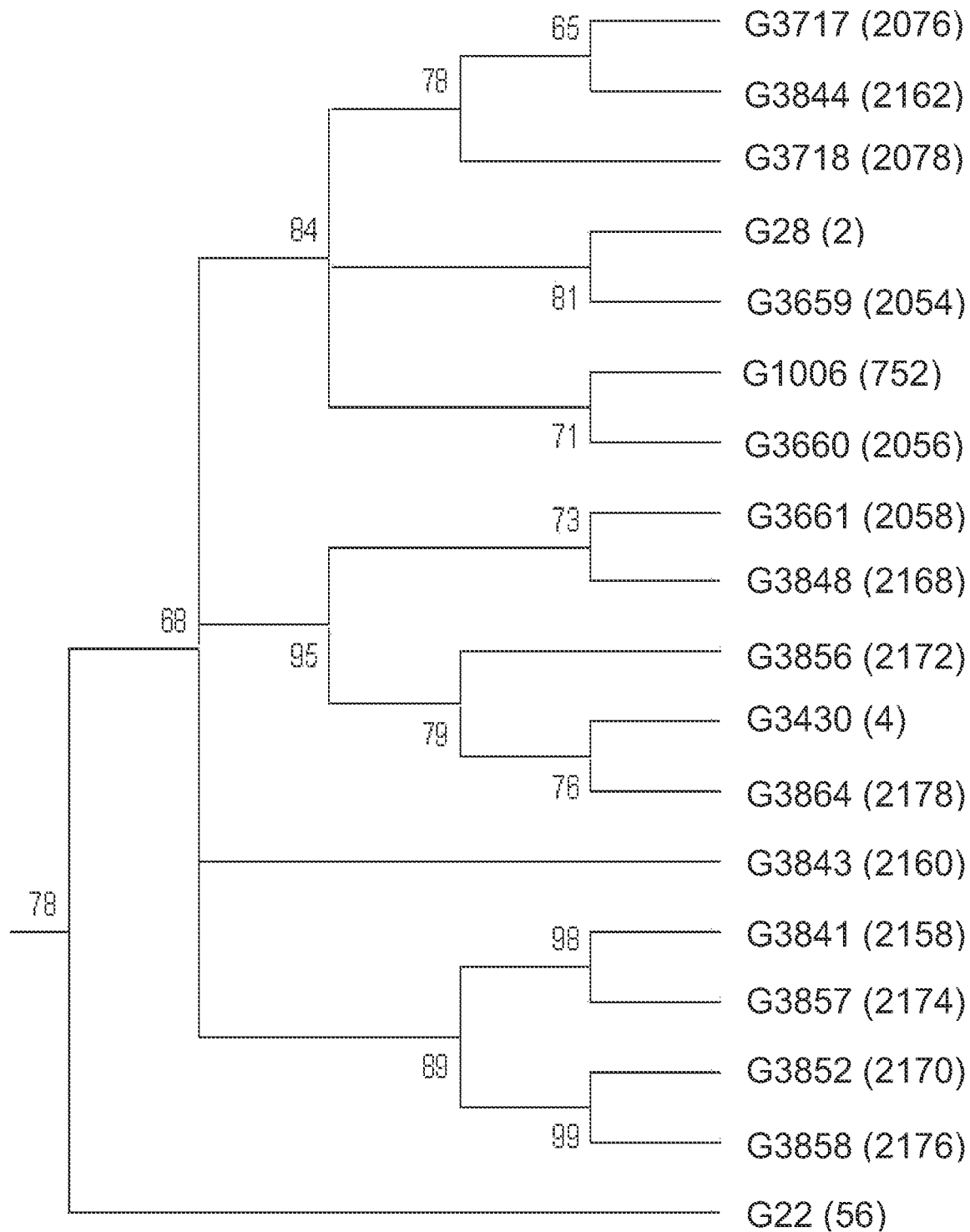
FIG. 6 illustrates a phylogenetic tree of G28 clade member AP2 sequences.

G481 (SEQ ID NOs: 9 and 10; AT2G38880; also known as HAP3A and NF-YB1) from *Arabidopsis* is a member of the HAP3/NF-YB sub-group of the CCAAT binding factor family (CCAAT) of transcription factors (FIG. 2).

Structural Features and Assembly of the NF-Y Subunits.

NF-Y is one of the most heavily studied transcription factor complexes and an extensive literature has accumulated regarding its structure, regulation, and putative roles in various different organisms. Each of the three subunits comprises a region which has been evolutionarily conserved (Li et al. (1992); Mantovani (1999)). In the NF-YA subunits, this conserved region is at the C-terminus, in the NF-YB proteins it is centrally located, and in the NF-YC subunits it is at the N-terminus. The NF-YA and NF-YC subunits also have regions which are rich in glutamine (Q) residues that also show some degree of conservation; these Q-rich regions have an activation domain function. In fact it has been shown that NF-Y contains two transcription activation domains: a glutamine-rich, serine-threonine-rich domain present in the CBF-B (HAP2, NF-YA) subunit and a glutamine-rich domain in the CBF-C(HAP5, CBF-C) subunit (Coustry et al. (1995); Coustry et al. (1996); Coustry et al. (1998); Coustry et al. (2001)).

The NF-YB and NF-YC subunits bear some similarity to histones; the conserved regions of both these subunits contain a histone fold motif (HFM), which is an ancient domain of about 65 amino acids. The HFM has a high degree of structural conservation across all histones and comprises three or four α-helices (four in the case of the NF-Y subunits) which are separated by short loops (L)/strand regions (Arents and Moudrianakis (1995)). In the histones, this HFM domain mediates dimerization and formation of non sequence-specific interactions with DNA (Arents and Moudrianakis (1995)).

Considerable knowledge has now accumulated regarding the biochemistry of NF-Y subunit association and DNA binding. The NF-YB-NF-YC subunits first form a tight dimer, which offers a complex surface for NF-YA association. The resulting trimer can then bind to DNA with high specificity and affinity (Kim and Sheffrey (1990); Bi et al. (1997); Mantovani (1999)). In addition to the NF-Y subunits themselves, a number of other proteins have been implicated in formation of the complex (Mantovani (1999)).

HAP3 (NF-YB) proteins have a modular structure and are comprised of three distinct domains: an amino-terminal A domain, a central B domain and a carboxy-terminal C domain. There is very little sequence similarity between HAP3 proteins within the A and C domains suggesting that those regions could provide a degree of functional specificity to each member of the HAP3 subfamily. The B domain is a highly conserved region that specifies DNA binding and subunit association. Lee et al. (2003) performed an elegant series of domain swap experiments between the LEC1 and a non-LEC1 like HAP3 protein (At4g14540, G485) to demonstrate that the B domain of LEC1 is necessary and sufficient, within the context of the rest of the protein, to confer its activity in embryogenesis. Furthermore, these authors identified a specific defining residue within the B domain (Asp-55) that is required for LEC1 activity and which is sufficient to confer LEC1 function to a non-LEC1 like B domain.

In FIGS. 3A-3B, HAP3 protein B domains from *Arabidopsis*, soybean, rice and corn are aligned with G481.

G1073, the G1073 Clade, and Related Sequences

G1073 (SEQ ID NO: 18, encoded by SEQ ID NO: 17) is a member of the At-hook family of transcription factors. We have now designated this locus as HERCULES 1 (HRC1), in recognition of the increased organ size seen in 35S::G1073 lines.

G1073 contains a single typical AT-hook DNA-binding motif (RRPRGRPAG; SEQ ID NO: 2382) at amino acids 63 to 71. A highly conserved 129 AA domain, with unknown function, can be identified in the single AT-hook domain subgroup. Comprised within this "second conserved domain is the DUF296 domain, which in G1073 occupies amino acids 90-209. According to the National Center for Biotechnology Information (NCBI; www.ncbi.nlm.nih.gov/), "[t]his putative domain is found in proteins that contain AT-hook motifs pfam02178, which strongly suggests a DNA-binding function for the proteins as a whole, however the function of this domain is unknown". Following the second conserved domain, a potential acidic domain spans from position 200 to 219. Additionally, analysis of the protein using PROSITE reveals three potential protein kinase C phosphorylation sites at Ser61, Thr112 and Thr131, and three potential casein kinase II phosphorylation sites at Ser35, Ser99 and Ser276. Additional structural features of G1073 include 1) a short glutamine-rich stretch in the C-terminal region distal to the conserved acidic domain, and 2) possible PEST sequences in the same C-terminal region.

The G1073 clade generally comprises the consensus sequence:

(SEQ ID NO: 5107)
RPRGRPXG, or Arg-Pro-Arg-Gly-Arg-Pro-Xaa-Gly where X or Xaa can be any of a number of amino acid residues; in the examples that have thus far been shown to confer abiotic stress tolerance, Xaa has been shown to represent an alanine, leucine, proline, or serine residue.

Also within the G1073 clade, a second conserved domain exists that generally comprises the consensus sequence: Pro-(Xaa)$_5$-Leu-(Xaa)$_2$-Tyr (SEQ ID NO: 5108), or alternatively Pro-(Xaa)$_5$-Leu-(Xaa)$_2$-Phe (SEQ ID NO: 5109). The tenth position of these latter two sequences is an aromatic residue, specifically tyrosine or phenylalanine, in the G1073 clade sequences that have thus far been examined.

Thus, the AT-hook family transcription factors of the invention each possess an AT-hook domain and a second conserved domain, and include paralogs and orthologs of G1073 found by BLAST analysis, as described below. The AT-hook domains of G1073 and related sequences examined thus far are at least 85% identical to the At-Hook domains of G1073, and the second conserved domains of these related sequences are at least 61% identical to the second conserved domain found in G1073. These transcription factors rely on the binding specificity of their AT-hook domains; many have been shown to have similar or identical functions in plants by increasing the size and biomass of a plant.

Role of at-Hook Proteins.

The At-hook is a short, highly-conserved, DNA binding protein motif that comprises a conserved nine amino acid peptide (Nieto-Sotelo, Ichida and Quail (1994)), the seminal domain of which contains KRPRGRPKK (SEQ ID NO: 5110; Reeves and Nissen, 1990) and is capable of binding to the minor groove of DNA (Reeves and Nissen (1990)). At the center of this AT-hook motif is a short, strongly conserved tripeptide (GRP) comprised of glycine-arginine-proline (Aravind and Landsman (1998)). At-hook motifs were first recognized in the non-histone chromosomal protein HMG-I(Y) but have since been found in other DNA binding proteins from a wide range of organisms. In general, it appears that the AT-hook motif is an auxiliary protein motif cooperating with other DNA-binding activities and facilitating changes in the structure of the chromatin (Aravind and Landsman (1998)). The AT-hook motif can be present in a variable number of copies (1-15) in a given AT-hook protein. For example, the mammalian HMG-I(Y) proteins have three copies of this motif.

Overexpression of G1073 in *Arabidopsis*.

We established that overexpression of G1073 leads to increased vegetative biomass and seed yield compared to control plants. As a result of these phenotypes we assigned the gene name HERCULES1 (HRC1) to G1073. Drought tolerance was observed in 35S::G1073 transgenic lines. We have also observed hyperosmotic stress-tolerance phenotypes, such as tolerance to high salt and high sucrose concentrations, in plate-based assays performed on 35S::G1073 plants.

Due to increased cell size and number, 35S::G1073 *Arabidopsis* lines display enlarged organs. We also conducted some preliminary analyses into the basis of the enhanced biomass of 35S::G1073 *Arabidopsis* lines. We found that the increased mass of 35S::G1073 transgenic plants could be attributed to enlargement of multiple organ types including leaves, stems, roots and floral organs. Petal size in the 35S::G1073 lines was increased by 40-50% compared to wild type controls. Petal epidermal cells in those same lines were approximately 25-30% larger than those of the control plants. Furthermore, we found 15-20% more epidermal cells per petal, compared to wild type. Thus, at least in petals, the increase in size was associated with an increase in cell size as well as in cell number. Additionally, images from the stem cross-sections of 35S::G1073 plants revealed that cortical cells were large and that vascular bundles contained more cells in the phloem and xylem relative to wild type.

Advantages of Root-Specific Expression:

Plants often respond to stresses such as limited water or nutrients by altering their root-shoot ratios, root architecture, or root growth. These changes are mediated through transcriptional responses in both the root and shoot. Since there is evidence that G1073 has a native role in the root, this gene and other genes encoding related proteins from the plant At-hook family may confer drought tolerance by controlling root development or other root responses. Root specific expression of G1073 and other sequences that encode plant At-hook proteins (for example: G1067, G1069, G1073, G1075, G1076, G1667, G1945, G2153, G2155, G2156, G2157, G3399, G3400, G3401, G3406, G3407, G3408, G3456, G3459, G3460, G3556, G597, G605, G1068, G1128, G1399, G1944, G2522 (SEQ ID NOs: 798, 802, 18, 804, 806, 1116, 28, 1420, 1422, 1424, 1426, 1870, 1872, 1874, 5145, 1876, 1878, 1916, 1918, 1920, 2034, 476, 484, 800, 828, 964, 1286, 1552) under the regulatory control of a promoter that drives root specific or root enhanced expression, such as, for example, ARSK1, NAS2, or others [such as the regulator regions from genes discussed recently by Birnbaum et al. (2003) or Brady et al. (2007) as having root specific expression patterns], may be used to produce transformed plants that are water deficit tolerant but lack undesirable developmental effects that may be associated with constitutive overexpression (e.g., for some applications, large plants, or changes in plant organ size or shape may be disadvantageous).

G28, the G28 Clade, and Related Sequences

G28 (SEQ ID NO: 2, encoded by SEQ ID NO: 1) corresponds to AtERF1 (GenBank accession number AB008103) (Fujimoto et al. (2000)). G28 appears as gene At4g17500 in the annotated sequence of *Arabidopsis* chromosome 4 (AL161546.2). G28 has been shown to confer resistance to both necrotrophic and biotrophic pathogens. The G28 polypeptide (SEQ ID NO: 2) is a member of the B-3a subgroup of the ERF subfamily of AP2 transcription factors, defined as having a single AP2 domain and having specific residues in the DNA binding domain that distinguish this large subfamily (65 members) from the DREB subfamily (see below). AtERF1 is apparently orthologous to the AP2 transcription factor Pti4, identified in tomato, which has been shown by Martin and colleagues to function in the Pto disease resistance pathway, and to confer broad-spectrum disease resistance when overexpressed in *Arabidopsis* (Zhou et al. (1997); Gu et al. (2000); Gu et al. (2002)).

AP2 Domain Transcription Factors.

This large transcription factor gene family includes 145 transcription factors (Weigel (1995); Okamuro et al. (1997); Riechmann and Meyerowitz (1998); Riechmann et al. (2000)). Based on the results of our earlier genomics screens it is clear that this family of proteins affect the regulation of a wide range of morphological and physiological processes, including the acquisition of abiotic and biotic stress tolerance. The AP2 family includes the AP2/ERF group which contain a single AP2 domain. This AP2/ERF class can be further categorized into three subgroups:

The DREB ("A") (dehydration responsive element binding) sub-family which comprises 56 genes. Many of the DREBs are involved in regulation of abiotic stress tolerance pathways (Stockinger et al. (1997); Jaglo-Ottosen et al. (1998); Finkelstein et al. (1998); Sakuma et al. (2002)).

The ERF (ethylene response factor) sub-family ("B") which includes 65 genes, several of which are involved in regulation of biotic stress tolerance pathways (Ohme-Takagi and Shinshi (1995); Zhou et al. (1997)). The DREB and ERF sub-groups are distinguished by the amino acids present at position 14 and 19 of the AP2 domain: while DREBs are characterized by Val-14 and Glu-19, ERFs typically have Ala-14 and Asp-19. Recent work indicates that those two amino acids have a key function in determining the target specificity (Sakuma et al. (2002), Hao et al. (2002)).

[3] The RAV class (6 genes) all of which have a B3 DNA binding domain in addition to the AP2 DNA binding domain, and which also regulate abiotic stress tolerance pathways.

The Role of ERF Transcription Factors in Stress Responses: ERF Transcription Factors in Disease Resistance.

The first indication that members of the ERF group might be involved in regulation of plant disease resistance pathways was the identification of Pti4, Pti5 and Pti6 as interactors with the tomato disease resistance protein Pto in yeast 2-hybrid assays (Zhou et al. (1997)). Since that time, many ERF genes have been shown to enhance disease resistance when overexpressed in *Arabidopsis* or other species. These ERF genes include ERF1 (G1266) of *Arabidopsis* (Berrocal-Lobo et al. (2002); Berrocal-Lobo and Molina, (2004)); Pti4 (Gu et al. (2002)) and Pti5 (He et al. (2001)) of tomato; Tsi1 (Park et al. (2001); Shin et al. (2002)), NtERF5 (Fischer and Droge-Laser (2004)), and OPBP1 (Guo et al. (2004)) of tobacco; CaERFLP1 (Lee et al. (2004)) and CaPF1 (Yi et al. (2004)) of hot pepper; and AtERF1 (G28) and TDR1 (G1792) of *Arabidopsis* (our data).

Protein Structure and Properties.

G28 lacks introns and encodes a 266 amino acid protein with a predicted molecular weight of 28.9 kDa. Specific conserved motifs have been identified through alignments with other related ERFs. The AP2 domain of G28 is relatively centrally positioned in the intact protein. G28 has been shown to bind specifically to the AGCCGCC motif (GCC box: Hao et al. (1998); Hao et al. (2002)). Our analysis of the G28 regulon by global transcript profiling is consistent with this, as the 5' regions of genes up-regulated by G28 are enriched for the presence of AGCCGCC motifs. The AP2 domain of AtERF1 (G28) was purified and used by Allen et al. (1998) in solution NMR studies of the AP2 domain and its interaction with DNA. This analysis indicated that certain residues in three beta-strands are involved in DNA recognition, and that an alpha helix provides structural support for the DNA binding domain.

A potential bipartite nuclear localization signal has been reported in the G28 protein. A protein scan also revealed several potential phosphorylation sites, but the conserved motifs used for those predictions are small, have a high probability of occurrence. However, the orthologous Pti4 sequence has been shown to be phosphorylated in multiple locations, which have yet to be mapped in detail. A protein alignment of closely related ERF sequences indicates the presence of conserved domains unique to B-3a ERF proteins. For example, a motif not found in other *Arabidopsis* transcription factors is found directly C-terminal to the AP2 domain in eudicot sequences, but is not found in monocot sequences. Another conserved motif is found 40-50 amino acids N-terminal to the AP2 DNA binding domain. The core of this motif is fairly well conserved in both eudicots and monocots, but extensions of the motif are divergent between eudicots and monocots. The identification of specific motifs unique to small clades of ERF transcription factors suggests that these motifs may be involved in specific interactions with other protein factors involved in transcriptional control, and thereby may determine functional specificity. Known transcriptional activation domains are either acidic, proline rich or glutamine rich (Liu et al. (1999)). The G28 protein contains one acid-enriched region (overlapping with the first eudicot-specific motif). There is also evidence that regions rich in serine, threonine, and proline may function in transcriptional activation (Silver et al. (2003)). There are two ser/pro-enriched regions in the region N-terminal to the AP2 domain None of these domains has yet to be demonstrated directly to have a role in transcriptional activation.

G1792, the G1792 Clade, and Related Sequences

We first identified G1792 (AT3G23230; SEQ ID NO: 23, 24) as a transcription factor in the sequence of BAC clone K14B15 (AB025608, gene K14B15.14). We have assigned the name TRANSCRIPTIONAL REGULATOR OF DEFENSE RESPONSE 1 (TDR1) to this gene, based on its apparent role in disease responses. The G1792 protein contains a single AP2 domain and belongs to the ERF class of AP2 proteins. A review of the different sub-families of proteins within the AP2 family is provided in the information provided for G28, above. The G28 disclosure provided herein includes description of target genes regulated by ERF transcription factors, the role of ERF transcription factors in stress responses: ERF transcription factors in disease resistance, ERF transcription factors in abiotic stress responses, regulation of ERF transcription factors by pathogen and small molecule signaling, etc., which also pertain to G1792.

G1792 Overexpression Increases Survivability in a Soil-Based Drought Assay.

35S::G1792 lines exhibited markedly enhanced drought tolerance in a soil-based drought screen compared to wild-type, both in terms of their appearance at the end of the drought period, and in survival following re-watering.

G1792 Overexpression Increases Tolerance to Growth on Nitrogen-Limiting Conditions.

35S::G1792 transformants showed more tolerance to growth under nitrogen-limiting conditions. In a root growth assay under conditions of limiting N, 35S::G1792 lines were slightly less stunted. In an germination assay that monitors the effect of carbon on nitrogen signaling through anthocyanin production (with high sucrose+/−glutamine; Hsieh et al. (1998)), the 35S::G1792 lines made less anthocyanin on high sucrose (+glutamine), suggesting that the gene could be involved in the plant's ability to monitor carbon and nitrogen status.

G1792 Overexpression Causes Morphological Alterations.

Plants overexpressing G1792 showed several mild morphological alterations: leaves were darker green and shiny, and plants bolted, and subsequently senesced, slightly later than wild-type controls. Among the T1 plants, additional morphological variation (not reproduced later in the T2 plants) was observed: many showed reductions in size as well as aberrations in leaf shape, phyllotaxy, and flower development.

G1792 Overexpression Produces Disease Resistance.

35S::G1792 plants were more resistant to the fungal pathogens *Fusarium oxysporum* and *Botrytis cinerea*: they showed fewer symptoms after inoculation with a low dose of each pathogen. This result was confirmed using individual T2 lines. The effect of G1792 overexpression in increasing resistance to pathogens received further, incidental confirmation. T2 plants of 35S::G1792 lines 5 and 12 were being grown (for other purposes) in a room that suffered a serious powdery mildew infection. For each line, a pot of 6 plants was present in a flat containing 9 other pots of lines from unrelated genes. In either of the two different flats, the only plants that were free from infection were those from the 35S::G1792 line. This observation suggested that G1792 overexpression increased resistance to powdery mildew.

G1792 has three paralogs, G30, G1791 and G1795 (SEQ ID NO: 66, 1172 and 26, respectively), which were not assayed for disease resistance in an earlier genomics program because their overexpression caused severe negative side effects. Some evidence suggested that these genes might play a role in disease resistance: expression of G1795 and G1791 was induced by *Fusarium*, and G1795 by salicylic acid, in RT-PCR experiments, and the lines shared the glossy phenotype observed for G1792. Phylogenetic trees based on whole protein sequences do not always make the relationship of these proteins to G1792 clear; however, the close relationship of these proteins is evident in an alignment and in a phylogenetic analysis based on the conserved AP2 domain and a second conserved motif, the EDLL domain described below.

In this study G1792, G1791, G1795 and G30 were expressed under the control of four different promoters using the two-component system. The promoters chosen were 35S, RBCS3 (mesophyll or photosynthetic-specific), LTP1 (epidermal-specific), and 35S::LexA:GAL4:GR (dexamethasone-inducible). All promoters other than 35S produced substantial amelioration of the negative side effects of transcription factor overexpression.

Five lines for each combination were tested with *Sclerotinia*, *Botrytis*, or *Fusarium*. Interestingly, G1791 and G30 conferred significant resistance to *Sclerotinia* when expressed under RBCS3 or 35S::LexA:GAL4:GR, even though G1792 does not confer *Sclerotinia* resistance. These results support the hypothesis that genes of this clade confer disease resistance when expressed under tissue specific or inducible promoters.

TABLE 1

Disease screening of G1792 and paralogs under different promoters

| | G1792 | | | G1791 | | | G1795 | | | G30 | | |
|---|---|---|---|---|---|---|---|---|---|---|---|---|
| | SEQ ID NO: | | | | | | | | | | | |
| | 24 | | | 1172 | | | 26 | | | 66 | | |
| | B | S | F | B | S | F | B | S | F | B | S | F |
| 35S | ++ | wt | + | nd | nd | nd | nd | nd | nd | nd | nd | nd |
| RBCS3 | + | wt | + | wt | wt | wt | ++ | ++ | wt | + | + | wt |
| LTP1 | wt | wt | nd | + | wt | wt | ++ | + | wt | + | wt | wt |
| 35S, Dexamethasone-induced | ++ | wt | + | ++ | ++ | wt | ++ | ++ | wt | ++ | ++ | wt |

Abbreviations and symbols:
B, *Botrytis*
S, *Sclerotinia*
F, *Fusarium*
Scoring:
wt, wild-type (susceptible) phenotype
+, mild to moderate resistance
++, strong resistance
nd, not determined Domains.

In addition to the AP2 domain (domains of G1792 clade members are shown in Table 7), G1792 contains a putative activation domain. This domain has been designated the "EDLL domain" based on four amino acids that are highly conserved across paralogs and orthologs of G1792 (FIG. 14).

Tertiary Structure.

The solution structure of an ERF type transcription factor domain in complex with the GCC box has been determined (Allen et. al., 1998). It consists of a β-sheet composed of three strands and an α-helix. Flanking sequences of the AP2 domain of this protein were replaced with the flanking sequences of the related CBF1 protein, and the chimeric protein was found to contain the same arrangement of secondary structural elements as the native ERF type protein (Allen et al. (1998)). This implies that the secondary structural motifs may be conserved for similar ERF type transcription factors within the family.

DNA Binding Motifs.

Two amino acid residues in the AP2 domain, Ala-14 and Asp-19, are definitive of the ERF class transcription factors Sakuma et al. (2002). Recent work indicates that these two amino acids have a key function in determining binding specificity (Sakuma et al. (2002), Hao et al. (2002)) and interact directly with DNA. The 3-dimensional structure of the GCC box complex indicates the interaction of the second strand of the β-sheet with the DNA.

G47, the G47 Clade, and Related Sequences

G47 (SEQ ID NO: 5, AT1G22810) encodes a member of the AP2 class of transcription factors (SEQ ID NO: 6) and was included based on the resistance to drought-related abiotic stress exhibited by 35S::G47 *Arabidopsis* lines and by overexpression lines for the closely related paralog, G2133 (SEQ ID NO: 7 and polypeptide SEQ ID NO: 8, AT1G71520). A detailed genetic characterization has not been reported for either of these genes in the public literature.

AP2 Family Transcription Factors.

Based on the results of our earlier genomics screens, it is clear that this family of proteins affect the regulation of a wide range of morphological and physiological processes, including the acquisition of stress tolerance. The AP2 family can be further divided into subfamilies as detailed in the G28 section, above.

G47 and G2133 Protein Structure.

G47 and G2133 and other highly related AP2 proteins (FIG. 8) and are members of the AP2/ERF subfamily Both proteins possess an AP2 domain at the amino terminus and a somewhat acidic region at the C-terminus that might constitute an activation domain. A putative bipartite NLS is located at the start of the AP2 domain in both proteins. Sakuma et al. (Sakuma et al. (2002)) categorized these factors within the A-5 class of the DREB related sub-group based on the presence of a V residue at position 14 within the AP2 domain Importantly, however, position 19 within the AP2 domain is occupied by a V residue in both G2133 and G47, rather than an E residue, as is the case in the majority of DREBs. Additionally, the "RAYD-box" within the AP2 domains of these two proteins is uniquely occupied by the sequence that substitutes a "V" for the "R" and an "H" for the "Y" in the RAYD-box (within SEQ ID NO: 2375, and near the right margin of the top group of subsequences in FIG. 9), a combination not found in any other *Arabidopsis* AP2/ERF protein (Sakuma et al. (2002)). These differences to other AP2 proteins could confer unique DNA binding properties on G2133 and G47.

Morphological Effects of G47 and G2133 Overexpression.

A number of striking morphological effects were observed in 35S::G47 lines. At early stages, the plants were somewhat reduced in size. However, these lines flowered late and eventually developed an apparent increase in rosette size compared to mature wild-type plants. Additionally, the 35S:: G47 plants showed a marked difference in aerial architecture; inflorescences displayed a short stature, had a reduction in apical dominance, and developed thick fleshy stems. When sections from these stems were stained and examined, it was apparent that the vascular bundles were grossly enlarged compared to wild-type. Similar morphological changes were apparent in shoots of 35S::G2133 lines, but most of the 35S::G2133 lines exhibited much more severe dwarfing at early stages compared to 35S::G47 lines. Nevertheless, at later stages, a number of 35S::G2133 lines showed a very similar reduction of apical dominance and a fleshy appearance comparable to that seen in 35S::G47 lines.

Physiological Effects of G47 and G2133 Overexpression.

Both 35S::G2133 lines and 35S::G47 lines exhibited abiotic stress resistance phenotypes in the screens performed during our earlier genomics program. 35S::G47 lines displayed increased tolerance to hyperosmotic stress (PEG) whereas 35S::G2133 lines were more tolerant to the herbicide glyphosate compared to wild type.

The increased tolerance of 35S::G47 lines to PEG, combined with the fleshy appearance and altered vascular structure of the plants, led us to test these lines in a soil drought screen. 35S::G2133 lines were also included in that assay, given the close similarity between the two proteins and the comparable morphological effects obtained. Both 35S::G47 and 35S::G2133 lines showed a strong performance in that screen and exhibited markedly enhanced drought tolerance compared to wild-type, both in terms of their appearance at the end of the drought period, and in survivability following re-watering. In fact, of the approximately 40 transcription factors tested in that screen, 35S::G2133 lines showed the top performance in terms of each of these criteria.

G1274, the G1274 Clade, and Related Sequences

G1274 (SEQ ID NO: 19) from *Arabidopsis* encodes a member of the WRKY family of transcription factors (SEQ ID NO: 20) and was included based primarily on soil-based drought tolerance exhibited by 35S::G1274 *Arabidopsis* lines. G1274 corresponds to AtWRKY51 (At5g64810), a gene for which there is currently no published information.

WRKY Transcription Factors.

In *Arabidopsis* alone, there are more than 70 members of the WRKY superfamily. The defining feature of the family is the ~57 amino acid DNA binding domain that contains a conserved heptapeptide motif. Additionally, all WRKY proteins have a novel zinc-finger motif contained within the DNA binding domain There are three distinct groups within the superfamily, each principally defined by the number of WRKY domains and the structure of the zinc-finger domain (reviewed by Eulgem et al. (2000)). Group I members have two WRKY domains, while Group II members contain only one. Members of the Group II family can be further split into five distinct subgroups (IIa-e) based on conserved structural motifs. Group III members have only one WRKY domain, but contain a zinc finger domain that is distinct from Group II members. The majority of WRKY proteins are Group II members, including G1274 and the related genes being studied here. An additional common feature found among WRKY genes is the existence of a conserved intron found within the region encoding the C-terminal WRKY domain of group I members or the single WRKY domain of group II/III members. In G1274, this intron occurs between the sequence encoding amino acids R130 and N131.

Structural Features of G1274.

The G1274 sequence possesses a potential serine-threonine-rich activation domain and putative nuclear localization signals, the "WRKY" (DNA binding) domain, and zinc finger motif, with the pattern of potential zinc ligands C-X$_{4-5}$-C-X$_{22-23}$-H-X$_1$-H (SEQ ID NO: 5164).

Tables 2-18 list a number of polypeptides of the invention and include the amino acid residue coordinates for the conserved domains, the conserved domain sequences of the respective polypeptides, (sixth column); the identity in percentage terms to the conserved domain of the lead *Arabidopsis* sequence (the first transcription factor listed in each table), and whether the given sequence in each row was shown to confer greater biomass and yield or stress tolerance in plants (+) or has thus far not been shown to confer stress tolerance (−) for each given promoter::gene combination in our experiments. Percentage identities to the sequences listed in Tables 2-18 were determined using BLASTP analysis with defaults of wordlength (W) of 3, an expectation (E) of 10, and the BLOSUM62 scoring matrix Henikoff & Henikoff (1992). When the conserved domain sequences found in Tables 2-18 are optimally aligned using the BLOSUM62 matrix, a gap existence penalty of 11, and a gap extension penalty of 1, similar conserved domains may be identified by virtue of having a minimum specified percentage identity. Said minimum percentage identity may be determined by the percentage identities found within a given clade of transcription factors. Examples of percentage identities to *Arabidopsis* sequences that are clade members are provided in Tables 2-18, although it is anticipated and expected that other percentage identities may be determined by related clade sequences to another *Arabidopsis* sequence, or a sequence from another plant species, where that sequence is a functional clade member.

TABLE 2

Conserved domains of G481 (TF family: CCAAT-binding) and closely related HAP3 sequences

| SEQ ID NO: | Species from which SEQ ID NO: is derived | Gene ID (GID) | Conserved B domain amino acid coordinates | Conserved B domain SEQ ID NO: | Conserved B domain | Percent ID of conserved B domain to G481 conserved B domain |
|---|---|---|---|---|---|---|
| 10 | *Arabidopsis thaliana* | G481 | 20-109 | 2377 | REQDRYLPIANISRIMKKALPPN GKIGKDAKDTVQECVSEFISFIT SEASDKCQKEKRKTVNGDDLL WAMATLGFEDYLEPLKIYLAR YR | 100 |
| 1922 | *Glycine max* | G3470 | 27-116 | 3527 | REQDRYLPIANISRIMKKALPPN GKIAKDAKDTMQECVSEFISFIT SEASEKCQKEKRKTINGDDLL WAMATLGFEDYIEPLKVYLAR YR | 93 |
| 1924 | *Glycine max* | G3471 | 26-115 | 3528 | REQDRYLPIANISRIMKKALPPN GKIAKDAKDTMQECVSEFISFIT SEASEKCQKEKRKTINGDDLL WAMATLGFEDYIEPLKVYLAR YR | 93 |
| 2188 | *Glycine max* | G3875 | 25-114 | 3680 | REQDRYLPIANISRIMKKALPA NGKIAKDAKETVQECVSEFISFI TSEASDKCQREKRKTINGDDLL WAMATLGFEDYIDPLKIYLTRY R | 91 |
| 2190 | *Zea mays* | G3876 | 30-119 | 3681 | REQDRFLPIANISRIMKKAIPAN GKIAKDAKETVQECVSEFISFIT SEASDKCQREKRKTINGDDLL WAMATLGFEDYIEPLKVYLQK YR | 87 |
| 1860 | *Oryza sativa* | G3394 | 38-126 | 3483 | RQDRFLPIANISRIMKKAIPANG KIAKDAKETVQECVSEFISFITS EASDKCQREKRKTINGDDLLW AMATLGFEDYIEPLKVYLQKY R | 87 |
| 1886 | *Zea mays* | G3434 | 18-107 | 3502 | REQDRFLPIANISRIMKKAVPA NGKIAKDAKETLQECVSEFISF VTSEASDKCQKEKRKTINGDD LLWAMATLGFEEYVEPLKIYL QKYK | 85 |
| 952 | *Arabidopsis thaliana* | G1364 | 29-118 | 2941 | REQDRFLPIANISRIMKRGLPAN GKIAKDAKEIVQECVSEFISFVT SEASDKCQREKRKTINGDDLL WAMATLGFEDYMEPLKVYLM RYR | 85 |

TABLE 2-continued

Conserved domains of G481 (TF family: CCAAT-binding) and closely related HAP3 sequences

| SEQ ID NO: | Species from which SEQ ID NO: is derived | Gene ID (GID) | Conserved B domain amino acid coordinates | Conserved B domain SEQ ID NO: | Conserved B domain | Percent ID of conserved B domain to G481 conserved B domain |
|---|---|---|---|---|---|---|
| 1932 | Glycine max | G3475 | 23-112 | 3532 | REQDRFLPIANVSRIMKKALPA NAKISKDAKETVQECVSEFISFI TGEASDKCQREKRKTINGDDL LWAMTTLGFEDYVEPLKGYLQ RFR | 84 |
| 394 | Arabidopsis thaliana | G485 | 20-109 | 2616 | REQDRFLPIANVSRIMKKALPA NAKISKDAKETVQECVSEFISFI TGEASDKCQREKRKTINGDDL LWAMTTLGFEDYVEPLKVYLQ KYR | 84 |
| 1934 | Glycine max | G3476 | 26-115 | 3533 | REQDRFLPIANVSRIMKKALPA NAKISKDAKETVQECVSEFISFI TGEASDKCQREKRKTINGDDL LWAMTTLGFEEYVEPLKIYLQ RFR | 84 |
| 1476 | Arabidopsis thaliana | G2345 | 28-117 | 3234 | REQDRFLPIANISRIMKRGLPLN GKIAKDAKETMQECVSEFISFV TSEASDKCQREKRKTINGDDLL WAMATLGFEDYIDPLKVYLMR YR | 84 |
| 1930 | Glycine max | G3474 | 25-114 | 3531 | REQDRFLPIANVSRIMKKALPA NAKISKEAKETVQECVSEFISFI TGEASDKCQKEKRKTINGDDL LWAMTTLGFEDYVDPLKIYLH KYR | 84 |
| 1936 | Glycine max | G3478 | 23-112 | 3534 | REQDRFLPIANVSRIMKKALPA NAKISKDAKETVQECVSEFISFI TGEASDKCQREKRKTINGDDL LWAMTTLGFEDYVEPLKGYLQ RFR | 84 |
| 12 | Arabidopsis thaliana | G482 | 26-115 | 2378 | REQDRFLPIANVSRIMKKALPA NAKISKDAKETMQECVSEFISF VTGEASDKCQKEKRKTINGDD LLWAMTTLGFEDYVEPLKVYL QRFR | 83 |
| 1888 | Zea mays | G3435 | 22-111 | 3503 | REQDRFLPIANVSRIMKKALPA NAKISKDAKETVQECVSEFISFI TGEASDKCQREKRKTINGDDL LWAMTTLGFEDYVEPLKHYLH KFR | 83 |
| 1926 | Glycine max | G3472 | 25-114 | 3529 | REQDRFLPIANVSRIMKKALPA NAKISKEAKETVQECVSEFISFI TGEASDKCQKEKRKTINGDDL LWAMTTLGFEEYVEPLKVYLH KYR | 83 |
| 1890 | Zea mays | G3436 | 20-109 | 3504 | REQDRFLPIANVSRIMKKALPA NAKISKDAKETVQECVSEFISFI TGEASDKCQREKRKTINGDDL LWAMTTLGFEDYVEPLKLYLH KFR | 83 |
| 1866 | Oryza sativa | G3397 | 23-112 | 3486 | REQDRFLPIANVSRIMKKALPA NAKISKDAKETVQECVSEFISFI TGEASDKCQREKRKTINGDDL LWAMTTLGFEDYVDPLKHYLH KFR | 82 |

TABLE 2-continued

Conserved domains of G481 (TF family: CCAAT-binding) and closely related HAP3 sequences

| SEQ ID NO: | Species from which SEQ ID NO: is derived | Gene ID (GID) | Conserved B domain amino acid coordinates | Conserved B domain SEQ ID NO: | Conserved B domain | Percent ID of conserved B domain to G481 conserved B domain |
|---|---|---|---|---|---|---|
| 1862 | Oryza sativa | G3395 | 19-108 | 3484 | REQDRFLPIANISRIMKKAVPA NGKIAKDAKETLQECVSEFISF VTSEASDKCQKEKRKTINGEDL LFAMGTLGFEEYVDPLKIYLHK YR | 82 |
| 2182 | Zea mays | G3866 | 30-126 | 3677 | REQDRFLPIANISRIMKKAIPAN GKTIPANGKIAKDAKETVQECV SEFISFITSEASDKCQREKRKTIN GDDLLWAMATLGFEDYIEPLK VYLQKYR | 81 |
| 1868 | Oryza sativa | G3398 | 21-110 | 3487 | REQDRFLPIANVSRIMKRALPA NAKISKDAKETVQECVSEFISFI TGEASDKCQREKRKTINGDDL LWAMTTLGFEDYIDPLKLYLH KFR | 81 |
| 1864 | Oryza sativa | G3396 | 21-110 | 3485 | KEQDRFLPIANIGRIMRRAVPE NGKIAKDSKESVQECVSEFISFI TSEASDKCLKEKRKTINGDDLI WSMGTLGFEDYVEPLKLYLRL YR | 77 |
| 1880 | Oryza sativa | G3429 | 40-124 | 3498 | ELPMANLVRLIKKVLPGKAKIG GAAKGLTHDCAVEFVGFVGDE ASEKAKAEHRRTVAPEDYLGS FGDLGFDRYVDPMDAYIHGYR | 42 |
| 2184 | Glycine max | G3873 | 29-118 | 3678 | REQDRFLPIANISRIMKKALPPN GKIAKDAKETVQECVSEFISFV TSEASDKCQREKRKTINGDDLL WAMTTLGFEEYIDPLKVYLAA YR | 86 |
| 2186 | Glycine max | G3874 | 25-114 | 3679 | REQDRYLPIANISRIMKKALPA NGKIAKDAKETVQECVSEFISFI TSEASDKCQREKRKTINGDDLL WAMATLGFEDYMDPLKIYLTR YR | 91 |
|  | Oryza sativa | G3938 | 57-146 |  | KEQDRFLPIANVSRIMKRSLPA NAKISKESKETVQECVSEFISF VTGESDKCQREKRKTINGDDL LWAMTLGFEAYVGPLKSYLN RYR | 76 |
|  | Physcomitrella patens | G3868 | 34-123 |  | REQDRFLPIANVSRIMKKALPS NAKISKDAKETVQECVSEFISFI TGESDKCQREKRKTINGDDLL WAMSLGFEDYVEPLKVYLHK YR | 84 |
|  | Physcomitrella patens | G3870 | 34-123 |  | REQDRFLPIANVSRIMKKALPS NAKISKDAKETVQECVSEFISFI TGEASDKCQREKRKTINGDDL LWAMSLGFEDYVEPLKVYLH KYR | 84 |

TABLE 3

Conserved domains of G928 (TF family: CCAAT-binding) and closely related HAP2 sequences

| SEQ ID NO: | Species from which SEQ ID NO: is derived | Gene ID (GID) | Conserved domain amino acid coordinates | Conserved domain SEQ ID NO: | Conserved domain | Percent ID of conserved domain to G928 conserved domain |
|---|---|---|---|---|---|---|
| 696 | Arabidopsis thaliana | G928 | 179-238 | 2790 | DPVFVNAKQYHAIMRRRQQR AKLEAQNKLIRARKPYLHESR HVHALKRPRGSGGRFLNTK | 100 |
| 700 | Arabidopsis thaliana | G931 | 172-231 | 2792 | fEPVFVNAKQFHAIMRRRQQR AKLEAQNKLIKARKPYLHESR HVHALKRPRGSGGRFLNTK | 95 |
| 2230 | Oryza sativa | G3926 | 164-222 | 3702 | EPIFVNAKQYNAILRRRQTRA KLEAQNKAVKGRKPYLHESR HHHAMKRARGSGGRFLTK | 78 |
| 2224 | Zea mays | G3921 | 148-207 | 3699 | EPIYVNAKQYHAILRRRQTRA KLEAQNKMVKGRKPYLHESR HRHAMKRARGSGGRFLNTK | 80 |
| 2326 | Zea mays | G4264 | 155-214 | 3750 | EPIYVNAKQYHAILRRRQTRA KLEAQNKMVKNRKPYLHESR HRHAMKRARGSGGRFLNTK | 80 |
| 2328 | Zea mays | G4265 | 149-208 | 3751 | EPIYVNAKQYHAILRRRQTRA KLEAQNKMVKGRKPYLHESR HRHAMKRARGSGGRFPHTK | 76 |
| 2334 | Zea mays | G4269 | 103-162 | 3754 | EPIYVNPKQYHGILRRRQLRA KLEAQNKLVRARKPYLHESRH LHAMKRARGSGGRFLNTK | 81 |

TABLE 4

Conserved domains of G1782 (TF family: CCAAT-binding) and closely related HAP2 sequences

| SEQ ID NO: | Species from which SEQ ID NO: is derived | Gene ID (GID) | Conserved domain amino acid coordinates | Conserved domain SEQ ID NO: | Conserved domain | Percent ID of conserved domain to G1782 conserved domain |
|---|---|---|---|---|---|---|
| 1162 | Arabidopsis thaliana | G1782 | 178-237 | 3060 | EPIFVNAKQYHAILRRRKHRA KLEAQNKLIKCRKPYLHESRH LHALKRARGSGGRFLNTK | 100 |
| 950 | Arabidopsis thaliana | G1363 | 171-230 | 2940 | EPIFVNAKQYQAILRRRERRA KLEAQNKLIKVRKPYLHESRH LHALKRVRGSGGRFLNTK | 91 |
| 2222 | Glycine max | G3920 | 149-208 | 3698 | EPVYVNAKQYHGILRRRQSRA KAEIEKKVIKNRKPYLHESRHL HAMRRARGNGGRFLNTK | 76 |
| 2228 | Oryza sativa | G3925 | 138-197 | 3701 | EPIYVNAKQYHAILRRRQLRA KLEAENKLVKNRKPYLHESRH QHAMKRARGTGGRFLNTK | 85 |
| 5116 | Zea mays | G3922 | 171-230 | 5117 | EPIYVNAKQYHAILRRRQTRA KLEAQNKMVKNRKPYLHESR HRHAMKRARGSGGRFLNTK | 86 |
| 2322 | Zea mays | G4262 | 142-201 | 3748 | EPIYVNAKQYHAILRRRQLRA KLEAENKLVKSRKPYLHESRH LHAMKRARGTGGRFLNTK | 86 |

TABLE 4-continued

Conserved domains of G1782 (TF family: CCAAT-binding) and closely related HAP2 sequences

| SEQ ID NO: | Species from which SEQ ID NO: is derived | Gene ID (GID) | Conserved domain amino acid coordinates | Conserved domain SEQ ID NO: | Conserved domain | Percent ID of conserved domain to G1782 conserved domain |
|---|---|---|---|---|---|---|
| 2324 | Zea mays | G4263 | 137-196 | 3749 | EPIYVNAKQYHAILRRRQLRA KLEAENKLVKSRKPYLHESRH LHAMKRARGTGGRFLNTK | 86 |
| 2336 | Zea mays | G4270 | 131-191 | 3755 | EAPIYVNAKQYDAIMRRRCAR AKAERENRLVKGRKPYLHESR HQHALRRPRGSGGRFLNTK | 76 |

TABLE 5

Conserved domains of G28 (TF family: AP2) and closely related AP2 sequences

| SEQ ID NO: | Species from which SEQ ID NO: is derived | Gene ID (GID) | Conserved AP2 domain amino acid coordinates | Conserved AP2 domain SEQ ID NO: | Conserved AP2 domain | Percent ID of conserved AP2 domain to G28 conserved AP2 domain |
|---|---|---|---|---|---|---|
| 2 | Arabidopsis thaliana | G28 | 144-208 | 2373 | KGKHYRGVRQRPWGKFAAEI RDPAKNGARVWLGTFETAED AALAYDRAAFRMRGSRALLN FPLRV | 100 |
| 2054 | Brassica oleracea | G3659 | 130-194 | 3594 | KGKHYRGVRQRPWGKFAAEI RDPAKNGARVWLGTFETAED AALAYDRAAFRMRGSRALLN FPLRV | 100 |
| 752 | Arabidopsis thaliana | G1006 | 113-177 | 2828 | KAKHYRGVRQRPWGKFAAEI RDPAKNGARVWLGTFETAED AALAYDIAAFRMRGSRALLNF PLRV | 98 |
| 2076 | Glycine max | G3717 | 130-194 | 3613 | KGKHYRGVRQRPWGKFAAEI RDPAKNGARVWLGTFETAED AALAYDRAAYRMRGSRALLN FPLRV | 98 |
| 2078 | Glycine max | G3718 | 139-203 | 3614 | KGKHYRGVRQRPWGKFAAEI RDPAKNGARVWLGTFETAED AALAYDRAAYRMRGSRALLN FPLRI | 96 |
| 2056 | Brassica oleracea | G3660 | 119-183 | 3595 | KGKHYRGVRQRPWGKFAAEI RDPAKKGAREWLGTFETAED AALAYDRAAFRMRGSRALLN FPLRV | 96 |
| 2168 | Oryza sativa | G3848 | 149-213 | 3670 | RGKHYRGVRQRPWGKFAAEI RDPAKNGARVWLGTFDTAED AALAYDRAAYRMRGSRALLN FPLRI | 95 |
| 2058 | Zea mays | G3661 | 126-190 | 3596 | RGKHYRGVRQRPWGKFAAEI RDPARNGARVWLGTYDTAED AALAYDRAAYRMRGSRALLN FPLRI | 92 |

TABLE 5-continued

Conserved domains of G28 (TF family: AP2) and closely related AP2 sequences

| SEQ ID NO: | Species from which SEQ ID NO: is derived | Gene ID (GID) | Conserved AP2 domain amino acid coordinates | Conserved AP2 domain SEQ ID NO: | Conserved AP2 domain | Percent ID of conserved AP2 domain to G28 conserved AP2 domain |
|---|---|---|---|---|---|---|
| 2178 | Triticum aestivum | G3864 | 127-191 | 3675 | RGKHFRGVRQRPWGKFAAEI RDPAKNGARVWLGTFDSAED AAVAYDRAAYRMRGSRALLN FPLRI | 90 |
| 2172 | Zea mays | G3856 | 140-204 | 3672 | RGKHYRGVRQRPWGKFAAEI RDPAKNGARVWLGTYDSAED AAVAYDRAAYRMRGSRALLN FPLRI | 90 |
| 4 | Oryza sativa | G3430 | 145-209 | 2374 | RGKHYRGVRQRPWGKFAAEI RDPAKNGARVWLGTFDSAEE AAVAYDRAAYRMRGSRALLN FPLRI | 90 |
| 2158 | Solanum lycopersicum | G3841 | 102-166 | 3665 | KGRHYRGVRQRPWGKFAAEI RDPAKNGARVWLGTYETAEE AAIAYDKAAYRMRGSKAHLN FPHRI | 84 |
| 56 | Arabidopsis thaliana | G22 | 88-152 | 2406 | KGMQYRGVRRRPWGKFAAEI RDPKKNGARVWLGTYETPED AAVAYDRAAFQLRGSKAKLN FPHLI | 81 |

TABLE 6

Conserved domains of G47 (TF family: AP2) and closely related AP2 sequences

| SEQ ID NO: | Species from which SEQ ID NO: is derived | Gene ID (GID) | Conserved AP2 domain amino acid coordinates | Conserved AP2 domain SEQ ID NO: | Conserved AP2 domain | Percent ID of conserved AP2 domain to G47 conserved AP2 domain |
|---|---|---|---|---|---|---|
| 6 | Arabidopsis thaliana | G47 | 10-75 | 2375 | SQSKYKGIRRRKWGKWVSEIR VPGTRDRLWLGSFSTAEGAAV AHDVAFFCLHQPDSLESLNFP HLL | 100 |
| 8 | Arabidopsis thaliana | G2133 | 10-77 | 2376 | DQSKYKGIRRRKWGKWVSEI RVPGTRQRLWLGSFSTAEGAA VAHDVAFYCLHRPSSLDDESF NFPHLL | 89 |
| 2046 | Oryza sativa | G3649 | 15-87 | 3590 | EMMRYRGVRRRWGKWVSE IRVPGTRERLWLGSYATAEAA AVAHDAAVCLLRLGGGRRAA AGGGGGLNFPARA | 79 |
| 2038 | Oryza sativa | G3644 | 52-122 | 3586 | ERCRYRGVRRRRWGKWVSEI RVPGTRERLWLGSYATPEAAA VAHDTAVYFLRGGAGDGGGG GATLNFPERA | 72 |
| 2036 | Glycine max | G3643 | 13-78 | 3585 | TNNKLKGVRRRKWGKWVSEI RVPGTQERLWLGTYATPEAA AVAHDVAVYCLSRPSSLDKLN FPETL | 68 |

TABLE 6-continued

Conserved domains of G47 (TF family: AP2) and closely related AP2 sequences

| SEQ ID NO: | Species from which SEQ ID NO: is derived | Gene ID (GID) | Conserved AP2 domain amino acid coordinates | Conserved AP2 domain SEQ ID NO: | Conserved AP2 domain | Percent ID of conserved AP2 domain to G47 conserved AP2 domain |
|---|---|---|---|---|---|---|
| 2048 | Zea mays | G3650 | 75-139 | 3591 | RRCRYGVRRRAWGKWVSEI RVPGTRERLWLGSYAAPEAA AVAHDAAACLLRGCAGRRLN FPGRA | 65 |

TABLE 7

Conserved domains of G1792 (TF family: AP2) and closely related AP2 sequences

| SEQ ID NO: | Species from which SEQ ID NO: is derived | Gene ID (GID) | Conserved AP2 and EDLL domain amino acid coordinates | Conserved AP2 and EDLL domain SEQ ID NO: | AP2 and EDLL conserved domains | Percent ID of conserved AP2 or EDLL domain to G1792 conserved AP2 or EDLL domain, respectively |
|---|---|---|---|---|---|---|
| 24 | Arabidopsis thaliana | G1792 | AP2: 16-80 | 2386 | AP2: KQARFRGVRRRPWGKFAAEIR DPSRNGARLWLGTFETAEEAA RAYDRAAFNLRGHLAILNFPN EY | 100 |
|  |  |  | EDLL: 117-132 | 5128 | EDLL: VFEFEYLDDKVLEELL | 100 |
| 26 | Arabidopsis thaliana | G1795 | AP2: 11-75 | 2387 | AP2: EHGKYRGVRRRPWGKYAAEI RDSRKHGERVWLGTFDTAEE AARAYDQAAYSMRGQAAILN FPHEY | 69 |
|  |  |  | EDLL: 104-119 | 5129 | EDLL: VFEFEYLDDSVLEELL | 93 |
| 66 | Arabidopsis thaliana | G30 | AP2: 16-80 | 2411 | AP2: EQGKYRGVRRRPWGKYAAEI RDSRKHGERVWLGTFDTAED AARAYDRAAYSMRGKAAILN FPHEY | 70 |
|  |  |  | EDLL: 100-115 | 5130 | EDLL: VFEFEYLDDSVLDELL | 87 |
| 1850 | Oryza sativa | G3383 | AP2: 9-73 | 3475 | AP2: TATKYRGVRRRPWGKFAAEIR DPERGGARVWLGTFDTAEEA ARAYDRAAYAQRGAAAVLNF PAAA | 79 |
|  |  |  | EDLL: 101-116 | 5131 | EDLL: KIEFEYLDDKVLDDLL | 85 |
| 1172 | Arabidopsis thaliana | G1791 | AP2: 10-74 | 3064 | AP2: NEMKYRGVRKRPWGKYAAEI RDSARHGARVWLGTFNTAED AARAYDRAAFGMRGQRAILN FPHEY | 73 |
|  |  |  | EDLL: 108-123 | 5132 | EDLL: VIEFEYLDDSLLEELL | 81 |

TABLE 7-continued

Conserved domains of G1792 (TF family: AP2) and closely related AP2 sequences

| SEQ ID NO: | Species from which SEQ ID NO: is derived | Gene ID (GID) | Conserved AP2 and EDLL domain amino acid coordinates | Conserved AP2 and EDLL domain SEQ ID NO: | AP2 and EDLL conserved domains | Percent ID of conserved AP2 or EDLL domain to G1792 conserved AP2 or EDLL domain, respectively |
|---|---|---|---|---|---|---|
| 1984 | Glycine max | G3519 | AP2: 13-77 | 3558 | AP2: CEVRYRGIRRRPWGKFAAEIR DPTRKGTRIWLGTFDTAEQAA RAYDAAAFHFRGHRAILNFPN EY | 78 |
| | | | EDLL: 128-143 | 5133 | EDLL: TFELEYLDNKLLEELL | 80 |
| 1848 | Oryza sativa | G3381 | AP2: 14-78 | 3474 | AP2: LVAKYRGVRRRPWGKFAAEI RDSSRHGVRVWLGTFDTAEE AARAYDRSAYSMRGANAVLN FPADA | 76 |
| | | | EDLL: 109-124 | 5134 | EDLL: PIEFEYLDDHVLQEML | 78 |
| 2104 | Oryza sativa | G3737 | AP2: 8-72 | 3627 | AP2: AASKYRGVRRRPWGKFAAEI RDPERGGSRVWLGTFDTAEEA ARAYDRAAFAMKGAMAVLN FPGRT | 76 |
| | | | EDLL: 101-116 | 5135 | EDLL: KVELVYLDDKVLDELL | 78 |
| 1976 | Oryza sativa | G3515 | AP2: 11-75 | 3554 | AP2: SSSSYRGVRKRPWGKFAAEIR DPERGGARVWLGTFDTAEEA ARAYDRAAFAMKGATAMLN FPGDH | 75 |
| | | | EDLL: 116-131 | 5136 | EDLL: KVELECLDDKVLEDLL | 78 |
| 1978 | Zea mays | G3516 | AP2: 6-70 | 3555 | AP2: KEGKYRGVRKRPWGKFAAEI RDPERGGSRVWLGTFDTAEEA ARAYDRAAFAMKGATAVLNF PASG | 74 |
| | | | EDLL: 107-122 | 5137 | EDLL: KVELECLDDRVLEELL | 78 |
| 1986 | Glycine max | G3520 | AP2: 14-78 | 3559 | AP2: EEPRYRGVRRRPWGKFAAEIR DPARHGARVWLGTFLTAEEA ARAYDRAAYEMRGALAVLNF PNEY | 80 |
| | | | EDLL: 109-124 | 5138 | EDLL: VIEFECLDDKLLEDLL | 75 |
| 1980 | Zea mays | G3517 | AP2: 13-77 | 3556 | AP2: EPTKYRGVRRRPWGKYAAEIR DSSRHGVRIWLGTFDTAEEAA RAYDRSANSMRGANAVLNFP EDA | 72 |
| | | | EDLL: 103-118 | 5139 | EDLL: VIEFEYLDDEVLQEML | 75 |

TABLE 7-continued

Conserved domains of G1792 (TF family: AP2) and closely related AP2 sequences

| SEQ ID NO: | Species from which SEQ ID NO: is derived | Gene ID (GID) | Conserved AP2 and EDLL domain amino acid coordinates | Conserved AP2 and EDLL domain SEQ ID NO: | AP2 and EDLL conserved domains | Percent ID of conserved AP2 or EDLL domain to G1792 conserved AP2 or EDLL domain, respectively |
|---|---|---|---|---|---|---|
| 1982 | Glycine max | G3518 | AP2: 13-77 | 3557 | AP2: VEVRYRGIRRRPWGKFAAEIR DPTRKGTRIWLGTFDTAEQAA RAYDAAAFHFRGHRAILNFPN EY | 78 |
|  |  |  | EDLL: 135-150 | 5140 | EDLL: TFELEYFDNKLLEELL | 73 |
| 2106 | Zea mays | G3739 | AP2: 13-77 | 3628 | AP2: EPTKYRGVRRRPWGKYAAEIR DSSRHGVRIWLGTFDTAEEAA RAYDRSAYSMRGANAVLNFP EDA | 72 |
|  |  |  | EDLL: 107-122 | 5141 | EDLL: VIELEYLDDEVLQEML | 68 |
| 1846 | Oryza sativa | G3380 | AP2: 18-82 | 3473 | AP2: ETTKYRGVRRRPSGKFAAEIR DSSRQSVRVWLGTFDTAEEAA RAYDRAAYAMRGHLAVLNFP AEA | 77 |
|  |  |  | EDLL: 103-118 | 5142 | EDLL: VIELECLDDQVLQEML | 62 |
| 2132 | Zea mays | G3794 | AP2: 6-70 | 3641 | AP2: EPTKYRGVRRRPSGKFAAEIR DSSRQSVRMWLGTFDTAEEA ARAYDRAAYAMRGQIAVLNF PAEA | 73 |
|  |  |  | EDLL: 102-117 | 5143 | EDLL: VIELECLDDQVLQEML | 62 |

TABLE 8

Conserved domains of G913 (TF family: AP2) and closely related AP2 sequences

| SEQ ID NO: | Species from which SEQ ID NO: is derived | Gene ID (GID) | Conserved AP2 domain amino acid coordinates | Conserved AP2 domain SEQ ID NO: | Conserved AP2 domain | Percent ID of conserved AP2 domain to G913 conserved AP2 domain |
|---|---|---|---|---|---|---|
|  | Arabidopsis thaliana | G913 | 62-128 | 2781 | HSIFRGIRLRNGKWVSEIRE PRKTTRIWLGTYPVPEMA AAAYDVAALALKGPDAVL NFPGLALTYVA | 100 |
|  | Arabidopsis thaliana | G2514 | 16-82 | 3277 | DPVYRGIRCRSGKWVSEIR EPRKTTRIWLGTYPMAEM AAAAYDVAAMALKGREA VLNFPGSVGSYPV | 84 |
|  | Arabidopsis thaliana | G976 | 87-153 | 2806 | NPVYRGIRCRSGKWVSEIR EPKKTTRVWLGTYPTPEM AAAAYDVAALALKGGDT LLNFPDSLGSYPI | 82 |

TABLE 8-continued

Conserved domains of G913 (TF family: AP2) and closely related AP2 sequences

| SEQ ID NO: | Species from which SEQ ID NO: is derived | Gene ID (GID) | Conserved AP2 domain amino acid coordinates | Conserved AP2 domain SEQ ID NO: | Conserved AP2 domain | Percent ID of conserved AP2 domain to G913 conserved AP2 domain |
|---|---|---|---|---|---|---|
| | Arabidopsis thaliana | G1753 | 12-80 | 3046 | HPLYRGVRQRKNSNKWVS EIREPRKPNRIWLGTFSTPE MAAIAYDVAALALKGSQA ELNFPNSVSSLPA | 70 |

TABLE 9

Conserved domains of G1073 (TF family: AT-hook) and closely related AT-hook sequences

| SEQ ID NO: | Species from which SEQ ID NO: is derived | Gene ID (GID) | Conserved AT-hook and 2nd conserved domain amino acid coordinates | AT-hook and 2nd conserved domain SEQ ID NO: | AT-hook and 2nd conserved domains | Percent ID of conserved AT-hook or 2nd domain to G1073 AT-hook or 2nd conserved domains, respectively |
|---|---|---|---|---|---|---|
| 18 | Arabidopsis thaliana | G1073 | AT-hook: 63-71 | 2382 | AT-hook: RRPRGRPAG | 100 |
| | | | 2nd domain: 71-216 | 2383 | 2nd conserved domain: GSKNKPKPPTIITRDSPNVLRS HVLEVTSGSDISEAVSTYATR RGCGVCIISGTGAVTNVTIRQ PAAPAGGGVITLHGRFDILSL TGTALPPPAPPGAGGLTVYLA GGQGQVVGGNVAGSLIASGP VVLMAASFANAVYDRLPIEE | 100 |
| 5145 | Oryza sativa | G3406 | AT-hook: 82-90 | 5146 | AT-hook: RRPRGRPPG | 100 |
| | | | 2nd domain: 90-232 | 5147 | 2nd conserved domain: GSKNKPKPPVIITRESANTLRA HILEVGSGCDVFECVSTYARR RQRGVCVLSGSGVVTNVTLR QPSAPAGAVVSLHGRFEILSL SGSFLPPPAPPGATSLTIFLAG GQGQVVGGNVVGALYAAGP VIVIAASFANVAYERLPL | 70 |
| 1870 | Oryza sativa | G3399 | AT-hook: 99-107 | 3488 | AT-hook: RRPRGRPPG | 100 |
| | | | 2nd domain: 107-253 | 3489 | 2nd conserved domain: GSKNKPKPPIIVTRDSPNALHS HVLEVAGGADVVDCVAEYA RRRGRGVCVLSGGGAVVNV ALRQPGASPPGSMVATLRGR FEILSLTGTVLPPPAPPGASGL TVFLSGGQGQVIGGSVVGPL VAAGPVVLMAASFANAVYE RLPLEG | 71 |
| 798 | Arabidopsis thaliana | G1067 | AT-hook: 86-94 | 2852 | AT-hook: KRPRGRPPG | 85 |
| | | | 2nd domain: | 2853 | 2nd conserved domain: GSKNKAKPPIIVTRDSPNALR | 71 |

TABLE 9-continued

Conserved domains of G1073 (TF family: AT-hook) and closely related AT-hook sequences

| SEQ ID NO: | Species from which SEQ ID NO: is derived | Gene ID (GID) | Conserved AT-hook and 2nd conserved domain amino acid coordinates | AT-hook and 2nd conserved domain SEQ ID NO: | AT-hook and 2nd conserved domains | Percent ID of conserved AT-hook or 2nd domain to G1073 AT-hook or 2nd conserved domains, respectively |
|---|---|---|---|---|---|---|
| | | | 94-247 | | SHVLEVSPGADIVESVSTYAR RRGRGVSVLGGNGTVSNVTL RQPVTPGNGGGVSGGGGVVT LHGRFEILSLTGTVLPPPAPPG AGGLSIFLAGGQGQVVGGSV VAPLIASAPVILMAASFSNAV FERLPIEE | |
| 1918 | Glycine max | G3459 | AT-hook: 77-85 | 3523 | AT-hook: RRPRGRPPG | 100 |
| | | | 2nd domain: 85-228 | 3524 | 2nd conserved domain: GSKNKPKPPVIITRESANTLRA HILEVGSGSDVFDCVTAYAR RRQRGICVLSGSGTVTNVSLR QPAAAGAVVTLHGRFEILSLS GSFLPPPAPPGATSLTIYLAGG QGQVVGGNVIGELTAAGPVI VIAASFTNVAYERLPLEE | 67 |
| 1872 | Oryza sativa | G3400 | AT-hook: 83-91 | 3490 | AT-hook: RRPRGRPLG | 100 |
| | | | 2nd domain: 91-237 | 3491 | 2nd conserved domain: GSKNKPKPPIIVTRDSPNAFHS HVLEVAAGTDIVECVCEFAR RRGRGVSVLSGGGAVANVAL RQPGASPPGSLVATMRGQFEI LSLTGTVLPPPAPPSASGLTVF LSGGQGQVVGGSVAGQLIAA GPVFLMAASFANAVYERLPL DG | 69 |
| 1694 | Arabidopsis thaliana | G2789 | AT-hook: 59-67 | 3364 | AT-hook: RRPRGRPAG | 100 |
| | | | 2nd domain: 67-208 | 3365 | 2nd conserved domain: GSKNKPKAPIIVTRDSANAFR CHVMEITNACDVMESLAVFA RRRQRGVCVLTGNGAVTNVT VRQPGGGVVSLHGRFEILSLS GSFLPPPAPPAASGLKVYLAG GQGQVIGGSVVGPLTASSPVV VMAASFGNASYERLPLEE | 65 |
| 1920 | Glycine max | G3460 | AT-hook: 74-82 | 3525 | AT-hook: RRPRGRPSG | 100 |
| | | | 2nd domain: 82-225 | 3526 | 2nd conserved domain: GSKNKPKPPVIITRESANTLRA HILEVGSGSDVFDCVTAYAR RRQRGICVLSGSGTVTNVSLR QPAAAGAVVRLHGRFEILSLS GSFLPPPAPPGATSLTIYLAGG QGQVVGGNVVGELTAAGPVI VIAASFTNVAYERLPLEE | 67 |
| 1116 | Arabidopsis thaliana | G1667 | AT-hook: 53-61 | 3035 | AT-hook: KRPRGRPAG | 85 |
| | | | 2nd domain: 61-204 | 5148 | 2nd conserved domain: GSKNKPKPPIIVTHDSPNSLRA NAVEISSGCDICETLSDFARR KQRGLCILSANGCVTNVTLR | 65 |

TABLE 9-continued

Conserved domains of G1073 (TF family: AT-hook) and closely related AT-hook sequences

| SEQ ID NO: | Species from which SEQ ID NO: is derived | Gene ID (GID) | Conserved AT-hook and 2nd conserved domain amino acid coordinates | AT-hook and 2nd conserved domain SEQ ID NO: | AT-hook and 2nd conserved domains | Percent ID of conserved AT-hook or 2nd domain to G1073 AT-hook or 2nd conserved domains, respectively |
|---|---|---|---|---|---|---|
| | | | | | QPASSGAIVTLHGRYEILSLLG SILPPPAPLGITGLTIYLAGPQ GQVVGGGVVGGLIASGPVVL MAASFMNAVFDRLPMDD | |
| 1424 | Arabidopsis thaliana | G2156 | AT-hook: 72-80 | 3205 | AT-hook: KRPRGRPPG | 85 |
| | | | 2nd domain: 80-232 | 3206 | 2nd conserved domain: GSKNKPKPPVIVTRDSPNVLR SHVLEVSSGADIVESVTTYAR RRGRGVSILSGNGTVANVSLR QPATTAAHGANGGTGGVVA LHGRFEILSLTGTVLPPPAPPG SGGLSIFLSGVQGQVIGGNVV APLVASGPVILMAASFSNATF ERLPLED | 68 |
| 1916 | Glycine max | G3456 | AT-hook: 44-52 | 3521 | AT-hook: RRPRGRPPG | 100 |
| | | | 2nd domain: 52-195 | 3522 | 2nd conserved domain: GSRNKPKPPIFVTRDSPNALR SHVMEIAVGADIADCVAQFA RRRQRGVSILSGSGTVVNVNL RQPTAPGAVMALHGRFDILSL TGSFLPGPSPPGATGLTIYLAG GQGQIVGGGVVGPLVAAGPV LVMAATFSNATYERLPLED | 64 |
| 1876 | Oryza sativa | G3407 | AT-hook: 63-71 | 3494 | AT-hook: RRPRGRPPG | 100 |
| | | | 2nd domain: 71-220 | 3495 | 2nd conserved domain: GSKNKPKPPVIITRESANALR AHILEVAAGCDVFEALTAYA RRRQRGVCVLSAAGTVANVT LRQPQSAQPGPASPAVATLH GRFEILSLAGSFLPPPAPPGAT SLAAFLAGGQGQVVGGSVAG ALIAAGPVVVVAASFSNVAY ERLPLED | 64 |
| 1874 | Oryza sativa | G3401 | AT-hook: 35-43 | 3492 | AT-hook: RRPRGRPPG | 100 |
| | | | 2nd domain: 43-186 | 3493 | 2nd conserved domain: GSKNKPKPPIFVTRDSPNALR SHVMEVAGGADVAESIAHFA RRRQRGVCVLSGAGTVTDVA LRQPAAPSAVVALRGRFEILS LTGTFLPGPAPPGSTGLTVYL AGGQGQVVGGSVVGTLTAA GPVMVIASTFANATYERLPLD Q | 64 |
| 1420 | Arabidopsis thaliana | G2153 | AT-hook: 80-88 | 3202 | AT-hook: RRPRGRPAG | 100 |
| | | | 2nd domain: 88-239 | 3203 | 2nd conserved domain: GSKNKPKPPIFVTRDSPNALK SHVMEIASGTDVIETLATFAR RRQRGICILSGNGTVANVTLR QPSTAAVAAAPGGAAVLALQ | 63 |

TABLE 9-continued

Conserved domains of G1073 (TF family: AT-hook) and closely related AT-hook sequences

| SEQ ID NO: | Species from which SEQ ID NO: is derived | Gene ID (GID) | Conserved AT-hook and 2nd conserved domain amino acid coordinates | AT-hook and 2nd conserved domain SEQ ID NO: | AT-hook and 2nd conserved domains | Percent ID of conserved AT-hook or 2nd domain to G1073 AT-hook or 2nd conserved domains, respectively |
|---|---|---|---|---|---|---|
| | | | | | GRFEILSLTGSFLPGPAPPGST GLTIYLAGGQGQVVGGSVVG PLMAAGPVMLIAATFSNATY ERLPLEE | |
| 802 | Arabidopsis thaliana | G1069 | AT-hook: 67-75 | 2855 | AT-hook: RRPRGRPPG | 100 |
| | | | 2nd domain: 75-218 | 5149 | 2nd conserved domain: GSKNKPKAPIFVTRDSPNALR SHVLEISDGSDVADTIAHFSR RRQRGVCVLSGTGSVANVTL RQAAAPGGVVSLQGRFEILSL TGAFLPGPSPPGSTGLTVYLA GVQGQVVGGSVVGPLLAIGS VMVIAATFSNATYERLPMEE | 63 |
| 2034 | Oryza sativa | G3556 | AT-hook: 45-53 | 3583 | AT-hook: RRPRGRPPG | 100 |
| | | | 2nd domain: 53-196 | 3584 | 2nd conserved domain: GSKNKPKPPVVVTRESPNAM RSHVLEIASGADIVEAIAGFSR RRQRGVSVLSGSGAVTNVTL RQPAGTGAAAVALRGRFEILS MSGAFLPAPAPPGATGLAVY LAGGQGQVVGGSVMGELIAS GPVMVIAATFGNATYERLPL D | 64 |
| 1426 | Arabidopsis thaliana | G2157 | AT-hook: 88-96 | 3207 | AT-hook: RRPRGRPPG | 100 |
| | | | 2nd domain: 96-240 | 3208 | 2nd conserved domain: GSKNKPKSPVVVTKESPNSLQ SHVLEIATGADVAESLNAFAR RRGRGVSVLSGSGLVTNVTL RQPAASGVVSLRGQFEILSM CGAFLPTSGSPAAAAGLTIYL AGAQGQVVGGGVAGPLIASG PVIVIAATFCNATYERLPIEE | 61 |
| 1878 | Oryza sativa | G3408 | AT-hook: 82-90 | 3496 | AT-hook: KKRRGRPPG | 57 |
| | | | 2nd domain: 90-247 | 3497 | 2nd conserved domain: GSKNKPKPPVVITREAEPAAA MRPHVIEIPGGRDVAEALARF SSRRNLGICVLAGTGAVANV SLRHPSPGVPGSAPAAIVFHG RYEILSLSATFLPPAMSSVAPQ AAVAAAGLSISLAGPHGQIVG GAVAGPLYAATTVVVVAAA FTNPTFHRLPADD | 45 |
| | Oryza sativa | G3403 | AT hook: 58-66 | | AT hook RRPRGRPPG | 88 |
| | | | 2nd domain: 66-209 | | 2nd conserved domain: GSKNKPKPPIFVTRDSPNALR SHVMEVAGGADVADAIAQFS RRRQRGVCVLSGAGTVANV ALRQPSAPGAVVALHGRFEIL SLTGTFLPGPAPPGSTGLTVY | 67 |

TABLE 9-continued

Conserved domains of G1073 (TF family: AT-hook) and closely related AT-hook sequences

| SEQ ID NO: | Species from which SEQ ID NO: is derived | Gene ID (GID) | Conserved AT-hook and 2nd conserved domain amino acid coordinates | AT-hook and 2nd conserved domain SEQ ID NO: | AT-hook and 2nd conserved domains | Percent ID of conserved AT-hook or 2nd domain to G1073 AT-hook or 2nd conserved domains, respectively |
|---|---|---|---|---|---|---|
| | | | | | LAGGQGQVVGGSVVGSLIAA GPVMVIASTFANATYERLPLE E | |
| | Glycine max | G3462 | | 82-90 | AT hook RRPRGRPAG | 100 |
| | | | 17882 | 90-233 | 2nd conserved domain: GSKNKPKPPIVIIFLSPNALRS HVLEIASGRDVAESIAAFANR RHRGVSVLSGSGIVANVTLR QPAAPAGVITLHGRFEILSLSG AFLPSPSPSGATGLTVYLAGG QGQVVGGNVAGSLVASGPV MVIAATFANATYERLPLED | 69 |
| | Glycine max | G3932 | | 41-49 | AT hook RRPRGRPPG | 88 |
| | | | | 49-192 | 2nd conserved domain: GSKNKPKPPIFVTRDSPNSLRS HVMEVAGGADVAESVAQFA RRRQRGVCVLSGSGSVANVT LRQPSAPGAVVALHGRFEILS LTGAFLPGPAPPGATGLTVYL AGGQGQVVGGSVVGSLVAA GPVMVIAATFANATYERLPLE E | 69 |

TABLE 10

Conserved domains of G1274 (TF family: WRKY) and closely related WRKY sequences

| SEQ ID NO: | Species from which SEQ ID NO: is derived | Gene ID (GID) | Conserved WRKY domain amino acid coordinates | Conserved WRKY domain SEQ ID NO: | Conserved WRKY domain | Percent ID of conserved WRKY domain to G1274 conserved WRKY domain |
|---|---|---|---|---|---|---|
| 20 | Arabidopsis thaliana | G1274 | 110-166 | 2384 | DDGFKWRKYGKKSVKNNI NKRNYYKCSSEGCSVKKR VERDGDDAAYVITTYEGVH NH | 100 |
| 2090 | Glycine max | G3724 | 107-163 | 3620 | DDGYKWRKYGKKSVKSSP NLRNYYKCSSGGCSVKKR VERDRDDYSYVITTYEGVH NH | 84 |
| 2098 | Zea mays | G3728 | 108-164 | 3624 | DDGFKWRKYGKKAVKNSP NPRNYYRCSSEGCGVKKRV ERDRDDPRYVITTYDGVHN H | 82 |

TABLE 10-continued

Conserved domains of G1274 (TF family: WRKY) and closely related WRKY sequences

| SEQ ID NO: | Species from which SEQ ID NO: is derived | Gene ID (GID) | Conserved WRKY domain amino acid coordinates | Conserved WRKY domain SEQ ID NO: | Conserved WRKY domain | Percent ID of conserved WRKY domain to G1274 conserved WRKY domain |
|---|---|---|---|---|---|---|
| 2136 | Zea mays | G3804 | 108-164 | 3643 | DDGFKWRKYGKKAVKNSP NPRNYYRCSSEGCGVKKRV ERDRDDPRYVITTYDGVHN H | 82 |
| 2134 | Glycine max | G3803 | 111-167 | 3642 | DDGYKWRKYGKKTVKNN PNPRNYYKCSGEGCNVKK RVERDRDDSNYVLTTYDG VHNH | 80 |
| 2096 | Zea mays | G3727 | 102-158 | 3623 | DDGFKWRKYGKKAVKSSP NPRNYYRCSSEGCGVKKRV ERDRDDPRYVITTYDGVHN H | 80 |
| 2084 | Oryza sativa | G3721 | 96-152 | 3617 | DDGFKWRKYGKKAVKNSP NPRNYYRCSTEGCNVKKR VERDREDHRYVITTYDGVH NH | 78 |
| 2086 | Zea mays | G3722 | 129-185 | 3618 | DDGYKWRKYGKKSVKNSP NPRNYYRCSTEGCNVKKR VERDRDDPRYVVTMYEGV HNH | 78 |
| 2094 | Oryza sativa | G3726 | 135-191 | 3622 | DDGYKWRKYGKKSVKNSP NPRNYYRCSTEGCNVKKR VERDKDDPSYVVTTYEGTH NH | 78 |
| 2082 | Zea mays | G3720 | 135-191 | 3616 | DDGYKWRKYGKKSVKNSP NPRNYYRCSTEGCNVKKR VERDKDDPSYVVTTYEGM HNH | 78 |
| 2088 | Glycine max | G3723 | 112-168 | 3619 | DDGYKWRKYGKKTVKSSP NPRNYYKCSGEGCDVKKR VERDRDDSNYVLTTYDGV HNH | 77 |
| 2080 | Arabidopsis thaliana | G1275 | 113-169 | 2908 | DDGFKWRKYGKKMVKNSP HPRNYYKCSVDGCPVKKR VERDRDDPSFVITTYEGSHN H | 77 |
| 2102 | Oryza sativa | G3730 | 107-163 | 3626 | DDGFKWRKYGKKAVKSSP NPRNYYRCSAAGCGVKKR VERDGDDPRYVVTTYDGV HNH | 77 |
| 2080 | Zea mays | G3719 | 98-154 | 3615 | DDGFKWRKYGKKTVKSSP NPRNYYRCSAEGCGVKKR VERDSDDPRYVVTTYDGV HNH | 77 |
| 2092 | Oryza sativa | G3725 | 158-214 | 3621 | DDGYKWRKYGKKSVKNSP NPRNYYRCSTEGCNVKKR VERDKNDPRYVVTMYEGI HNH | 75 |
| 2100 | Oryza sativa | G3729 | 137-193 | 3625 | DDGYRWRKYGKKMVKNS PNPRNYYRCSSEGCRVKKR VERARDDARFVVTTYDGV HNH | 75 |

TABLE 11

Conserved domains of G1988 (TF family: Z-CONSTANS-like) and closely related Z-CO-like sequences

| SEQ ID NO: | Species from which SEQ ID NO: is derived | Gene ID (GID) | Conserved B-box domain amino acid coordinates | Conserved B-box domain SEQ ID NO: | Conserved B-box domain | Percent ID of conserved B-box domain to G1988 conserved B-box domain |
|---|---|---|---|---|---|---|
| 30 | Arabidopsis thaliana | G1988 | 5-50 | 2389 | CELCGAEADLHCAADSAFLCRS CDAKFHASNFLFARHFRRVICP NC | 100 |
| 2348 | Zea mays | G4297 | 14-55 | 3761 | CELCGGAAAVHCAADSAFLCP RCDAKVHGANFLASRHVRRRL | 70 |
| 2262 | Oryza sativa | G4012 | 15-56 | 3718 | CELCGGVAAVHCAADSAFLCL VCDDKVHGANFLASRHRRRRL | 67 |
| 2350 | Oryza sativa | G4298 | 15-56 | 3762 | CELCGGVAAVHCAADSAFLCL VCDDKVHGANFLASRHPRRRW | 67 |
| 2250 | Zea mays | G4000 | 20-61 | 3712 | CELCGGAAAVHCAADSAFLCL RCDAKVHGANFLASRHVRRRL | 70 |
| 2260 | Oryza sativa | G4011 | 8-49 | 3717 | CALCGAAAAVHCEADAAFLCA ACDAKVHGANFLASRHHRRRV | 65 |
| 2254 | Glycine max | G4005 | 6-51 | 3714 | CELCDQQASLYCPSDSAFLCSD CDAAVHAANFLVARHLRRLLC SKC | 60 |
| 2252 | Glycine max | G4004 | 6-51 | 3713 | CELCHQLASLYCPSDSAFLCFH CDAAVHAANFLVARHLRRLLC SKC | 60 |
| 2256 | Citrus sinensis | G4007 | 5-50 | 3715 | CELCSQEAALHCASDEAFLCFD CDDRVHKANFLVARHVRQTLC SQC | 58 |
| 2352 | Solanum lycopersicum | G4299 | 9-54 | 3763 | CELCNDQAALFCPSDSAFLCFH CDAKVHQANFLVARHLRLTLC SHC | 58 |
| 2258 | Populus trichocarpa | G4009 | 6-51 | 3716 | CELCKGEAGVYCDSDAAYLCF DCDSNVHNANFLVARHIRRVIC SGC | 56 |

TABLE 12

Conserved domains of G1760 (TF family: MADS) and closely related MADS box sequences

| SEQ ID NO: | Species from which SEQ ID NO: is derived | Gene ID (GID) | Conserved MADS DNA binding domain amino acid coordinates | Conserved MADS DNA binding domain SEQ ID NO: | Conserved MADS DNA binding domain | Percent ID of conserved MADS DNA binding domain to G1760 conserved MADS DNA binding domain |
|---|---|---|---|---|---|---|
| 22 | Arabidopsis thaliana | G1760 | 2-57 | 2385 | GRGKIVIQRIDDSTSRQV TFSKRRKGLIKKAKELA ILCDAEVGLIIFSSTGKL YDF | 100 |

TABLE 12-continued

Conserved domains of G1760 (TF family: MADS) and closely related MADS box sequences

| SEQ ID NO: | Species from which SEQ ID NO: is derived | Gene ID (GID) | Conserved MADS DNA binding domain amino acid coordinates | Conserved MADS DNA binding domain SEQ ID NO: | Conserved MADS DNA binding domain | Percent ID of conserved MADS DNA binding domain to G1760 conserved MADS DNA binding domain |
|---|---|---|---|---|---|---|
| 110 | Arabidopsis thaliana | G152 | 2-57 | 2433 | GRGKIVIQKIDDSTSRQV TFSKRRKGLIKKAKELA ILCDAEVCLIIFSNTDKL YDF | 92 |
| 5162 | Antirrhinum majus | G3982 | 2-57 | 5163 | GRGKIVIQRIDKSTSRQV TFSKRRSGLLKKAKELA ILCDAEVGVVIFSSTGKL YEF | 89 |
| 1950 | Glycine max | G3485 | 2-57 | 3541 | GRGKIVIRRIDNSTSRQV TFSKRRNGLLKKAKELA ILCDAEVGVMIFSSTGK LYDF | 89 |
| 2246 | Glycine max | G3980 | 2-57 | 3710 | GRGKIVIRRIDNSTSRQV TFSKRRNGLLKKAKELA ILCDAEVGVMIFSSTGK LYDF | 89 |
| 2248 | Glycine max | G3981 | 2-57 | 3711 | GRGKIVIRRIDNSTSRQV TFSKRRNGLLKKAKELA ILCDAEVGVMIFSSTGK LYDF | 89 |
| 112 | Arabidopsis thaliana | G153 | 2-57 | 2434 | GRGKIVIRRIDNSTSRQV TFSKRRSGLLKKAKELSI LCDAEVGVIIFSSTGKLY DY | 87 |
| 640 | Arabidopsis thaliana | G860 | 2-57 | 2756 | GRGKIAIKRINNSTSRQV TFSKRRNGLLKKAKELA ILCDAEVGVIIFSSTGRL YDF | 85 |
| 1938 | Oryza sativa | G3479 | 2-57 | 3535 | GRGKIVIRRIDNSTSRQV TFSKRRNGIFKKAKELAI LCDAEVGLVIFSSTGRL YEY | 83 |
| 1940 | Oryza sativa | G3480 | 2-57 | 3536 | GRGKIVIRRIDNSTSRQV TFSKRRNGIFKKAKELAI LCDAEVGLMIFSSTGRL YEY | 83 |
| 1942 | Oryza sativa | G3481 | 2-57 | 3537 | GRGKIVIRRIDNSTSRQV TFSKRRNGLLKKAKELS ILCDAEVGLVVFSSTGR LYEF | 83 |
| 1956 | Zea mays | G3489 | 2-57 | 3544 | GRGKIVIRRIDNSTSRQV TFSKRRNGIFKKAKELAI LCDAEVGLVIFSSTGRL YEY | 83 |
| 1948 | Glycine max | G3484 | 2-57 | 3540 | GRGKIAIRRIDNSTSRQV TFSKRRNGLLKKARELS ILCDAEVGLMVFSSTGK LYDY | 82 |
| 1952 | Zea mays | G3487 | 2-57 | 3542 | GRGKIEIKRIDNATSRQV TFSKRRGGLFKKAKELA ILCDAEVGLVVFSSTGR LYHF | 82 |

TABLE 12-continued

Conserved domains of G1760 (TF family: MADS) and closely related MADS box sequences

| SEQ ID NO: | Species from which SEQ ID NO: is derived | Gene ID (GID) | Conserved MADS DNA binding domain amino acid coordinates | Conserved MADS DNA binding domain SEQ ID NO: | Conserved MADS DNA binding domain | Percent ID of conserved MADS DNA binding domain to G1760 conserved MADS DNA binding domain |
|---|---|---|---|---|---|---|
| 1954 | Zea mays | G3488 | 2-57 | 3543 | GRGKIVIRRIDNSTSRQV TFSKRRNGIFKKARELAI LCDAEVGLVIFSSTGRL YEY | 82 |
| 1946 | Oryza sativa | G3483 | 2-57 | 3539 | GRGKIEIKRIDNATSRQV TFSKRRSGLFKKARELSI LCDAEVGLLVFSSTSRL YDF | 78 |

TABLE 13

Conserved domains of G1543 (Family: Homeobox; HD-ZIP proteins) and closely related sequences

| SEQ ID NO: | Species from which SEQ ID NO: is derived | Gene ID (GID) | Conserved HB domain amino acid coordinates | Conserved HB domain SEQ ID NO: | Conserved homeodomain and HALZ domain | Percent ID of conserved HB domain to G1543 homeo and HALZ domains |
|---|---|---|---|---|---|---|
| 1062 | Arabidopsis thaliana | G1543 | 135-195 | 3004 | Homeodomain: APPRKKLRLTREQSRLL EDSFRQNHTLNPKQKEV LAKHLMLRPRQIEVWF QNRRARSKLKQ | 100 |
|  |  |  | 194-237 | 17824 | HALZ: KQTEMECEYLKRWFGS LTEENHRLHREVEELRA IKVGPTTVNSA | 100 |
| 1988 | Glycine max | G3524 | 61-121 | 3560 | Homeodomain: GEPPRKKLRLTKEQSRL LEESFRQNHTLNPKQKE SLAMQLKLRPRQVEVW FQNRRARSKLKQ | 88 |
|  |  |  | 120-162 | 17825 | HALZ: KQTEMECEYLKRWFGS LTEQNRRLQREVEELRA IKVGPPTVIS | 88 |
| 1974 | Oryza sativa | G3510 | 74-134 | 3553 | Homeodomain: PHRPKKLRLSKEQSRLL EESFRLNHTLTPKQKEA LAIKLKLRPRQVEVWFQ NRRARTKLKQ | 75 |
|  |  |  | 133-175 | 17826 | HALZ: KQTEMECEYLKRCFGSL TEENRRLQREVEELRA MRVAPPTVLS | 81 |
| 17829 | Glycine max | G4371 | 61-121 | 17830 | Homeodomain: EPPRKKLRLTKEQSLLL EESFRQNHTLNPKQKES LAMQLKLRPRQVEVWF QNRRARSKLKQ | 86 |

TABLE 13-continued

Conserved domains of G1543 (Family: Homeobox; HD-ZIP proteins) and closely related sequences

| SEQ ID NO: | Species from which SEQ ID NO: is derived | Gene ID (GID) | Conserved HB domain amino acid coordinates | Conserved HB domain SEQ ID NO: | Conserved homeodomain and HALZ domain | Percent ID of conserved HB domain to G1543 homeo and HALZ domains |
|---|---|---|---|---|---|---|
| | | | 120-162 | 17831 | HALZ: KQTEMECEYLKRWFGS LTEQNRRLQREVEELRA IKVGPPTVIS | 88 |
| 1958 | Zea mays | G3490 | 60-120 | 3545 | Homeodomain: PHRAKKLRLSKEQSRLL EESFRLNHTLTPKQKEA LAVKLKLRPRQVEVWF QNRRARTKLKQ | 80 |
| | | | 119-161 | 17827 | HALZ: KQTELECEYLKRCFGSL TEENRRLQREVEELRA MRVAPPTVLS | 79 |
| 17833 | Zea mays | G4369 | 76-136 | 17834 | Homeodomain: PHRAKKLRLSKEQSRLL EESFRLNHTLTPKQKEA LAVKLKLRPRQVEVWF QNRRARTKLKQ | 80 |
| | | | 135-177 | 17835 | HALZ: KQTELECEYLKRCFGSL TEENRRLQREVEELRA MRVAPPTVLS | 79 |
| 17837 | Zea mays | G4370 | 75-135 | 17838 | Homeodomain: PHRPKKLRLSKEQSRLL EESFRLNHTLSPKQKEA LAIKLKLRPRQVEVWFQ NRRARTKLKH | 80 |
| | | | 134-176 | 17839 | HALZ: KHTEMECEYLKRCFGSL TEENRRLQREVEELRA MRMAPPTVLS | 76 |
| 17841 | Arabidopsis thaliana | G2712 | 65-125 | 17842 | Homeodomain: GRRRKKLRLTKEQSHLL EESFIQNHTLTPKQKKD LATFLKLSQRQVEVWF QNRRARSKLKH | 70 |
| | | | 124-163 | 17843 | HALZ: KHTEMECEYLKRWFGS LKEQNRRLQIEVEELRA LKPSSTS | 72 |

TABLE 14

Conserved domains of G142 (Family: MADS) and closely related sequences

| SEQ ID NO: | Species from which SEQ ID NO: is derived | Gene ID (GID) | Conserved MADS domain amino acid coordinates | Conserved MADS domain SEQ ID NO: | Conserved MADS domain | Percent ID of conserved AP2 DNA binding domain to G142 conserved AP2 domain |
|---|---|---|---|---|---|---|
| 98 | Arabidopsis thaliana | G142 | 2-57 | 2427 | GRGRVEMKRIENKINRQ VTFSKRRNGLLKKAYEL SVLCDAEVALIIFSSRGK LYEF | 100 |
| 17845 | Brassica oleracea | G5483 | 2-57 | 17846 | GRGRVEMKRIENKINRQ VTFSKRRNGLLKKAYEL SVLCDAEVALIVFSSRG KLYEF | 98 |
| 17848 | Brassica oleracea | G5484 | 2-57 | 17849 | GRGRVEMKRIENKINRQ VTFSKRRNGLLKKAYEL SVLCDAEVALIVFSSRG KLYEF | 98 |
| 17851 | Oryza sativa | G5475 | 2-57 | 17852 | GRGRVELKRIENKINRQ VTFSKRRNGLLKKAYEL SVLCDAEVALIIFSSRGK LYEF | 98 |
| 17854 | Oryza sativa | G5476 | 2-57 | 17855 | GRGRVELKRIENKINRQ VTFSKRRNGLLKKAYEL SVLCDAEVALIIFSSRGK LYEF | 98 |
| 17857 | Zea mays | G5470 | 2-57 | 17858 | GRGRVELKRIENKINRQ VTFSKRRNGLLKKAYEL SVLCDAEVALIIFSSRGK LYEF | 98 |
| 17863 | Triticum aestivum | G5472 | 2-57 | 17864 | GRGRVELKRIENKINRQ VTFSKRRNGLLKKAYEL SVLCDAEVALIIFSSRGK LYEF | 98 |
| 17860 | Zea mays | G5471 | 2-57 | 17861 | GRGRVELKRIENKINRQ VTFSKRRNGLLKKAYEL SVLCDAEVALIIFSGRGK LYEF | 96 |
| 106 | Arabidopsis thaliana | G148 | 1-57 | 2431 | MGRGKVEVKRIENKITR QVTFSKRKSGLLKKAYE LSVLCDAEVSLIIFSTGG KLYEF | 85 |
| 17897 | Pinus radiata | G5487 | 2-57 | 17911 | GRGRVQLRRIENKINRQ VTFSKRRNGLLKKAYEL SVLCDAEVALIIFSTRGK LYEF | 92 |
| 17887 | Poa annua | G5473 | 2-57 | 17912 | GRGRVELKRIENKINRQ VTFSKRRNGLLKKAYEL SVLCDAEVALIIFSSRGK LYEF | 98 |
| 17888 | Lolium perenne | G5474 | 2-57 | 17913 | GRGRVELKRIENKINRQ VTFSKRRNGLLKKAYEL SVLCDAEVALIIFSSRGK LYEF | 98 |
| 17889 | Vitis vinifera | G5477 | 2-57 | 17914 | GRGRVELKRIENKINRQ VTFSKRRNGLLKKAYEL SVLCDAEVALIIFSSRGK LYEF | 98 |

TABLE 14-continued

Conserved domains of G142 (Family: MADS) and closely related sequences

| SEQ ID NO: | Species from which SEQ ID NO: is derived | Gene ID (GID) | Conserved MADS domain amino acid coordinates | Conserved MADS domain SEQ ID NO: | Conserved MADS domain | Percent ID of conserved AP2 DNA binding domain to G142 conserved AP2 domain |
|---|---|---|---|---|---|---|
| 17890 | Petunia x hybrida | G5478 | 2-57 | 17915 | GRGRVELKRIENKINRQ VTFSKRRNGLLKKAYEL SVLCDAEVALIIFSSRGK LYEF | 98 |
| 17891 | Malus domestica | G5479 | 2-57 | 17916 | GRGRVELKRIENKINRQ VTFSKRRNGLLKKAYEL SVLCDAEVGLIIFSSRGK LYEF | 96 |
| 17892 | Picea abies | G5480 | 2-57 | 17917 | GRGRVQLRRIENKINRQ VTFSKRRNGLLKKAYEL SVLCDAEVALIIFSTRGK LYEF | 92 |
| 17893 | Hordeum vulgare | G5481 | 2-57 | 17918 | GRGRVELKRIENKINRQ VTFSKRRNGLLKKAYEL SVLCDAEVALIIFSSRGK LYEF | 98 |
| 17894 | Dendrocalamus latiflorus | G5482 | 2-57 | 17919 | GRGKVELKRIENKINRQ VTFSKRRNGLLKKAYEL SVLCDAEVALIIFSSRGK LYEF | 96 |
| 17895 | Pinus resinosa | G5485 | 2-57 | 17920 | GRGRVELKRIENKINRQ VTFSKRRNGLLKKAYEL SVLCDAEVALIIFSSRGK LYEF | 98 |
| 17896 | Pinus radiata | G5486 | 2-57 | 17921 | GRGRVELKRIENKINRQ VTFSKRRNGLLKKAYEL SVLCDAEVALIIFSSRGK LYEF | 98 |
| 17898 | Chrysanthemum x morifolium | G5488 | 2-57 | 17910 | GRGRVELKRIENKINRQ VTFSKRRNGLLKKAYEL SVLCDAEVGLIIFSSRDK LYEF | 94 |

TABLE 15

Conserved domains of G1266 (Family: AP2) and closely related sequences

| SEQ ID NO: | Species from which SEQ ID NO: is derived | Gene ID (GID) | Conserved AP2 DNA-binding domain amino acid coordinates | Conserved AP2 DNA-binding domain SEQ ID NO: | Conserved AP2 domain | Percent ID of conserved AP2 DNA binding domain to G1266 conserved AP2 domain |
|---|---|---|---|---|---|---|
| 884 | Arabidopsis thaliana | G1266 | 79-147 | 2902 | EKSYRGVRRRPWGKFA AEIRDSTRNGIRVWLGT FESAEEAALAYDQAAFS MRGSSAILNFSAERVQE SL | 100 |

TABLE 15-continued

Conserved domains of G1266 (Family: AP2) and closely related sequences

| SEQ ID NO: | Species from which SEQ ID NO: is derived | Gene ID (GID) | Conserved AP2 DNA-binding domain amino acid coordinates | Conserved AP2 DNA-binding domain SEQ ID NO: | Conserved AP2 domain | Percent ID of conserved AP2 DNA binding domain to G1266 conserved AP2 domain |
|---|---|---|---|---|---|---|
| 1136 | Arabidopsis thaliana | G1752 | 83-151 | 3045 | ERSYRGVRKRPWGKFA AEIRDSTRNGIRVWLGT FDKAEEAALAYDQAAF ATKGSLATLNFPVEVVR ESL | 81 |
| 1540 | Arabidopsis thaliana | G2512 | 79-147 | 3275 | EKSYRGVRKRPWGKFA AEIRDSTRKGIRVWLGT FDTAEAAALAYDQAAF ALKGSLAVLNFPADVV EESL | 79 |
| 17931 | Zea mays | G5185 | 105-173 | 17933 | PAPYIGVRKRPWGKFA AEIRDSTRKGARVWLG TFDSPEAAAMAYDQAA FSVRGAAAVLNFPVERV QESL | 75 |
| 17929 | Oryza sativa | G5183 | 18-86 | 17934 | QQAFRGVRKRPWGKFA AEIRDSTRNGVRVWLG TFDSAEEAALAYDQAA FAMRGSAAVLNFPMEQ VRRSM | 76 |
| 17930 | Glycine max | G5184 | 71-139 | 17935 | EKSYRGVRRRPWGKFA AEIRDSTRHGMRVWLG TFDSAEAAALAYDQAA FSMRGSAAILNFPAEIVR ESL | 88 |
| 17932 | Glycine max | G5186 | 117-185 | 17936 | KRPFRGVRRRPWGKFA AEIRDSTRNGVRVWIGT FDTAEAAALAYDQAAL STRGSMAVLNF PEEVVRESL | 75 |
| 17928 | Lycopersicon esculentum | G5170 | 94-162 | 17937 | EKHYIGVRKRPWGKYA SEIRDSTRNGIRVWLGT FDTAEEAALAYDQAAL SMRGPWSLLNFPMEHV KKSL | 75 |

TABLE 16

Conserved domains of G2933 (Family: HLH/MYC) and closely related sequences

| SEQ ID NO: | Species from which SEQ ID NO: is derived | Gene ID (GID) | Conserved HLH/MYC domain amino acid coordinates | Conserved HLH/MYC domain SEQ ID NO: | Conserved HLH/MYC domain | Percent ID of conserved HLH/MYC domain to G2933 conserved HLH/MYC domain |
|---|---|---|---|---|---|---|
| 17949 | Arabidopsis thaliana | G2933 | 68-128 | 17956 | PVVVKKLNHNASERDR RKKINTLFSSLRSCLPAS DQSKKLSIPETVSKSLK YIPELQQQVK | 100 |

TABLE 16-continued

Conserved domains of G2933 (Family: HLH/MYC) and closely related sequences

| SEQ ID NO: | Species from which SEQ ID NO: is derived | Gene ID (GID) | Conserved HLH/MYC domain amino acid coordinates | Conserved HLH/MYC domain SEQ ID NO: | Conserved HLH/MYC domain | Percent ID of conserved HLH/MYC domain to G2933 conserved HLH/MYC domain |
|---|---|---|---|---|---|---|
| 17948 | Arabidopsis thaliana | G2932 | 73-133 | 17957 | PVVVKKLNHNASERDR RRKINSLFSSLRSCLPAS GQSKKLSIPATVSRSLK YIPELQEQVK | 90 |
| 17947 | Arabidopsis thaliana | G2928 | 58-118 | 17958 | PVVMKKLNHNASERER RRKINTMFSSLRSCLPPT NQTKKLSVSATVSQAL KYIPELQEQVK | 78 |
| 17954 | Hordeum vulgare | G5193 | 70-126 | 17959 | RKISHNAYERDRRKQLN ELYSDLRSLLPDSDHTK KLSIPITVSRVLKYIPELQ KQV | 69 |
| 17951 | Zea mays | G5190 | 72-128 | 17960 | RKLSHNAYERDRRKQL NDLYSSLRSLLPDADHT KKLSIPTTVSRVLKYIPE LQKQV | 71 |
| 17944 | Vitis vinifera | G5192 | 66-122 | 17961 | PTMVKKLNHNASERDR RRKINSLYSSLRSLLPAA DQAKKLSIPSTVSRVLK YIPELQKQVK | 80 |
| 17950 | Oryza sativa | G5189 | 69-125 | 17962 | RKLSHNAYERDRRKQL NELYSSLRALLPDADHT KKLSIPTTVSRVLKYIPE LQKQVE | 68 |
| 17952 | Glycine max | G5191 | 62-118 | 17963 | KKLSHNASERDRRKKV NHLVSSLRSLLPGPDQT KKMSIPATVSRVLKYIP ELQHQVQ | 73 |
| 17955 | Arabidopsis thaliana | G2936 | 82-142 | 17964 | VVLEKKLNHNASERDR RRKLNALYSSLRALLPL SDQKRKLSIPMTVARVV KYIPEQKQELQ | 65 |

TABLE 17

Conserved domains of G154 (Family: MADS) and closely related sequences

| SEQ ID NO: | Species from which SEQ ID NO: is derived | Gene ID (GID) | Conserved MADS DNA binding domain amino acid coordinates | Conserved MADS DNA binding domain SEQ ID NO: | Conserved MADS domain | Percent ID of conserved MADS DNA binding domain to G154 conserved MADS domain |
|---|---|---|---|---|---|---|
| 114 | Arabidopsis thaliana | G154 | 2-57 | 17993 | VRGKTQMKRIENATSRQVTFSKR RNGLLKKAFELSVLCDAEVSLIIF SPKGKLYEF | 100 |
| 18040 | Medicago truncatula | G5312 | 2-57 | 17994 | VRGKTQMKRIENATSRQVTFSKR RNGLLKKAFELSVLCDAEVALIV FSPRGRLYEF | 92 |

TABLE 17-continued

Conserved domains of G154 (Family: MADS) and closely related sequences

| SEQ ID NO: | Species from which SEQ ID NO: is derived | Gene ID (GID) | Conserved MADS DNA binding domain amino acid coordinates | Conserved MADS DNA binding domain SEQ ID NO: | Conserved MADS domain | Percent ID of conserved MADS DNA binding domain to G154 conserved MADS domain |
|---|---|---|---|---|---|---|
| 18022 | Arabidopsis thaliana | G149 | 2-57 | 17995 | VRGKTEMKRIENATSRQVTFSKR RNGLLKKAFELSVLCDAEVALIIF SPRGKLYEF | 94 |
| 18048 | Arabidopsis thaliana | G627 | 2-57 | 17996 | VRGKTEMKRIENATSRQVTFSKR RNGLLKKAFELSVLCDAEVALVI FSPRSKLYEF | 91 |
| 18021 | Arabidopsis thaliana | G1011 | 2-57 | 17997 | VRGKIEMKKIENATSRQVTFSKR RNGLLKKAYELSVLCDAQLSLIIF SQRGRLYEF | 83 |
| 18023 | Arabidopsis thaliana | G1797 | 2-57 | 17998 | VRGKIEIKKIENVTSRQVTFSKRR SGLFKKAHELSVLCDAQVAAMIF SQKGRLYEF | 75 |
| 18024 | Arabidopsis thaliana | G1798 | 2-57 | 17999 | VRGKIEIKKIENVTSRQVTFSKRR SGLFKKAHELSVLCDAQVAAIVF SQSGRLHEY | 69 |
| 18037 | Populus tremuloides | G5309 | 2-57 | 18000 | VRGKTQMRRIENATSRQVTFSKR RNGLLKKAFELSVLCDAEVALIV FSPRGKLYEF | 92 |
| 18026 | Brassica rapa | G4062 | 2-57 | 18001 | VRGKTQMKRIENATSRQVTFSKR RNGLLKKAFELSVLCDAEVSLIIF SPKAKLYEF | 98 |
| 18035 | Cardamine flexuosa | G5306 | 2-57 | 18002 | VRGKTQMKRIENATSRQVTFSKR RNGLLKKAFELSVLCDAEVSLIIF SPKGKLYEF | 100 |
| 18029 | Zea mays | G4065 | 2-57 | 18003 | VRGKTQMKRIENPTSRQVTFSKR RNGLLKKAFELSVLCDAEVALV VFSPRGKLYEF | 91 |
| 18034 | Gossypium hirsutum | G5305 | 2-57 | 18004 | VRGKTQMKRIENPTSRQVTFSKR RNGLLKKAFELSVLCDVEVALIIF SPRGKPYEF | 91 |
| 18039 | Vitis vinifera | G5311 | 2-57 | 18005 | VRGKTQMRRIENATSRQVTFSKR RNGLFKKAFELSVLCDAEVALIIF SPRGKLYEF | 92 |
| 18041 | Citrus sinensis | G5313 | 2-57 | 18006 | VRGKTQMRRIENATSRQVTFSKR RNGLLKKAFELSVLCDAEVAVIIF SPRGKLSEF | 91 |
| 18044 | Citrus sinensis | G5316 | 2-57 | 18007 | VRGKIQMKKIENDTSRQVTFSKR RNGMLKKAYELSVLCDAEVAVII FSQKGRLYEF | 83 |
| 18042 | Pisum sativum | G5314 | 2-57 | 18065 | VRGKTQMKRIENATSRQVTFSKR RNGLLKKAFELSVLCDAEVALIIF SPRGKLYEF | 96 |
| 18045 | Petunia x hybrida | G5317 | 2-57 | 18008 | VRGKTQMRRIENATSRQVTFSKR RNGLLKKAFELSVLCDAEVSLIIF STRGKLYEF | 94 |
| 18046 | Petunia x hybrida | G5318 | 2-57 | 18009 | VRGKTQMRRIENATSRQVTFSKR RNGLLKKAFELSVLCDAQVGLVI FSPRGKQYEF | 89 |
| 18047 | Petunia x hybrida | G5319 | 2-57 | 18010 | VRGKTQMRRIENATSRQVTFSKR RNGLLKKAFELSVLCDAEVGLVI FSPRGKLYEF | 92 |

TABLE 17-continued

Conserved domains of G154 (Family: MADS) and closely related sequences

| SEQ ID NO: | Species from which SEQ ID NO: is derived | Gene ID (GID) | Conserved MADS DNA binding domain amino acid coordinates | Conserved MADS DNA binding domain SEQ ID NO: | Conserved MADS domain | Percent ID of conserved MADS DNA binding domain to G154 conserved MADS domain |
|---|---|---|---|---|---|---|
| 18030 | Oryza sativa | G4066 | 2-57 | 18011 | VRGKTQMKRIENPTSRQVTFSKR RNGLLKKAFELSVLCDAEVALIV FSPRGKLYEF | 92 |
| 18031 | Oryza sativa | G4067 | 2-57 | 18012 | VRGRTELKRIENPTSRQVTFSKRR NGLLKKAFELSVLCDAEVALIVF SPRGRLYEF | 85 |
| 18027 | Glycine max | G4063 | 2-57 | 18013 | VRGKTQLRRIENATSRQVTFSKR RNGLLKKAFELSVLCDAEVALIIF SPRGKLYEF | 92 |
| 18028 | Glycine max | G4064 | 2-57 | 18014 | VRGKTQMRRIENATSRQVTFSKR RNGLLKKAFELSVLCDAEVALIIF SPRGKLYEF | 94 |
| 18032 | Glycine max | G5303 | 2-57 | 18015 | VRGKTQMKRIENATSRQVTFSKR RNGLLKKAFELSVLCDAEVALIIF SPRGKLYEF | 96 |
| 18033 | Glycine max | G5304 | 2-57 | 18016 | VRGKTQIKRIENATSRQVTFSKRR NGLLKKAFELSVLCDAEVALIIFS SSGKLYEF | 92 |
| 18043 | Ipomoea batatas | G5315 | 2-57 | 18017 | VRGKTQMRRIENATSRQVTFSKR RNGLLKKAFELSVLCDAEVALIIF SPRGKLYEF | 94 |
| 18038 | Nicotiana tabacum | G5310 | 2-57 | 18018 | VRGKTQMRRIENATSRQVTFSKR RNGLLKKAFELSVLCDAEVGLVI FSPRGKLYEF | 92 |
| 18025 | Solanum lycopersicum | G4061 | 2-57 | 18019 | VRGKVEMKRIENSTSRQVTFSKR RNGLTKKAYELSVLCDAEVAFIIF SHKGRLYEF | 83 |
| 18036 | Sinapis alba | G5307 | 2-57 | 18020 | VRGKTQMKRIENATSRQVTFSKR RNGLLKKAFELSVLCDAEVSLIIF SPKGKLYEF | 100 |

TABLE 18

Conserved domain of G671 and closely related sequence

| SEQ ID NO: | Species from which SEQ ID NO: is derived | Gene ID (GID) | Conserved MYB-(R1)R2R3 domain amino acid coordinates | Conserved MYB-(R1)R2R3 domain SEQ ID NO: | Conserved MYB-(R1)R2R3 domain | Percent ID of conserved MYB-(R1)R2R3 domain to G671 conserved MYB-(R1)R2R3 domain |
|---|---|---|---|---|---|---|
| 538 | Arabidopsis thaliana | G671 | 15-115 | 18059 | KGAWTPEEDQKLLSYLNRHGEGG WRTLPEKAGLKRCGKSCRLRWAN YLRPDIKRGEFTEDEERSIISLHALH GNKWSAIARGLPGRTDNEIKNYW NTHIKK | 100 |

TABLE 18-continued

Conserved domain of G671 and closely related sequence

| SEQ ID NO: | Species from which SEQ ID NO: is derived | Gene ID (GID) | Conserved MYB-(R1)R2R3 domain amino acid coordinates | Conserved MYB-(R1)R2R3 domain | Conserved MYB-(R1)R2R3 domain SEQ ID NO: | Percent ID of conserved MYB-(R1)R2R3 domain to G671 conserved MYB-(R1)R2R3 domain |
|---|---|---|---|---|---|---|
| 18058 | Arabidopsis thaliana | G656 | 14-114 | KGAWTPEEDQKLIAYLHLHGEGG WRTLPEKAGLKRCGKSCRLRWAN YLRPDIKRGEFSPEEDDTIIKLHALK GNKWAAIATSLAGRTDNEIKNYW NTNLKK | 18060 | 82 |
| 174 | Arabidopsis thaliana | G202 | 14-114* | KGAWTTEEDKKLISYIHDHGEGG WRDIPQKAGLKRCGKSCRLRWTN YLKPEIKRGEFSSEEEQIIIMLHASR GNKWSVIARHLPRRTDNEIKNYW NTHLKK | 18061 | 76 |
| 172 | Arabidopsis thaliana | G201 | 14-114 | KGAWTAEEDKKLISYIHEHGGGG WRDIPQKAGLKRCGKSCRLRWAN YLKPDIKRGEFSYEEEQIIIMLHASR GNKWSVIARHLPKRTDNEIKNYW NTHLKK | 18051 | 77 |
| 18057 | Arabidopsis thaliana | G243 | 14-114** | KGAWTTEEDKKLISYIHDHGEGG WRDIPEKAGLKRCGKSCRLRWTN YLKPDIKRGEFSYEEEQIIIMLHASR GNKWSVIARHLPKRTDNEVKNYW NTHLKK | 18063 | 77 |
| 18056 | Arabidopsis thaliana | G2340 | 14-114*** | KGAWTQEEDQKLIAYVQRHGEGG WRTLPDKAGLKRCGKSCRLRWAN YLRPDIKRGEFSQDEEDSIINLHAIH GNKWSAIARKIPRRTDNEIKNHWN THIKK | 18052 | 85 |

*The domain is within the larger conserved domain which consists of amino acid residues 13-116.
**The domain is within the larger conserved domain which consists of amino acid residues 12-128.
***The domain is within the larger conserved domain which consists of amino acid residues 14-120.

Orthologs and Paralogs

Homologous sequences as described above can comprise orthologous or paralogous sequences. Several different methods are known by those of skill in the art for identifying and defining these functionally homologous sequences. Three general methods for defining orthologs and paralogs are described; an ortholog or paralog, including equivalogs, may be identified by one or more of the methods described below.

As described by Eisen (1998) *Genome Res.* 8: 163-167, evolutionary information may be used to predict gene function. It is common for groups of genes that are homologous in sequence to have diverse, although usually related, functions. However, in many cases, the identification of homologs is not sufficient to make specific predictions because not all homologs have the same function. Thus, an initial analysis of functional relatedness based on sequence similarity alone may not provide one with a means to determine where similarity ends and functional relatedness begins. Fortunately, it is well known in the art that protein function can be classified using phylogenetic analysis of gene trees combined with the corresponding species. Functional predictions can be greatly improved by focusing on how the genes became similar in sequence (i.e., by evolutionary processes) rather than on the sequence similarity itself (Eisen, supra). In fact, many specific examples exist in which gene function has been shown to correlate well with gene phylogeny (Eisen, supra). Thus, "[t]he first step in making functional predictions is the generation of a phylogenetic tree representing the evolutionary history of the gene of interest and its homologs. Such trees are distinct from clusters and other means of characterizing sequence similarity because they are inferred by techniques that help convert patterns of similarity into evolutionary relationships . . . . After the gene tree is inferred, biologically determined functions of the various homologs are overlaid onto the tree. Finally, the structure of the tree and the relative phylogenetic positions of genes of different functions are used to trace the history of functional changes, which is then used to predict functions of [as yet] uncharacterized genes" (Eisen, supra).

Within a single plant species, gene duplication may cause two copies of a particular gene, giving rise to two or more genes with similar sequence and often similar function known as paralogs. A paralog is therefore a similar gene formed by duplication within the same species. Paralogs typically cluster together or in the same clade (a group of similar genes) when a gene family phylogeny is analyzed using programs such as CLUSTAL (Thompson et al. (1994); Higgins et al. (1996)). Groups of similar genes can also be identified with pair-wise BLAST analysis (Feng and Doolittle (1987)). For example, a clade of very similar MADS domain transcription factors from *Arabidopsis* all share a common function in flowering time (Ratcliffe et al. (2001)), and a group of very similar AP2 domain transcription factors from *Arabidopsis* are involved in tolerance of plants to freezing (Gilmour et al. (1998)). Analysis of groups of similar genes with similar function that fall within one clade can yield sub-sequences that are particular to the clade. These sub-sequences, known as consensus sequences, can not only be used to define the sequences within each clade, but define the functions of these genes; genes within a clade may contain paralogous sequences, or orthologous sequences that share the same function (see also, for example, Mount (2001))

Speciation, the production of new species from a parental species, can also give rise to two or more genes with similar sequence and similar function. These genes, termed orthologs, often have an identical function within their host plants and are often interchangeable between species without losing function. Because plants have common ancestors, many genes in any plant species will have a corresponding orthologous gene in another plant species. Once a phylogenic tree for a gene family of one species has been constructed using a program such as CLUSTAL (Thompson et al. (1994); Higgins et al. (1996)) potential orthologous sequences can be placed into the phylogenetic tree and their relationship to genes from the species of interest can be determined Orthologous sequences can also be identified by a reciprocal BLAST strategy. Once an orthologous sequence has been identified, the function of the ortholog can be deduced from the identified function of the reference sequence.

Transcription factor gene sequences are conserved across diverse eukaryotic species lines (Goodrich et al. (1993); Lin et al. (1991); Sadowski et al. (1988)). Plants are no exception to this observation; diverse plant species possess transcription factors that have similar sequences and functions.

Orthologous genes from different organisms have highly conserved functions, and very often essentially identical functions (Lee et al. (2002); Remm et al. (2001)). Paralogous genes, which have diverged through gene duplication, may retain similar functions of the encoded proteins. In such cases, paralogs can be used interchangeably with respect to certain embodiments of the instant invention (for example, transgenic expression of a coding sequence). An example of such highly related paralogs is the CBF family, with three well-defined members in *Arabidopsis* and at least one ortholog in *Brassica napus*, all of which control pathways involved in both freezing and drought stress (Gilmour et al. (1998); Jaglo et al. (2001)).

Distinct *Arabidopsis* transcription factors, including G28 (found in U.S. Pat. No. 6,664,446), G482 (found in US Patent Application 20040045049), G867 (found in US Patent Application 20040098764), and G1073 (found in U.S. Pat. No. 6,717,034), have been shown to confer stress tolerance or increased biomass when the sequences are overexpressed. The polypeptides sequences belong to distinct clades of transcription factor polypeptides that include members from diverse species. In each case, a significant number of clade member sequences derived from both eudicots and monocots have been shown to confer greater biomass or tolerance to stress when the sequences were overexpressed (unpublished data). These references may serve to represent the many studies that demonstrate that conserved transcription factor genes from diverse species are likely to function similarly (i.e., regulate similar target sequences and control the same traits), and that transcription factors may be transformed into diverse species to confer or improve traits.

As shown in Tables 1-7, transcription factors that are phylogenetically related to the transcription factors of the invention may have conserved domains that share at least 38% amino acid sequence identity, and have similar functions.

At the nucleotide level, the sequences of the invention will typically share at least about 30% or 40% nucleotide sequence identity, preferably at least about 50%, about 60%, about 70% or about 80% sequence identity, and more preferably about 85%, about 90%, about 95% or about 97% or more sequence identity to one or more of the listed full-length sequences, or to a listed sequence but excluding or outside of the region(s) encoding a known consensus sequence or consensus DNA-binding site, or outside of the region(s) encoding one or all conserved domains. The degeneracy of the genetic code enables major variations in the nucleotide sequence of a polynucleotide while maintaining the amino acid sequence of the encoded protein.

Percent identity can be determined electronically, e.g., by using the MEGALIGN program (DNASTAR, Inc. Madison, Wis.). The MEGALIGN program can create alignments between two or more sequences according to different methods, for example, the clustal method (see, for example, Higgins and Sharp (1988) The clustal algorithm groups sequences into clusters by examining the distances between all pairs. The clusters are aligned pairwise and then in groups. Other alignment algorithms or programs may be used, including FASTA, BLAST, or ENTREZ, FASTA and BLAST, and which may be used to calculate percent similarity. These are available as a part of the GCG sequence analysis package (University of Wisconsin, Madison, Wis.), and can be used with or without default settings. ENTREZ is available through the National Center for Biotechnology Information. In one embodiment, the percent identity of two sequences can be determined by the GCG program with a gap weight of 1, e.g., each amino acid gap is weighted as if it were a single amino acid or nucleotide mismatch between the two sequences (see U.S. Pat. No. 6,262,333).

Software for performing BLAST analyses is publicly available, e.g., through the National Center for Biotechnology Information (see internet website at www.ncbi.nlm nih.gov/). This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul (1993); Altschul et al. (1990)). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1992). Unless otherwise indicated for comparisons of predicted polynucleotides, "sequence identity" refers to the % sequence identity generated from a tblastx using the NCBI version of the algorithm at the default settings using gapped alignments with the filter "off" (see, for example, internet website at www.ncbi.nlm.nih.gov/).

Other techniques for alignment are described by Doolittle (1996). Preferably, an alignment program that permits gaps in the sequence is utilized to align the sequences. The Smith-Waterman is one type of algorithm that permits gaps in sequence alignments (see Shpaer (1997). Also, the GAP program using the Needleman and Wunsch alignment method can be utilized to align sequences. An alternative search strategy uses MPSRCH software, which runs on a MASPAR computer. MPSRCH uses a Smith-Waterman algorithm to score sequences on a massively parallel computer. This approach improves ability to pick up distantly related matches, and is especially tolerant of small gaps and nucleotide sequence errors. Nucleic acid-encoded amino acid sequences can be used to search both protein and DNA databases.

The percentage similarity between two polypeptide sequences, e.g., sequence A and sequence B, is calculated by dividing the length of sequence A, minus the number of gap residues in sequence A, minus the number of gap residues in sequence B, into the sum of the residue matches between sequence A and sequence B, times one hundred. Gaps of low or of no similarity between the two amino acid sequences are not included in determining percentage similarity. Percent identity between polynucleotide sequences can also be counted or calculated by other methods known in the art, e.g., the Jotun Hein method (see, for example, Hein (1990)) Identity between sequences can also be determined by other methods known in the art, e.g., by varying hybridization conditions (see US Patent Application No. 20010010913).

Thus, the invention provides methods for identifying a sequence similar or paralogous or orthologous or homologous to one or more polynucleotides as noted herein, or one or more target polypeptides encoded by the polynucleotides, or otherwise noted herein and may include linking or associating a given plant phenotype or gene function with a sequence. In the methods, a sequence database is provided (locally or across an internet or intranet) and a query is made against the sequence database using the relevant sequences herein and associated plant phenotypes or gene functions.

In addition, one or more polynucleotide sequences or one or more polypeptides encoded by the polynucleotide sequences may be used to search against a BLOCKS (Bairoch et al. (1997)), PFAM, and other databases which contain previously identified and annotated motifs, sequences and gene functions. Methods that search for primary sequence patterns with secondary structure gap penalties (Smith et al. (1992)) as well as algorithms such as Basic Local Alignment Search Tool (BLAST; Altschul (1993); Altschul et al. (1990)), BLOCKS (Henikoff and Henikoff (1991)), Hidden Markov Models (HMM; Eddy (1996); Sonnhammer et al. (1997)), and the like, can be used to manipulate and analyze polynucleotide and polypeptide sequences encoded by polynucleotides. These databases, algorithms and other methods are well known in the art and are described in Ausubel et al. (1997), and in Meyers (1995).

A further method for identifying or confirming that specific homologous sequences control the same function is by comparison of the transcript profile(s) obtained upon overexpression or knockout of two or more related transcription factors. Since transcript profiles are diagnostic for specific cellular states, one skilled in the art will appreciate that genes that have a highly similar transcript profile (e.g., with greater than 50% regulated transcripts in common, or with greater than 70% regulated transcripts in common, or with greater than 90% regulated transcripts in common) will have highly similar functions. Fowler et al. (2002), have shown that three paralogous AP2 family genes (CBF1, CBF2 and CBF3), each of which is induced upon cold treatment, and each of which can condition improved freezing tolerance, have highly similar transcript profiles. Once a transcription factor has been shown to provide a specific function, its transcript profile becomes a diagnostic tool to determine whether paralogs or orthologs have the same function.

Furthermore, methods using manual alignment of sequences similar or homologous to one or more polynucleotide sequences or one or more polypeptides encoded by the polynucleotide sequences may be used to identify regions of similarity and conserved domains. Such manual methods are well-known of those of skill in the art and can include, for example, comparisons of tertiary structure between a polypeptide sequence encoded by a polynucleotide that comprises a known function and a polypeptide sequence encoded by a polynucleotide sequence that has a function not yet determined Such examples of tertiary structure may comprise predicted alpha helices, beta-sheets, amphipathic helices, leucine zipper motifs, zinc finger motifs, proline-rich regions, cysteine repeat motifs, and the like.

Orthologs and paralogs of presently disclosed transcription factors may be cloned using compositions provided by the present invention according to methods well known in the art. cDNAs can be cloned using mRNA from a plant cell or tissue that expresses one of the present transcription factors. Appropriate mRNA sources may be identified by interrogating Northern blots with probes designed from the present transcription factor sequences, after which a library is prepared from the mRNA obtained from a positive cell or tissue. Transcription factor-encoding cDNA is then isolated using, for example, PCR, using primers designed from a presently disclosed transcription factor gene sequence, or by probing with a partial or complete cDNA or with one or more sets of degenerate probes based on the disclosed sequences. The cDNA library may be used to transform plant cells. Expression of the cDNAs of interest is detected using, for example, microarrays, Northern blots, quantitative PCR, or any other technique for monitoring changes in expression. Genomic clones may be isolated using similar techniques to those.

Examples of orthologs of the *Arabidopsis* polypeptide sequences and their functionally similar orthologs are listed in the Sequence Listing. In addition to the sequences in the Sequence Listing, the invention encompasses isolated nucleotide sequences that are phylogenetically and structurally similar to sequences listed in the Sequence Listing) and can function in a plant by increasing biomass, disease resistance and/or and abiotic stress tolerance when ectopically expressed in a plant. These polypeptide sequences represent transcription factors that show significant sequence similarity the polypeptides of the Sequence Listing particularly in their respective conserved domains, as identified in Tables 1-18.

Since a significant number of these sequences are phylogenetically and sequentially related to each other and have been shown to increase a plant's biomass, disease resistance and/or abiotic stress tolerance, one skilled in the art would predict that other similar, phylogenetically related sequences falling within the present clades of transcription factors would also perform similar functions when ectopically expressed.

Identifying Polynucleotides or Nucleic Acids by Hybridization

Polynucleotides homologous to the sequences illustrated in the Sequence Listing and tables can be identified, e.g., by hybridization to each other under stringent or under highly stringent conditions. Single stranded polynucleotides hybridize when they associate based on a variety of well characterized physical-chemical forces, such as hydrogen bonding, solvent exclusion, base stacking and the like. The stringency of a hybridization reflects the degree of sequence identity of the nucleic acids involved, such that the higher the stringency, the more similar are the two polynucleotide strands. Stringency is influenced by a variety of factors, including temperature, salt concentration and composition, organic and non-organic additives, solvents, etc. present in both the hybridization and wash solutions and incubations (and number thereof), as described in more detail in the references cited below (e.g., Sambrook et al. (1989); Berger and Kimmel (1987); and Anderson and Young (1985)).

Encompassed by the invention are polynucleotide sequences that are capable of hybridizing to the claimed polynucleotide sequences, including any of the transcription factor polynucleotides within the Sequence Listing, and fragments thereof under various conditions of stringency (see, for example, Wahl and Berger (1987); and Kimmel (1987)). In addition to the nucleotide sequences listed in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

With regard to hybridization, conditions that are highly stringent, and means for achieving them, are well known in the art. See, for example, Sambrook et al. (1989); Berger (1987), pages 467-469; and Anderson and Young (1985).

Stability of DNA duplexes is affected by such factors as base composition, length, and degree of base pair mismatch. Hybridization conditions may be adjusted to allow DNAs of different sequence relatedness to hybridize. The melting temperature ($T_m$) is defined as the temperature when 50% of the duplex molecules have dissociated into their constituent single strands. The melting temperature of a perfectly matched duplex, where the hybridization buffer contains formamide as a denaturing agent, may be estimated by the following equations:

$T_m(° C.)=81.5+16.6(\log [Na+])+0.41(\% G+C)- 0.62(\% \text{ formamide})-500/L$ (I) DNA-DNA:

$T_m(° C.)=79.8+18.5(\log [Na+])+0.58(\% G+C)+ 0.12(\% G+C)^2-0.5(\% \text{ formamide})-820/L$ (II) DNA-RNA:

$T_m(° C.)=79.8+18.5(\log [Na+])+0.58(\% G+C)+ 0.12(\% G+C)^2-0.35(\% \text{ formamide})-820/L$ (III) RNA-RNA:

where L is the length of the duplex formed, [Na+] is the molar concentration of the sodium ion in the hybridization or washing solution, and % G+C is the percentage of (guanine+cytosine) bases in the hybrid. For imperfectly matched hybrids, approximately 1° C. is required to reduce the melting temperature for each 1% mismatch.

Hybridization experiments are generally conducted in a buffer of pH between 6.8 to 7.4, although the rate of hybridization is nearly independent of pH at ionic strengths likely to be used in the hybridization buffer (Anderson and Young (1985)). In addition, one or more of the following may be used to reduce non-specific hybridization: sonicated salmon sperm DNA or another non-complementary DNA, bovine serum albumin, sodium pyrophosphate, sodium dodecylsulfate (SDS), polyvinyl-pyrrolidone, ficoll and Denhardt's solution. Dextran sulfate and polyethylene glycol 6000 act to exclude DNA from solution, thus raising the effective probe DNA concentration and the hybridization signal within a given unit of time. In some instances, conditions of even greater stringency may be desirable or required to reduce non-specific and/or background hybridization. These conditions may be created with the use of higher temperature, lower ionic strength and higher concentration of a denaturing agent such as formamide.

Stringency conditions can be adjusted to screen for moderately similar fragments such as homologous sequences from distantly related organisms, or to highly similar fragments such as genes that duplicate functional enzymes from closely related organisms. The stringency can be adjusted either during the hybridization step or in the post-hybridization washes. Salt concentration, formamide concentration, hybridization temperature and probe lengths are variables that can be used to alter stringency (as described by the formula above). As a general guidelines high stringency is typically performed at $T_m-5°$ C. to $T_m-20°$ C., moderate stringency at $T_m-20°$ C. to $T_m-35°$ C. and low stringency at $T_m-35°$ C. to $T_m-50°$ C. for duplex>150 base pairs. Hybridization may be performed at low to moderate stringency (25-50° C. below $T_m$), followed by post-hybridization washes at increasing stringencies. Maximum rates of hybridization in solution are determined empirically to occur at $T_m-25°$ C. for DNA-DNA duplex and $T_m-15°$ C. for RNA-DNA duplex. Optionally, the degree of dissociation may be assessed after each wash step to determine the need for subsequent, higher stringency wash steps.

High stringency conditions may be used to select for nucleic acid sequences with high degrees of identity to the disclosed sequences. An example of stringent hybridization conditions obtained in a filter-based method such as a Southern or Northern blot for hybridization of complementary nucleic acids that have more than 100 complementary residues is about 5° C. to 20° C. lower than the thermal melting point ($T_m$) for the specific sequence at a defined ionic strength and pH. Conditions used for hybridization may include about 0.02 M to about 0.15 M sodium chloride, about 0.5% to about 5% casein, about 0.02% SDS or about 0.1% N-laurylsarcosine, about 0.001 M to about 0.03 M sodium citrate, at hybridization temperatures between about 50° C. and about 70° C. More preferably, high stringency conditions are about 0.02 M sodium chloride, about 0.5% casein, about 0.02% SDS, about 0.001 M sodium citrate, at a temperature of about 50° C. Nucleic acid molecules that hybridize under stringent conditions will typically hybridize to a probe based on either the entire DNA molecule or selected portions, e.g., to a unique subsequence, of the DNA.

Stringent salt concentration will ordinarily be less than about 750 mM NaCl and 75 mM trisodium citrate. Increasingly stringent conditions may be obtained with less than about 500 mM NaCl and 50 mM trisodium citrate, to even greater stringency with less than about 250 mM NaCl and 25 mM trisodium citrate. Low stringency hybridization can be obtained in the absence of organic solvent, e.g., formamide, whereas high stringency hybridization may be obtained in the presence of at least about 35% formamide, and more preferably at least about 50% formamide Stringent temperature conditions will ordinarily include temperatures of at least about 30° C., more preferably of at least about 37° C., and most preferably of at least about 42° C. with formamide present. Varying additional parameters, such as hybridization time, the concentration of detergent, e.g., sodium dodecyl sulfate (SDS) and ionic strength, are well known to those skilled in the art. Various levels of stringency are accomplished by combining these various conditions as needed.

The washing steps that follow hybridization may also vary in stringency; the post-hybridization wash steps primarily determine hybridization specificity, with the most critical factors being temperature and the ionic strength of the final wash solution. Wash stringency can be increased by decreasing salt concentration or by increasing temperature. Stringent salt concentration for the wash steps will preferably be less than about 30 mM NaCl and 3 mM trisodium citrate, and most preferably less than about 15 mM NaCl and 1.5 mM trisodium citrate.

Thus, hybridization and wash conditions that may be used to bind and remove polynucleotides with less than the desired homology to the nucleic acid sequences or their complements that encode the present transcription factors include, for example:

0.2× to 2×SSC and 0.1% SDS at 50° C., 55° C., 60° C., 65° C., or 50° C. to 65° C.;

6×SSC at 65° C.;

50% formamide, 4×SSC at 42° C.; or 0.5×, 1×, or 1.5×SSC, 0.1% SDS at 50° C., 55° C., 60° C., or 65° C.;

with, for example, two wash steps of 10-30 minutes each. Useful variations on these conditions will be readily apparent to those skilled in the art. A formula for "SSC, 20×" may be found, for example, in Ausubel et al., 1997, in Appendix A1.

A person of skill in the art would not expect substantial variation among polynucleotide species encompassed within the scope of the present invention because the highly stringent conditions set forth in the above formulae yield structurally similar polynucleotides.

If desired, one may employ wash steps of even greater stringency, including about 0.2×SSC, 0.1% SDS at 65° C. and washing twice, each wash step being about 30 minutes, or about 0.1×SSC, 0.1% SDS at 65° C. and washing twice for 30 minutes. The temperature for the wash solutions will ordinarily be at least about 25° C., and for greater stringency at least about 42° C. Hybridization stringency may be increased further by using the same conditions as in the hybridization steps, with the wash temperature raised about 3° C. to about 5° C., and stringency may be increased even further by using the same conditions except the wash temperature is raised about 6° C. to about 9° C. For identification of less closely related homologs, wash steps may be performed at a lower temperature, e.g., 50° C.

An example of a low stringency wash step employs a solution and conditions of at least 25° C. in 30 mM NaCl, 3 mM trisodium citrate, and 0.1% SDS over 30 minutes. Greater stringency may be obtained at 42° C. in 15 mM NaCl, with 1.5 mM trisodium citrate, and 0.1% SDS over 30 minutes. Even higher stringency wash conditions are obtained at 65° C.–68° C. in a solution of 15 mM NaCl, 1.5 mM trisodium citrate, and 0.1% SDS. Wash procedures will generally employ at least two final wash steps. Additional variations on these conditions will be readily apparent to those skilled in the art (see, for example, US Patent Application No. 20010010913).

Stringency conditions can be selected such that an oligonucleotide that is perfectly complementary to the coding oligonucleotide hybridizes to the coding oligonucleotide with at least about a 5-10× higher signal to noise ratio than the ratio for hybridization of the perfectly complementary oligonucleotide to a nucleic acid encoding a transcription factor known as of the filing date of the application. It may be desirable to select conditions for a particular assay such that a higher signal to noise ratio, that is, about 15× or more, is obtained. Accordingly, a subject nucleic acid will hybridize to a unique coding oligonucleotide with at least a 2× or greater signal to noise ratio as compared to hybridization of the coding oligonucleotide to a nucleic acid encoding known polypeptide. The particular signal will depend on the label used in the relevant assay, e.g., a fluorescent label, a colorimetric label, a radioactive label, or the like. Labeled hybridization or PCR probes for detecting related polynucleotide sequences may be produced by oligolabeling, nick translation, end-labeling, or PCR amplification using a labeled nucleotide.

Encompassed by the invention are polynucleotide sequences that are capable of hybridizing to the claimed polynucleotide sequences, including any of the transcription factor polynucleotides within the Sequence Listing, and fragments thereof under various conditions of stringency (see, for example, Wahl and Berger (1987), pages 399-407; and Kimmel (1987)). In addition to the nucleotide sequences in the Sequence Listing, full length cDNA, orthologs, and paralogs of the present nucleotide sequences may be identified and isolated using well-known methods. The cDNA libraries, orthologs, and paralogs of the present nucleotide sequences may be screened using hybridization methods to determine their utility as hybridization target or amplification probes.

EXAMPLES

It is to be understood that this invention is not limited to the particular devices, machines, materials and methods described. Although particular embodiments are described, equivalent embodiments may be used to practice the invention.

The invention, now being generally described, will be more readily understood by reference to the following examples, which are included merely for purposes of illustration of certain aspects and embodiments of the present invention and are not intended to limit the invention. It will be recognized by one of skill in the art that a transcription factor that is associated with a particular first trait may also be associated with at least one other, unrelated and inherent second trait which was not predicted by the first trait.

Example I. Project Types

A variety of constructs were used to modulate the activity of lead transcription factors, and to test the activity of orthologs and paralogs in transgenic plant material. This platform provided the material for all subsequent analysis.

Transgenic lines from each particular transformation "project" were examined for morphological and physiological phenotypes. An individual project was defined as the analysis of lines for a particular construct or knockout (for example this might be 35S lines for a lead gene, 35S lines for a paralog or ortholog, lines for an RNAi construct, lines for a GAL4 fusion construct, lines in which expression is driven from a particular tissue specific promoter, etc.) In the current lead advancement program, four main areas of analysis were pursued, spanning a variety of different project types (e.g., promoter-gene combinations).

(1) Overexpression/Tissue-Specific/Conditional Expression

The promoters used in our experiments were selected in order to provide for a range of different expression patterns. Details of promoters being used are provided in Example II.

Expression of a given TF from a particular promoter was achieved either by a direct-promoter fusion construct in which that TF was cloned directly behind the promoter of interest or by a two component system. Details of transformation vectors used in these studies are shown in the Vector and Cloning Information (Example III). A list of all constructs used in these analyses (PIDs), including compilations of the sequences of promoter fragments and the expressed transgene sequences within the PIDs, are provided in the Sequence Listing.

The Two-Component Expression System

For the two-component system, two separate constructs were used: Promoter::LexA-GAL4TA and opLexA::TF. The first of these (Promoter::LexA-GAL4TA) comprised a desired promoter cloned in front of a LexA DNA binding domain fused to a GAL4 activation domain. The construct vector backbone (pMEN48, also known as P5375) also carried a kanamycin resistance marker, along with an opLexA::GFP (green fluorescent protein) reporter. Transgenic lines were obtained containing this first component, and a line was selected that shows reproducible expression of the reporter gene in the desired pattern through a number of generations. A homozygous population was established for that line, and the population was supertransformed with the second construct (opLexA::TF) carrying the TF of interest cloned behind a LexA operator site. This second construct vector backbone (pMEN53, also known as P5381) also contained a sulfonamide resistance marker.

Each of the above methods offers a number of pros and cons. A direct fusion approach allows for much simpler genetic analysis if a given promoter-TF line is to be crossed into different genetic backgrounds at a later date. The two-component method, on the other hand, potentially allows for stronger expression to be obtained via an amplification of transcription. Additionally, a range of two-component constructs were available at the start of the Lead Advancement program which had been built using funding from an Advanced Technology Program (ATP) grant.

In general, Arabidopsis TFs from different study groups were expressed from a range of different promoters, often with a two component method. Arabidopsis paralogs were also generally analyzed by the two-component method, but were typically analyzed using the only 35S promoter. However, an alternative promoter was sometimes used for paralogs when there was a specific indication that a different promoter might afford a more useful approach (such as when use of the 35S promoter was known to generate deleterious effects). Putative orthologs from other species were usually analyzed by overexpression from a 35S CaMV promoter via a direct promoter-fusion construct. The vector backbone for most of the direct promoter-fusion overexpression constructs was pMEN65, but pMEN1963 and pMEN20 were sometimes used.

(2) Knock-Out/Knock-Down

Where available, T-DNA insertion lines from either the public or the in-house collections were analyzed.

In cases where a T-DNA insertion line was unavailable, an RNA interference (RNAi) strategy was sometimes used. At the outset of the program, the system was tested with two well-characterized genes [LEAFY (Weigel et al., 1992) and CONSTANS (Putterill et al., 1995)] that gave clear morphological phenotypes when mutated. In each case, RNAi lines were obtained that exhibited characters seen in the null mutants.

(3) Protein Modifications

Deletion Variants

Truncated versions or fragments of the leads were sometimes overexpressed to test hypotheses regarding particular parts of the proteins. Such an approach can result in dominant negative alleles.

Point Mutation and Domain Swap Variants

In order to assess the role of particular conserved residues or domains, mutated versions of lead proteins with substitutions at those residues were overexpressed. In some cases, we also overexpressed chimeric variants of the transcription factor in which one or domains have been exchanged with another transcription factor.

(4) Analytical Tools for Pathway Analysis

Promoter-Reporter Constructs

Promoters were primarily cloned in front of a GUS reporter system. These constructs were used to identify putative upstream transcriptional activators via a transient assay. In most cases approximately 2 kb of the sequence immediately 5' to the ATG of the gene was included in the construct.

In addition to being used in transient assays, the promoter-reporter constructs were transformed into Arabidopsis. The lines were then used to characterize the expression patterns of the lead genes in planta over a variety of tissue types and stress conditions. As well as GUS, a number of fluorescent reporter proteins were used in Promoter-reporter constructs including GFP, YFP (yellow fluorescent protein), CFP (cyan fluorescent protein) and anchored variants of YFP such as YFP-LTI6.

Protein Fusions to Fluorescent Tags

To examine sub-cellular localization of TFs, translational fusions to fluorescent markers such as GFP, CFP, and YFP were used.

Dexamethasone Inducible Lines

Glucocorticoid receptor fusions at the N and C termini of the primary TFs were constructed to allow the identification of their immediate/early targets during array-based studies. We also produced dexamethasone inducible lines via a two-component approach.

TABLE 19

Definitions of particular project types

| Project type | Definition |
| --- | --- |
| Direct promoter-fusion (DPF) | A full-length wild-type version of a gene was directly fused to a promoter that drove its expression in transgenic plants. Such a promoter could be the native promoter or that gene, 35S, or a promoter that drove tissue specific or conditional expression. |
| 2-components-supTfn (TCST) | A full-length wild-type version of a gene was expressed via the 2 component, promoter::LexA-GAL4; opLexA::TF system. In this case, a stable transgenic line was first established containing one of the components and was later supertransformed with the second component. |

TABLE 19-continued

Definitions of particular project types

| Project type | Definition |
|---|---|
| splice_variant_* | A splice variant of a gene was directly fused to a promoter that drove its expression in transgenic plants. Such a promoter was the native promoter or that gene, 35S, or a promoter that drove tissue specific or conditional expression. |
| Direct GR-fusion C-term | A construct contained a TF with a direct C-terminal fusion to a glucocorticoid receptor. |
| Direct GR-fusion N-term | A construct contained a TF with a direct N-terminal fusion to a glucocorticoid receptor. |
| Direct GR-fusion HA C-term | A construct contains a TF with a direct C-terminal fusion to a glucocorticoid receptor in combination with an HA (hemagglutinin) epitope tag in the conformation: TF-GR-HA |
| Direct GR-fusion HA N-term | A construct contained a TF with a direct N-terminal fusion to a glucocorticoid receptor in combination with an HA (hemagglutinin) epitope tag in the conformation: GR-TF-HA |
| GAL4 C-term | A TF with a C-terminal fusion to a GAL4 activation domain was overexpressed. |
| GAL4 N-term | A TF with an N-terminal fusion to a GAL4 activation domain was overexpressed. |
| TF dominant negative deletion | A truncated variant or fragment of a TF was (over)expressed, often with the aim of producing a dominant negative phenotype. Usually the truncated version comprised the DNA binding domain |
| TF dom neg deln 2ndry domain | A truncated variant or fragment of a TF was (over)expressed, often with the aim of producing a dominant negative phenotype. In this case, the truncated version contained a conserved secondary domain (rather than the main DNA binding domain) or a secondary DNA binding domain alone, in the case when a TF had two potential binding domains (e.g. B3 & AP2). |
| deletion_* | A variant of a TF was (over)expressed in which one or more regions had been deleted. |
| site-directed mutation_* | A form of the protein was overexpressed which had had one or more residues changed by site directed mutagenesis. |
| domain swap_* | A form of the protein was overexpressed in which a particular fragment had been substituted with a region from another protein. |
| KO | Describes a line that harbored a mutation in an *Arabidopsis* TF at its endogenous locus. In most cases this was caused by a T-DNA insertion. |
| RNAi (clade) | An RNAi construct designed to knock-down a clade of related genes. |
| RNAi (GS) | An RNAi construct designed to knock-down a specific gene. |
| Promoter-reporter | A construct used to determine the expression pattern of a gene, or in transient assay experiments. This was typically a promoter-GUS or promoter-GFP (or a derivative of GFP) fusion. |
| Protein-GFP-C-fusion | Overexpression of a translational fusion in which the TF had GFP fused to the C-terminus. |
| Protein-YFP-C-fusion | Overexpression of a translational fusion in which the TF had YFP fused to the C-terminus. |
| Protein-CFP-C-fusion | Overexpression of a translational fusion in which the TF had CFP fused to the C-terminus. |
| 2-components-supTfn-TAP-C-term | Overexpression of a translational fusion in which the TF had a TAP tag (Tandem affinity purification epitope, see Rigaut et al., 1999 and Rohila et al., 2004) fused to the C-terminus. This fusion was expressed via the two-component system: promoter::LexA-GAL4; opLexA::TF-TAP. In this case, a stable transgenic line was first established containing the promoter component and was later supertransformed with the TF-TAP component). |
| 2-components-supTfn-HA-C-term | Overexpression of a translational fusion in which the TF had an HA (hemagglutinin) epitope tag fused to the C-terminus. This fusion was expressed via the two-component system: promoter::LexA-GAL4; opLexA::TF-HA. In this case, a stable transgenic line was first established containing the promoter component and was later supertransformed with the TF-HA component). |
| 2-components-supTfn-HA-N-term | Overexpression of a translational fusion in which the TF had an HA (hemagglutinin) epitope tag fused to the N-terminus. This fusion was expressed via the two-component system: promoter::LexA-GAL4; opLexA::HA-TF. In this case, a stable transgenic line was first established containing the promoter component and was later supertransformed with the HA-TF component). |
| Double Overexpression (Double OE) Cross | A transgenic line harboring two different overexpression constructs, created by a genetic crossing approach. |
| Triple Overexpression (Triple OE) Cross | A transgenic line harboring three different overexpression constructs, created by a genetic crossing approach. |

*designates any numeric value

Example II. Promoter Analysis

A major component of the program was to determine the effects of ectopic expression of transcription factors in a variety of different tissue types, and in response to the onset of stress conditions. Primarily this was achieved by using a panel of different promoters via a two-component system.

Component 1: Promoter Driver Lines (Promoter::LexA/GAL4).

In each case, the first component (Promoter::LexA/GAL4) comprised a LexA DNA binding domain fused to a GAL4 activation domain, cloned behind the desired promoter. These constructs were contained within vector backbone pMEN48 (Example III) which also carried a kanamycin resistance marker, along with an opLexA::GFP reporter. The GFP was EGFP, an variant available from Clontech (Mountain View, Calif.) with enhanced signal. EGFP is soluble in the cytoplasm. Transgenic "driver lines" were first obtained containing the Promoter::LexA/GAL4 component.

carrying the TF of interest cloned behind a LexA operator site. In each case this second construct carried a sulfonamide selectable marker and was contained within vector backbone pMEN53 (see Example III).

*Arabidopsis* promoter driver lines are shown in Table 20.

TABLE 20

Expression patterns conferred by promoters used for one (i.e., in some 35S overexpressing lines) and two-component studies.

| Promoter | Expression pattern conferred | Reference |
| --- | --- | --- |
| 35S | Constitutive, high levels of expression in all throughout the plant and fruit | Odell et al. (1985) |
| SUC2 | Vascular/Phloem | Truernit and Sauer (1995) |
| ARSK1 | Root | Hwang and Goodman (1995) |
| CUT1 | Shoot epidermal/guard cell enhanced | Kunst et al. (2000) |
| RBCS3 | Photosynthetic tissue; expression predominately in highly photosynthetic vegetative tissues. Fruit expression predominately in the pericarp | Wanner and Gruissem (1991) |
| RD29A* | Drought/Cold/ABA inducible | Yamaguchi-Shinozaki and Shinozaki (1993) |
| LTP1 | Shoot epidermal/trichome enhanced; in vegetative tissues, expression is predominately in the epidermis. Low levels of expression are also evident in vascular tissue. In the fruit, expression is strongest in the pith-like columella/placental tissue | Thoma et al. (1994) |
| RSI1 | Root meristem and root vascular; expression generally limited to roots. Also expressed in the vascular tissues of the fruit. | Taylor and Scheuring (1994) |
| AP1 | Flower primordia/flower; light expression in leaves increases with maturation. Highest expression in flower primordia and flower organs. In fruits, predominately in pith-like columella/placental tissue | Hempel et al. (1997); Mandel et al. (1992) |
| STM | Expressed in meristematic tissues, including apical meristems, cambium. Low levels of expression also in some differentiating tissues. In fruit, most strongly expressed in vascular tissues and endosperm. | Long and Barton (2000); Long et al. (1996) |
| AS1 | Primordia and young organs; expressed predominately in differentiating tissues. In fruit, most strongly expressed in vascular tissues and in endosperm | Byrne et al. (2000) |
| PG | Phytoene desaturase; high expression throughout the fruit, comparable to 35S. Strongest late in fruit development | Nicholass et al. (1995); Montgomery et al. (1993) |
| PD | Phytoene desaturase; moderate expression in fruit tissues | Corona et al. (1996) |
| CRU | Cruciferin 1; expressed at low levels in fruit vascular tissue and columella. Seed and endosperm expression | Breen and Crouch (1992); Sjodahl et al. (1995) |

Notes:
*Two different RD29A promoter lines, lines 2 and 5, were used. Line 2 has a higher level of background expression than line 5. Expression from the line 2 promoter was expected to produce constitutive moderate basal transcript levels of any gene controlled by it, and to generate an increase in levels following the onset of stress. In contrast, line 5 was expected to produce lower basal levels and a somewhat sharper up-regulation of any gene under its control, following the onset of stress. Although RD29A exhibits up-regulation in response to cold and drought in mature tissues, this promoter produces relatively high levels of expression in embryos and young seedlings.

For each promoter driver, a line was selected which showed reproducible expression of the GFP reporter gene in the desired pattern, through a number of generations. We also tested the plants in our standard plate based physiology assays to verify that the tissue specific pattern was not substantially altered by stress conditions. A homozygous population was then established for that line.

Component 2: TF Construct (opLexA::TF).

Having established a promoter panel, it was possible to overexpress any transcription factor in the precise expression pattern conferred by the driver lines, by super-transforming or crossing in a second construct (opLexA::TF)

Validation of the Promoter-Driver Line Patterns.

To demonstrate that each of the promoter driver lines could generate the desired expression pattern of a second component target at an independent locus arranged in trans, crosses were made to an opLexA::GUS line. Typically, it was confirmed that the progeny exhibited GUS activity in an equivalent region to the GFP seen in the parental promoter driver line. However, GFP can move from cell-to-cell early in development and in meristematic tissues, and hence patterns of GFP in these tissues do not strictly report gene expression.

It was clear that the 35S promoter induces much higher levels of expression compared to the other promoters presently in use.

Example III. Vector and Cloning Information

Vector and Cloning Information: Expression Vectors.

A list of nucleic acid constructs (PIDs) included in this application, indicating the promoter fragment that was used to drive the transgene, along with the cloning vector backbone, is provided in the Sequence listing as SEQ ID NOs 3792-5086 and 5102-5106.

Target sequences were selected to be 100 by long or longer. For constructs designed against a clade rather than a single gene, the target sequences had at least 85% identity to all clade members. Where it is not possible to identify a single 100 by sequence with 85% identity to all clade members, hybrid fragments composed of two shorter sequences were used.

Cloning Methods.

*Arabidopsis* transcription factor clones were created in one of three ways: isolation from a library, amplification from cDNA, or amplification from genomic DNA. The ends of the *Arabidopsis* transcription factor coding sequences were generally confirmed by RACE PCR or by comparison with public cDNA sequences before cloning.

Clones of transcription factor orthologs from rice, maize, and soybean were all made by amplification from cDNA. The ends of the coding sequences were predicted based on homology to *Arabidopsis* or by comparison to public and proprietary cDNA sequences; RACE PCR was not done to confirm the ends of the coding sequences. For cDNA amplification, KOD Hot Start DNA Polymerase (Novagen, Madison, Wis.) was used in combination with 1M betaine and 3% DMSO. This protocol was found to be successful in amplifying cDNA from GC-rich species such as rice and corn, along with some non-GC-rich species such as soybean and tomato, where traditional PCR protocols failed. Primers were designed using at least 30 bases specific to the target sequence, and were designed close to, or overlapping, the start and stop codons of the predicted coding sequence.

Clones were fully sequenced. In the case of rice, high-quality public genomic sequences were available for comparison, and clones with sequence changes that result in changes in amino acid sequence of the encoded protein were rejected. For corn and soy, however, it was often unclear whether sequence differences represent an error or polymorphism in the source sequence or a PCR error in the clone. Therefore, in the cases where the sequence of the clone we obtained differed from the source sequence, a second clone was created from an independent PCR reaction. If the sequences of the two clones agreed, then the clone was accepted as a legitimate sequence variant.

Transformation.

*Agrobacterium* strain ABI was used for all plant transformations. This strain is chloramphenicol, kanamycin and gentamicin resistant.

Example IV. Transformation

Transformation of *Arabidopsis* was performed by an *Agrobacterium*-mediated protocol based on the method of Bechtold and Pelletier (1998). Unless otherwise specified, all experimental work was done using the Columbia ecotype.

Plant Preparation.

*Arabidopsis* seeds were sown on mesh covered pots. The seedlings were thinned so that 6-10 evenly spaced plants remained on each pot 10 days after planting. The primary bolts were cut off a week before transformation to break apical dominance and encourage auxiliary shoots to form. Transformation was typically performed at 4-5 weeks after sowing.

Bacterial Culture Preparation.

*Agrobacterium* stocks were inoculated from single colony plates or from glycerol stocks and grown with the appropriate antibiotics and grown until saturation. On the morning of transformation, the saturated cultures were centrifuged and bacterial pellets were re-suspended in Infiltration Media (0.5×MS, 1×B5 Vitamins, 5% sucrose, 1 mg/ml benzylaminopurine riboside, 200 µl/L Silwet L77) until an A600 reading of 0.8 is reached.

Transformation and Seed Harvest.

The *Agrobacterium* solution was poured into dipping containers. All flower buds and rosette leaves of the plants were immersed in this solution for 30 seconds. The plants were laid on their side and wrapped to keep the humidity high. The plants were kept this way overnight at 4° C. and then the pots were turned upright, unwrapped, and moved to the growth racks.

The plants were maintained on the growth rack under 24-hour light until seeds were ready to be harvested. Seeds were harvested when 80% of the siliques of the transformed plants were ripe (approximately 5 weeks after the initial transformation). This seed was deemed T0 seed, since it was obtained from the T0 generation, and was later plated on selection plates (either kanamycin or sulfonamide, see Example VI). Resistant plants that were identified on such selection plates comprised the T1 generation.

Example V. Morphology

*Arabidopsis* is used as a model plant for the study of plant growth and development. In addition to providing ornamental utility, altered morphological or developmental features may affect stress tolerance and ultimately plant quality or yield. For example, alterations to appendages such as hairs and trichomes, stomata, and the deposition of waxes may enhance a plant's ability to take up nutrients or resist disease or pathogens. Dark color may also contribute to oxidative stress tolerance or enhanced photosynthetic capacity, which in turn could result in yield increases.

Thus, morphological analysis was performed to determine whether changes in transcription factor levels affect plant growth and development. This was primarily carried out on the T1 generation, when at least 10-20 independent lines were examined. However, in cases where a phenotype required confirmation or detailed characterization, plants from subsequent generations were also analyzed.

Primary transformants were typically selected on MS medium with 0.3% sucrose and 50 mg/l kanamycin. T2 and later generation plants were selected in the same manner, except that kanamycin was used at 35 mg/l. In cases where lines carry a sulfonamide marker (as in all lines generated by supertransformation), seeds were selected on MS medium with 0.3% sucrose and 1.5 mg/l sulfonamide KO lines were usually germinated on plates without a selection. Seeds were cold-treated (stratified) on plates for 3 days in the dark (in order to increase germination efficiency) prior to transfer to growth cabinets. Initially, plates were incubated at 22° C. under a light intensity of approximately 100 microEinsteins for 7 days. At this stage, transformants were green, possessed the first two true leaves, and were easily distinguished from bleached kanamycin or sulfonamide-susceptible seedlings. Resistant seedlings were then transferred onto soil (Sunshine potting mix). Following transfer to soil, trays of seedlings were covered with plastic lids for 2-3 days to maintain humidity while they became established. Plants were grown on soil under fluorescent light at an intensity of 70-95 microEinsteins and a temperature of 18-23° C. Light conditions consisted of a 24-hour photoperiod unless otherwise stated. In instances where alterations in flowering time was apparent, flowering was typically re-examined under both 12-hour and 24-hour light to assess whether the phenotype was photoperiod dependent. Under our 24-hour light growth conditions, the typical generation time (seed to seed) was approximately 14 weeks.

Because many aspects of Arabidopsis development are dependent on localized environmental conditions, in all cases plants were evaluated in comparison to controls in the same flat. As noted below, controls for transgenic lines were wild-type plants, plants overexpressing CBF4, or transgenic plants harboring an empty transformation vector selected on kanamycin or sulfonamide. Careful examination was made at the following stages: seedling (1 week), rosette (2-3 weeks), flowering (4-7 weeks), and late seed set (8-12 weeks). Seed was also inspected. Seedling morphology was assessed on selection plates. At all other stages, plants were macroscopically evaluated while growing on soil. All significant differences (including alterations in growth rate, size, leaf and flower morphology, coloration and flowering time) were recorded, but routine measurements were not be taken if no differences were apparent. In certain cases, stem sections were stained to reveal lignin distribution. In these instances, hand-sectioned stems were mounted in phloroglucinol saturated 2M HCl (which stains lignin pink) and viewed immediately under a dissection microscope.

Note that for a given project (gene-promoter combination, GAL4 fusion lines, RNAi lines etc.), ten lines were typically examined in subsequent plate based physiology assays.

Example VI. Physiology Experimental Methods

Plate Assays.

Twelve different plate-based physiological assays (shown below), representing a variety of drought-stress related conditions, were used as a pre-screen to identify top performing lines from each project (i.e. lines from transformation with a particular construct), that may be tested in subsequent soil based assays. Typically, ten lines were subjected to plate assays, from which the best three lines were selected for subsequent soil based assays. However, in projects where significant stress tolerance was not obtained in plate based assays, lines were not submitted for soil assays.

In addition, transgenic lines were subjected to nutrient limitation studies. A nutrient limitation assay was intended to find genes that allow more plant growth upon deprivation of nitrogen. Nitrogen is a major nutrient affecting plant growth and development that ultimately impacts yield and stress tolerance. These assays monitor primarily root but also rosette growth on nitrogen deficient media. In all higher plants, inorganic nitrogen is first assimilated into glutamate, glutamine, aspartate and asparagine, the four amino acids used to transport assimilated nitrogen from sources (e.g. leaves) to sinks (e.g. developing seeds). This process is regulated by light, as well as by C/N metabolic status of the plant. We used a C/N sensing assay to look for alterations in the mechanisms plants use to sense internal levels of carbon and nitrogen metabolites which could activate signal transduction cascades that regulate the transcription of N-assimilatory genes. To determine whether these mechanisms are altered, we exploited the observation that wild-type plants grown on media containing high levels of sucrose (3%) without a nitrogen source accumulate high levels of anthocyanins. This sucrose induced anthocyanin accumulation can be relieved by the addition of either inorganic or organic nitrogen. We used glutamine as a nitrogen source since it also serves as a compound used to transport N in plants.

G1792 and N

The performance of two G1792-overexpressing lines, G1792-311-9 and G1792-312-8, was examined under limited nitrogen growth conditions. Plants were grown in pots filled with fritted clay, sub-irrigated every two hours with a hydroponic growth solution containing 0.1 mM ammonium nitrate as the sole nitrogen source. These conditions represent nitrogen-limited conditions for Arabidopsis growth. Plants were harvested at the rosette stage after 7 weeks of growth under 10 hour light. Chlorophyll content was measured with a SPAD meter, fresh weight was determined, and percent total nitrogen content was determined by dry combustion (Micro-Dumas combustion analysis). As shown in Table 20 provided below, the two G1792 lines were found to have higher chlorophyll content and total nitrogen concentration. One line produced significantly less biomass than controls.

Germination Assays.

NaCl (150 mM), mannitol (300 mM), glucose (5%), sucrose (9.4%), PEG (10%, with Phytogel as gelling agent), ABA (0.3 µM), Heat (32° C.), Cold (8° C.), —N is basal media minus nitrogen plus 3% sucrose and –N/+Gln is basal media minus nitrogen plus 3% sucrose and 1 mM glutamine. In addition to being stresses in their own right, salt, mannitol, heat, PEG and high sugar concentrations (e.g., 9.4% sucrose, 300 mM mannitol, 5% glucose), may contribute to hyperosmotic stress in plants and may also be used to assess tolerance to water deficit.

Growth Assays.

Growth assays consisted of water deficit assays, including severe dehydration assays such as desiccation (plate-based drought assays), or heat (32° C. for 5 days followed by recovery at 22° C.), chilling (8° C.), root development (visual assessment of lateral and primary roots, root hairs and overall growth). For the nitrogen limitation assay, all components of MS medium remained constant except nitrogen was reduced to 20 mg/L of $NH_4NO_3$. Note that 80% MS had 1.32 g/L $NH_4NO_3$ and 1.52 g/L $KNO_3$.

Unless otherwise stated, all experiments were performed with the Arabidopsis thaliana ecotype Columbia (col-0). Assays were usually performed on non-selected segregating T2 populations (in order to avoid the extra stress of selection). Control plants for assays on lines containing direct promoter-fusion constructs were Col-0 plants transformed an empty transformation vector (pMEN65). Controls for 2-component lines (generated by supertransformation) were the background promoter-driver lines (i.e. promoter::LexA-GAL4TA lines), into which the supertransformations were initially performed.

All assays were performed in tissue culture. Growing the plants under controlled temperature and humidity on sterile medium produced uniform plant material that had not been exposed to additional stresses (such as water stress) which could cause variability in the results obtained. All assays were designed to detect plants that were more tolerant or less tolerant to the particular stress condition and were developed with reference to the following publications: Jang et al. (1997), Smeekens (1998), Liu and Zhu (1997), Saleki et al. (1993), Wu et al. (1996), Zhu et al. (1998), Alia et al. (1998), Xin and Browse, (1998), Leon-Kloosterziel et al. (1996). Where possible, assay conditions were originally tested in a blind experiment with controls that had phenotypes related to the condition tested.

Procedures

Prior to plating, seed for all experiments were surface sterilized in the following manner: (1) 5 minute incubation with mixing in 70% ethanol, (2) 20 minute incubation with mixing in 30% bleach, 0.01% triton-X 100, (3) 5× rinses with sterile water, (4) Seeds were re-suspended in 0.1% sterile agarose and stratified at 4° C. for 3-4 days.

All germination assays follow modifications of the same basic protocol. Sterile seeds were sown on the conditional media that had a basal composition of 80% MS+Vitamins. Plates were incubated at 22° C. under 24-hour light (120-130 $\mu E\ m^{-2}\ s^{-1}$) in a growth chamber. Evaluation of germination and seedling vigor was performed 5 days after planting. For assessment of root development, seedlings germinated on 80% MS+Vitamins+1% sucrose were transferred to square plates at 7 days. Evaluation was done 5 days after transfer following growth in a vertical position. Qualitative differences were recorded including lateral and primary root length, root hair number and length, and overall growth.

For chilling (8° C.) and heat sensitivity (32° C.) growth assays, seeds were germinated and grown for 7 days on MS+Vitamins+1% sucrose at 22° C. and then were transferred to chilling or heat stress conditions. Heat stress was applied for 5 days, after which the plants were transferred back to 22° C. for recovery and evaluated after a further 5 days. Plants were subjected to chilling conditions (8° C.) and evaluated at 10 days and 17 days.

For plate-based severe dehydration assays (sometimes referred to as desiccation assays), seedlings were grown for 14 days on MS+Vitamins+1% Sucrose at 22° C. Plates were opened in the sterile hood for 3 hr for hardening and then seedlings were removed from the media and dried for 2 h in the hood. After this time they were transferred back to plates and incubated at 22° C. for recovery. Plants were evaluated after another 5 days.

Data Interpretation

At the time of evaluation, plants were given one of the following scores:

(++) Substantially enhanced performance compared to controls. The phenotype was very consistent and growth was significantly above the normal levels of variability observed for that assay.
(+) Enhanced performance compared to controls. The response was consistent but was only moderately above the normal levels of variability observed for that assay.
(wt) No detectable difference from wild-type controls.
(−) Impaired performance compared to controls. The response was consistent but was only moderately above the normal levels of variability observed for that assay.
(−−) Substantially impaired performance compared to controls. The phenotype was consistent and growth was significantly above the normal levels of variability observed for that assay.
(n/d) Experiment failed, data not obtained, or assay not performed.

Example VII. Soil Drought (Clay Pot)

The soil drought assay (performed in clay pots) was based on that described by Haake et al. (2002).

Experimental Procedure.

Previously, we performed clay-pot assays on segregating T2 populations, sown directly to soil. However, in the current procedure, seedlings were first germinated on selection plates containing either kanamycin or sulfonamide.

Seeds were sterilized by a 2 minute ethanol treatment followed by 20 minutes in 30% bleach/0.01% Tween and five washes in distilled water. Seeds were sown to MS agar in 0.1% agarose and stratified for 3 days at 4° C., before transfer to growth cabinets with a temperature of 22° C. After 7 days of growth on selection plates, seedlings were transplanted to 3.5 inch diameter clay pots containing 80 g of a 50:50 mix of vermiculite:perlite topped with 80 g of ProMix. Typically, each pot contains 14 seedlings, and plants of the transgenic line being tested were in separate pots to the wild-type controls. Pots containing the transgenic line versus control pots were interspersed in the growth room, maintained under 24-hour light conditions (18-23° C., and 90-100 $\mu E\ m^{-2}\ s^{-1}$) and watered for a period of 14 days. Water was then withheld and pots were placed on absorbent paper for a period of 8-10 days to apply a drought treatment. After this period, a visual qualitative "drought score" from 0-6 was assigned to record the extent of visible drought stress symptoms. A score of "6" corresponded to no visible symptoms whereas a score of "0" corresponded to extreme wilting and the leaves having a "crispy" texture. At the end of the drought period, pots were re-watered and scored after 5-6 days; the number of surviving plants in each pot was counted, and the proportion of the total plants in the pot that survived was calculated.

Split-Pot Method.

A variation of the above method was sometimes used, whereby plants for a given transgenic line were compared to wild-type controls in the same pot. For those studies, 7 wild-type seedlings were transplanted into one half of a 3.5 inch pot and 7 seedlings of the line being tested were transplanted into the other half of the pot.

Analysis of Results.

In a given experiment, we typically compared six or more pots of a transgenic line with 6 or more pots of the appropriate control. (In the split pot method, 12 or more pots were used.) The mean drought score and mean proportion of plants surviving (survival rate) were calculated for both the transgenic line and the wild-type pots. In each case a p-value* was calculated, which indicated the significance of the difference between the two mean values. The results for each transgenic line across each planting for a particular project were then presented in a results table.

Calculation of p-Values.

For the assays where control and experimental plants were in separate pots, survival was analyzed with a logistic regression to account for the fact that the random variable was a proportion between 0 and 1. The reported p-value was the significance of the experimental proportion contrasted to the control, based upon regressing the logit-transformed data.

Drought score, being an ordered factor with no real numeric meaning, was analyzed with a non-parametric test between the experimental and control groups. The p-value was calculated with a Mann-Whitney rank-sum test.

For the split-pot assays, matched control and experimental measurements were available for both variables. In lieu of a direct transformed regression technique for these data, the logit-transformed proportions were analyzed by parametric methods. The p-value was derived from a paired-t-test on the transformed data. For the paired score data, the p-value from a Wilcoxon test was reported.

Example VIII. Soil Drought (Single Pot)

These experiments determined the physiological basis for the drought tolerance conferred by each lead and were typically performed under soil grown conditions. Usually, the experiment was performed under photoperiodic conditions of 10-hr or 12-hr light. Where possible, a given project (gene/promoter combination or protein variant) was represented by three independent lines. Plants were usually at late vegetative/early reproductive stage at the time measurements were taken. Typically we assayed three different states: a well-watered state, a mild-drought state and a moderately severe drought state. In each case, we made comparisons to wild-type plants with the same degree of physical stress symptoms (wilting). To achieve this, staggered samplings were often required. Typically, for a given line, ten individual plants were assayed for each state.

The following physiological parameters were routinely measured: relative water content, ABA content, proline content, and photosynthesis rate. In some cases, measurements of chlorophyll levels, starch levels, carotenoid levels, and chlorophyll fluorescence were also made.

Analysis of Results.

In a given experiment, for a particular parameter, we typically compared about 10 samples from a given transgenic line with about 10 samples of the appropriate wild-type control at each drought state. The mean values for each physiological parameter were calculated for both the transgenic line and the wild-type pots. In each case, a P-value (calculated via a simple t-test) was determined, which indicated the significance of the difference between the two mean values. The results for each transgenic line across each planting for a particular project were then presented in a results table.

A typical procedure is described below; this corresponds to method used for the drought time-course experiment which we performed on wild-type plants during our baseline studies at the outset of the drought program.

Procedure.

Seeds were stratified for 3 days at 4° C. in 0.1% agarose and sown on Metromix 200 in 2.25 inch pots (square or round). Plants were maintained in individual pots within flats grown under short days (10:14 L:D). Seedlings were watered as needed to maintain healthy plant growth and development. At 7 to 8 weeks after planting, plants were used in drought experiments.

Plants matched for equivalent growth development (rosette size) were removed from plastic flats and placed on absorbent paper. Pots containing plants used as well-watered controls were placed within a weigh boat and the dish placed on the absorbent paper. The purpose of the weigh boat was to retain any water that might leak from well-watered pots and affect pots containing plants undergoing the drought stress treatment.

On each day of sampling, up to 18 droughted plants and 6 well-watered controls (from each transgenic line) were picked from a randomly generated pool (given that they passed quality control standards). Biochemical analysis for photosynthesis, ABA, and proline was performed on the next three youngest, most fully expanded leaves. Relative water content was analyzed using the remaining rosette tissue.

Example IX. Soil Drought (Biochemical and Physiological Assays)

Background.

The purpose of these measurements was to determine the physiological state of plants in soil drought experiments.

Measurement of Photosynthesis.

Photosynthesis was measured using a LICOR LI-6400. The LI-6400 uses infrared gas analyzers to measure carbon dioxide to generate a photosynthesis measurement. This method is based upon the difference of the $CO_2$ reference (the amount put into the chamber) and the $CO_2$ sample (the amount that leaves the chamber). Since photosynthesis is the process of converting $CO_2$ to carbohydrates, we expected to see a decrease in the amount of $CO_2$ sample. From this difference, a photosynthesis rate can be generated. In some cases, respiration may occur and an increase in $CO_2$ detected. To perform measurements, the LI-6400 was set-up and calibrated as per LI-6400 standard directions. Photosynthesis was measured in the youngest most fully expanded leaf at 300 and 1000 ppm $CO_2$ using a metal halide light source. This light source provided about 700 $\mu E$ $m^{-2}$ $s^{-1}$.

Fluorescence was measured in dark and light adapted leaves using either a LI-6400 (LICOR) with a leaf chamber fluorometer attachment or an OS-1 (Opti-Sciences, Hudson, N.H.) as described in the manufacturer's literature. When the LI-6400 was used, all manipulations were performed under a dark shade cloth. Plants were dark adapted by placing in a box under this shade cloth until used. The OS-30 utilized small clips to create dark adapted leaves.

Measurement of Abscisic Acid and Proline.

The purpose of this experiment was to measure ABA and proline in plant tissue. ABA is a plant hormone believed to be involved in stress responses and proline is an osmoprotectant.

Three of the youngest, most fully expanded mature leaves were harvested, frozen in liquid nitrogen, lyophilized, and a dry weight measurement taken. Plant tissue was then homogenized in methanol to which 500 ng of d6-ABA had been added to act as an internal standard. The homogenate was filtered to removed plant material and the filtrate evaporated to a small volume. To this crude extract, approximately 3 ml of 1% acetic acid was added and the extract was further evaporated to remove any remaining methanol. The volume of the remaining aqueous extract was measured and a small aliquot (usually 200 to 500 µl) removed for proline analysis (Protocol described below). The remaining extract was then partitioned twice against ether, the ether removed by evaporation and the residue methylated using ethereal diazomethane. Following removal of any unreacted diazomethane, the residue was dissolved in 100 to 200 µl ethyl acetate and analyzed by gas chromatography-mass spectrometry. Analysis was performed using an HP 6890 GC coupled to an HP 5973 MSD using a DB-5 ms gas capillary column. Column pressure was 20 psi. Initially, the oven temperature was 150° C. Following injection, the oven was heated at 5° C./min to a final temperature of 250° C. ABA levels were estimated using an isotope dilution equation and normalized to tissue dry weight.

Free proline content was measured according to Bates (Bates et al., 1973). The crude aqueous extract obtained above was brought up to a final volume of 500 µl using distilled water. Subsequently, 500 µl of glacial acetic was added followed by 500 µl of Chinard's Ninhydrin. The samples were then heated at 95 to 100° C. for 1 hour. After this incubation period, samples were cooled and 1.5 ml of toluene were added. The upper toluene phase was removed and absorbance measured at 515 nm. Amounts of proline were estimated using a standard curve generated using L-proline and normalized to tissue dry weight.

[n.b. Chinard's Ninhydrin was prepared by dissolving 2.5 g ninhydrin (triketohydrindene hydrate) in 60 ml glacial acetic acid at 70° C. to which 40 ml of 6 M phosphoric acid was added.]

Measurement of Relative Water Content (RWC).

Relative Water Content (RWC) indicates the amount of water that is stored within the plant tissue at any given time. It was obtained by taking the field weight of the rosette minus the dry weight of the plant material and dividing by the weight of the rosette saturated with water minus the dry weight of the plant material. The resulting RWC value can be compared from plant to plant, regardless of plant size.

$$\text{Relative Water Content} = \frac{\text{Field Weight} - \text{Dry Weight}}{\text{Turgid Weight} - \text{Dry Weight}} \times 100$$

After tissue had been removed for array and ABA/proline analysis, the rosette was cut from the roots using a small pair of scissors. The field weight was obtained by weighing the rosette. The rosette was then immersed in cold water and placed in an ice water bath in the dark. The purpose of this was to allow the plant tissue to take up water while preventing any metabolism which could alter the level of small molecules within the cell. The next day, the rosette was carefully removed, blotted dry with tissue paper, and weighed to obtain the turgid weight. Tissue was then frozen, lyophilized, and weighed to obtain the dry weight.

Starch Determination.

Starch was estimated using a simple iodine based staining procedure. Young, fully expanded leaves were harvested either at the end or beginning of a 12 h light period and placed in tubes containing 80% ethanol or 100% methanol. Leaves were decolorized by incubating tubes in a 70 to 80 C water bath until chlorophyll had been removed from leaf tissue. Leaves were then immersed in water to displace any residual methanol which may be present in the tissue. Starch was then stained by incubating leaves in an iodine stain (2 g KI, 1 g $I_2$ in 100 ml water) for one min and then washing with copious amounts of water. Tissue containing large amounts of starch stained dark blue or black; tissues depleted in starch were colorless.

Chlorophyll/Carotenoid Determination.

For some experiments, chlorophyll was estimated in methanolic extracts using the method of Porra et al. (1989). Carotenoids were estimated in the same extract at 450 nm using an A(1%) of 2500. Chlorophyll was measured with a SPAD-502 (Minolta). Both carotenoid and chlorophyll content and amount could also be determined via HPLC. In this procedure pigments were extracted from leave tissue by homogenizing leaves in acetone:ethyl acetate (3:2). Water was added, the mixture centrifuged, and the upper phase removed for HPLC analysis. Samples were analyzed using a Zorbax C18 (non-endcapped) column (250×4.6) with a gradient of acetonitrile:water (85:15) to acetonitrile:methanol (85:15) in 12.5 minutes. After holding at these conditions for two minutes, solvent conditions were changed to methanol:ethyl acetate (68:32) in two minutes. Carotenoids and chlorophylls were quantified using peak areas and response factors calculated using lutein and beta-carotene as standards.

Quantification of Protein Level.

Protein level quantification was performed for 35S::G481 and related projects. Plants were plated on selective MS media, and transplanted to vertical MS plates after one week of growth. After 17 days of growth (24 h light, 22 C), tissues were harvested from the vertical plates. The shoot tissue from 1 plant was harvested as one biological replicate for each line, and the root tissue from 2 plants were combined as 1 biological replicate. For each line analyzed, two biological replicates each of shoot and root tissue were analyzed. Whole cell protein extracts were prepared in a 96 well format and separated on a 4-20% SDS-PAGE gel, transferred to PVDF membrane for western blotting, and probed with a 1:2000 dilution of anti-G481 antibody in a 1% blocking solution in TBS-T. Protein levels for various samples were estimated by setting a level of one for pMEN65 wild type and three for line G481-6 to describe the amount of G481 protein visible on the blot. The protein level for each of the other lines tested was visually estimated on each blot relative to the pMEN65 and G481-6 standards.

Nuclear and Cytoplasmically-Enriched Fractions.

We developed a platform to prepare nuclear and cytoplasmic protein extracts in a 96-well format using a tungsten carbide beads for cell disruption in a mild detergent and a sucrose cushion to separate cytoplasmic from nuclear fractions. We used histone antibodies to demonstrate that this method effectively separated cytoplasmic from nuclear-enriched fractions. An alternate method (spun only) used the same disruption procedure, but simply pelleted the nuclei to separate them from the cytoplasm without the added purification of a sucrose cushion.

Quantification of mRNA Level.

Three shoot and three root biological replicates were typically harvested for each line, as described above in the protein quantification methods section. RNA was prepared using a 96-well format protocol, and cDNA synthesized from each sample. These preparations were used as templates for RT-PCR experiments. We measured the levels of transcript for a gene of interest (such as G481) relative to 18S RNA transcript for each sample using an ABI 7900 Real-Time RT-PCR machine with SYBR Green technology.

Phenotypic Analysis: Flowering Time.

Plants were grown in soil. Flowering time was determined based on either or both of (i) number to days after planting to the first visible flower bud. (ii) the total number of leaves (rosette or rosette plus cauline) produced by the primary shoot meristem.

Phenotypic Analysis: Heat Stress.

In preliminary experiments described in this report, plants were germinated growth chamber at 30 C with 24 h light for 11 d. Plants were allowed to recover in 22 C with 24 h light for three days, and photographs were taken to record health after the treatment. In a second experiment, seedlings were grown at 22 C for four days on selective media, and the plates transferred to 32 C for one week. They were then allowed to recover at 22 C for three days. Forty plants from two separate plates were harvested for each line, and both fresh weight and chlorophyll content measured.

Phenotypic Analysis: Dark-Induced Senescence.

In preliminary experiments described in this report, plants were grown on soil for 27-30 days in 12 h light at 22 C. They were moved to a dark chamber at 22 C, and visually evaluated for senescence after 10-13 days. In some cases we used Fv/Fm as a measure of chlorophyll (Pourtau et al., 2004) on the youngest most fully-expanded leaf on each plant. The Fv/Fm mean for the 12 plants from each line was normalized to the Fv/Fm mean for the 12 matched controls.

VARIOUS DEFINITIONS USED IN THIS REPORT

RWC=Relative water content (field wt.–dry weight)/(turgid wt.–dry wt.)×100
ABA=Abscisic acid, μg/gdw
Proline=Proline, μmole/gdw A 300=net assimilation rate, μmole $CO_2/m^2/s$ at 300 ppm $CO_2$
A 1000=net assimilation rate, μmole $CO_2/m^2/s$ at 1000 ppm $CO_2$
Chl SPAD=Chlorophyll estimated by a Minolta SPAD-502, ratio of 650 nm to 940 nm
Total Chl=mg/gfw, estimated by HPLC
Carot=mg/gfw, estimated by HPLC
Fo=minimal fluorescence of a dark adapted leaf
Fm=maximal fluorescence of a dark adapted leaf
Fo'=minimal fluorescence of a light adapted leaf
Fm'=maximal fluorescence of a light adapted leaf
Fs=steady state fluorescence of a light adapted leaf
Psi if =water potential (Mpa) of a leaf
Psi p=turgor potential (Mpa) of a leaf
Psi pi=osmotic potential (Mpa) of a leaf
Fv/Fm=(Fm−Fo)/Fm; maximum quantum yield of PSII
Fv'/Fm'=(Fm'−Fo')/Fm'; efficiency of energy harvesting by open PSII reaction centers
PhiPS2=(Fm'−Fs)/Fm', actual quantum yield of PSII
ETR=PhiPS2×light intensity absorbed×0.5; we use 100 μE/$m^2$/s for an average light intensity and 85% as the amount of light absorbed
qP=(Fm'−Fs)/(Fm'−Fo'); photochemical quenching (includes photosynthesis and photorespiration); proportion of open PSII
qN=(Fm−Fm')/(Fm−Fo'); non-photochemical quenching (includes mechanisms like heat dissipation)
NPQ=(Fm−Fm')/Fm'; non-photochemical quenching (includes mechanisms like heat dissipation)

Example X. Disease Physiology, Plate Assays

Overview.

A *Sclerotinia* plate-based assay was used as a pre-screen to identify top performing lines from each project (i.e., lines from transformation with a particular construct) that could be tested in subsequent soil-based assays. Top performing lines were also subjected to *Botrytis cinerea* plate assays as noted. Typically, eight lines were subjected to plate assays, from which the best lines were selected for subsequent soil-based assays. In projects where significant pathogen resistance was not obtained in plate based assays, lines were not submitted for soil assays.

Unless otherwise stated, all experiments were performed with the *Arabidopsis thaliana* ecotype Columbia (Col-0). Similar assays could be devised for other crop plants such as soybean or maize plants. Assays were usually performed on non-selected segregating T2 populations (in order to avoid the extra stress of selection). Control plants for assays on lines containing direct promoter-fusion constructs were wild-type plants or Col-0 plants transformed an empty transformation vector (pMEN65). Controls for 2-component lines (generated by supertransformation) were the background promoter-driver lines (i.e. promoter::LexA-GAL4TA lines), into which the supertransformations were initially performed.

Procedures.

Prior to plating, seed for all experiments were surface sterilized in the following manner: (1) 5 minute incubation with mixing in 70% ethanol; (2) 20 minute incubation with mixing in 30% bleach, 0.01% Triton X-100; (3) five rinses with sterile water. Seeds were resuspended in 0.1% sterile agarose and stratified at 4° C. for 2-4 days.

Sterile seeds were sown on starter plates (15 mm deep) containing the following medium: 50% MS solution, 1% sucrose, 0.05% MES, and 1% Bacto-Agar. 40 to 50 seeds were sown on each plate. Plates were incubated at 22° C. under 24-hour light (95-110 μE $m^{-2}$ $s^{-1}$) in a germination growth chamber. On day 10, seedlings were transferred to assay plates (25 mm deep plates with medium minus sucrose). Each assay plate had nine test seedlings and nine control seedlings on separate halves of the plate. Three or four plates were used per line, per pathogen. On day 14, seedlings were inoculated (specific methods below). After inoculation, plates were put in a growth chamber under a 12-hour light/12-hour dark schedule. Light intensity was lowered to 70-80 μE $m^{-2}$ $s^{-1}$ for the disease assay. Disease symptoms were evaluated starting four days post-inoculation (DPI) up to 10 DPI if necessary. For each plate, the number of dead test plants and control plants were counted. Plants were scored as "dead" if the center of the rosette collapsed (usually brown or water-soaked).

*Sclerotinia* Inoculum Preparation.

A *Sclerotinia* liquid culture was started three days prior to plant inoculation by cutting a small agar plug (¼ sq. inch) from a 14- to 21-day old *Sclerotinia* plate (on Potato Dextrose Agar; PDA) and placing it into 100 ml of half-strength Potato Dextrose Broth (PDB). The culture was allowed to grown in the PDB at room temperature under 24-hour light for three days. On the day of seedling inoculation, the hyphal ball was retrieved from the medium, weighed, and ground in a blender with water (50 ml/gm tissue). After grinding, the mycelial suspension was filtered through two layers of cheesecloth and the resulting suspension was diluted 1:5 in water. Plants were inoculated by spraying to run-off with the mycelial suspension using a Preval aerosol sprayer.

*Botrytis* Inoculum Preparation.

*Botrytis* inoculum was prepared on the day of inoculation. Spores from a 14- to 21-day old plate were resuspended in a solution of 0.05% glucose, 0.03M $KH_2PO_4$ to a final concentration of $10^4$ spores/ml. Seedlings were inoculated with a Preval aerosol sprayer, as with *Sclerotinia* inoculation.

Data Interpretation.

After the plates were evaluated, each line was given one of the following qualitative scores:
(++) Substantially enhanced resistance compared to controls. The phenotype was very consistent across all plates for a given line.
(+) Enhanced resistance compared to controls. The response was consistent but was only moderately above the normal levels of variability observed for that assay.
(wt) No detectable difference from wild-type controls.
(−) Increased susceptibility compared to controls. The response was consistent but was only moderately above the normal levels of variability observed for that assay.
(−−) Substantially impaired performance compared to controls. The phenotype was consistent and growth was significantly above the normal levels of variability observed for that assay.
(n/d) Experiment failed, data not obtained, or assay not performed.

Example XI. Disease Physiology, Soil Assays

Overview.

Lines from transformation with a particular construct were tested in a soil-based assay for resistance to powdery mildew (*Erysiphe cichoracearum*) as noted below. Typically, eight lines per project were subjected to the *Erysiphe* assay.

Unless otherwise stated, all experiments were performed with the *Arabidopsis thaliana* ecotype Columbia (Col-0). Assays were usually performed on non-selected segregating T2 populations (in order to avoid the extra stress of selection). Control plants for assays on lines containing direct promoter-fusion constructs were wild-type plants or Col-0 plants transformed an empty transformation vector (pMEN65). Controls for 2-component lines (generated by supertransformation) were the background promoter-driver lines (i.e. promoter::LexA-GAL4TA lines), into which the supertransformations were initially performed.

In addition, positive hits from the *Sclerotinia* plate assay were subjected to a soil-based *Sclerotinia* assay as noted. This assay was based on hyphal plug inoculation of rosette leaves.

Procedures.

*Erysiphe* inoculum was propagated on a pad4 mutant line in the Col-0 background, which is highly susceptible to *Erysiphe* (Reuber et al., 1998). The inoculum was maintained by using a small paintbrush to dust conidia from a 2-3 week old culture onto new plants (generally three weeks old). For the assay, seedlings were grown on plates for one week under 24-hour light in a germination chamber, then transplanted to soil and grown in a walk-in growth chamber under a 12-hour light/12-hour dark light regimen, 70% humidity. Each line was transplanted to two 13 cm square pots, nine plants per pot. In addition, three control plants were transplanted to each pot for direct comparison with the test line. Approximately 3.5 weeks after transplanting, plants were inoculated using settling towers as described by Reuber et al. (1998). Generally, three to four heavily infested leaves were used per pot for the disease assay. The level of fungal growth was evaluated eight to ten days after inoculation.

Data Interpretation.

After the pots were evaluated, each line was given one of the following overall scores:

(+++) Highly enhanced resistance as compared to controls. The phenotype was very consistent.

(++) Substantially enhanced resistance compared to controls. The phenotype was very consistent in both pots for a given line.

(+) Enhanced resistance compared to controls. The response was consistent but was only moderately above the normal levels of variability observed.

(wt) No detectable difference from wild-type controls.

(−) Increased susceptibility compared to controls. The response was consistent but was only moderately above the normal levels of variability observed.

(−−) Substantially impaired performance compared to controls. The phenotype was consistent and growth was significantly above the normal levels of variability observed.

(n/d) Experiment failed, data not obtained, or assay not performed.

Example XII. Experimental Results

This application provides experimental observations for a number of transcription factors for improved yield and/or increased tolerance to abiotic stresses such as water deficit-related tolerance, low nutrient tolerance, cold tolerance (for example, G481, G867, G1073, G28, G47, G1274, G1792, G1988, and G1760, (SEQ ID NOs: 10, 550, 16, 18, 2, 6, 20, 24, 1794, 1836, 30, 178, 690, 22, and 1336, respectively), two transcription factors for disease resistance (G28, SEQ ID NO: 2, and G1792, SEQ ID NO: 24), and, for each of these transcription factors, a number of phylogenetically and closely related homologs derived from diverse gene sequences. A set of polynucleotides and polypeptides related to each lead transcription factor has been designated as a "study group" and related sequences in these clades have been subsequently analyzed using morphological and phenotypic studies.

Phenotypic Screens: Promoter Combinations.

A panel of promoters was assembled based on domains of expression that had been well characterized in the published literature. These were chosen to represent broad non-constitutive patterns which covered the major organs and tissues of the plant. The following domain-specific promoters were picked, each of which drives expression in a particular tissue or cell-type: ARSK1 (root), RBCS3 (photosynthetic tissue, including leaf tissue), CUT1 (shoot epidermal, guard-cell enhanced), SUC2 (vascular), STM (apical meristem and mature-organ enhanced), AP1 (floral meristem enhanced), AS1 (young organ primordia) and RSI1 (young seedlings, and roots). Also selected was a stress inducible promoter, RD29A, which is able to up-regulate a transgene at drought onset.

The basic strategy was to test each polynucleotide with each promoter to give insight into the following questions: (i) mechanistically, in which part of the plant is activity of the polynucleotide sufficient to produce stress tolerance? (ii) Can we identify expression patterns which produce compelling stress tolerance while eliminating any undesirable effects on growth and development? (iii) Does a particular promoter give an enhanced or equivalent stress tolerance phenotype relative to constitutive expression? Each of the promoters in this panel is considered to be representative of a particular pattern of expression; thus, for example, if a particular promoter such as SUC2, which drives expression in vascular tissue, yields a positive result with a particular transcription factor gene, it would be predicted and expected that a positive result would be obtained with any other promoter that drives the same vascular pattern.

We now have many examples demonstrating the principle that use of a regulated promoter can confer substantial stress tolerance while minimizing deleterious effects. For example, the results from regulating G1792-related genes using regional specific promoters were especially persuasive. When overexpressed constitutively, these genes produced extreme dwarfing. However, when non-constitutive promoters were used to express these sequences ectopically, off-types were substantially ameliorated, and strong disease tolerance was still obtained (for example, with RBCS3::G1792 and RBCS3::G1795 lines).

Additionally, it is feasible to identify promoters which afford high levels of inducible expression. For instance, a major tactic in the disease program is to utilize pathogen inducible promoters; a set of these has now been identified for testing with each of the disease-resistance conferring transcription factors. This approach is expected to be productive as we have shown that inducible expression of G1792 via the dexamethasone system gives effective disease tolerance without off-types. By analogy, it would be useful to take a similar approach for the drought tolerance trait. So far the only drought regulated promoter that we have tested is RD29A, since its utility had been published (Kasuga et al., 1999).

Phenotypic Screens: effects of protein variants for distinct transcription factors. The effects of overexpressing a variety of different types of protein variants including: deletion variants, GAL4 fusions, variants with specific residues mutagenized, and forms in which domains were swapped with other proteins, have been examined Together, these approaches have been informative, and have helped illuminate the role of specific residues (see for example, the site-directed mutagenesis experiments for G1274 or G1792), as well as giving new clues as to the basis of particular phenotypes. For example, overexpression lines for a G481 deletion variant exhibited drought tolerance, suggesting that the G481 drought phenotype might arise from dominant negative type interactions.

Phenotypic Screens: Knockout and Knock-Down Approaches.

Thus far, both T-DNA alleles and RNAi methods have been used to isolate knockouts/knockdown lines for transcription factors of interest. In general, it was determined that the knockout (KO) approach to be more informative and easier to interpret than RNAi based strategies. In particular, RNAi approaches are hampered by the possibility that other related transcription factors might be directly or indirectly knocked-down (even when using a putative gene-specific construct). Thus, a set of RNAi lines showing an interesting phenotype requires a very substantial amount of molecular characterization to prove that the phenotypes are due to reduced activity of the targeted gene. We have found that KO lines have given some useful insights into the relative endogenous roles of particular genes within the CAAT family, and revealed the potential for obtaining stress tolerance traits via knock-down strategies (e.g., G481 knockout/knockdown approaches).

Table 21 summarizes experimental results with plants in which sequences of the invention have either been overexpressed, reduced, or knocked out. These modifications have yielded new and potentially valuable phenotypic traits, relative to control plants, in morphological, physiological or disease assays, as demonstrated in *Arabidopsis*, or alternatively in tomato or other plants where noted. The last column lists the trait that was experimentally observed in plants, relative to control plants, after: either transforming plants with each transcription factor polynucleotide GID (Gene IDentifier, found in the first column) under the listed regulatory control mechanism; or (ii) in the cases where the project is listed as a knockout, expression of the transcription factor was abolished; or (iii) in the cases where the project is listed as "RNAi (GS) or RNAi (clade), the transcription factor was knocked down using RNAi targeting either the gene sequence or the clade of related genes, respectively.

TABLE 21

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G28 | AP2 (145-208) | 2 | G28 | Const. 35S prom. | P174 | 3854 | More tol. to drought* and better recovery from drought treatment* |
| G28 | AP2 (145-208) | 2 | G28 | Const. 35S prom. | P174 | 3854 | Late flowering |
| G28 | AP2 (145-208) | 2 | G28 | Const. 35S prom. | P26537 | 5019 | Late flowering |
| G28 | AP2 (145-208) | 2 | G28 | Const. 35S prom. | P26378 | 4967 | Late flowering |
| G28 | AP2 (145-208) | 2 | G28 | 2 comp. including P6506 (35S prom.) | P7826 | 4605 | Late flowering |
| G28 | AP2 (145-208) | 2 | G28 | Const. 35S prom. | P174 | 3854 | Darker green leaf color |
| G28 | AP2 (145-208) | 2 | G28 | Const. 35S prom. | P26537 | 5019 | Darker green leaf color |
| G28 | AP2 (145-208) | 2 | G28 | Const. 35S prom. | P26378 | 4967 | Darker green leaf color |
| G28 | AP2 (145-208) | 2 | G28 | 2 comp. including P6506 (35S prom.) | P7826 | 4605 | Darker green leaf color |
| G28 | AP2 (145-208) | 2 | G28 | Const. 35S prom. | P174 | 3854 | Altered C/N sensing: greater tol. to low nitrogen conditions in C/N sensing assay |
| G28 | AP2 (145-208) | 2 | G28 | Const. 35S prom. | P174 | 3854 | Greater resistance to *Botrytis* |
| G28 | AP2 (145-208) | 2 | G28 | Const. 35S prom. | P174 | 3854 | Greater resistance to *Sclerotinia* |
| G28 | AP2 (145-208) | 2 | G28 | Const. 35S prom. | P174 | 3854 | Greater resistance to *Erysiphe* |
| G28 | AP2 (145-208) | 2 | G28 | Root-specific ARSK1 prom. | P23541 | 4845 | Early flowering |
| G28 | AP2 (145-208) | 2 | G28 | Epidermal-specific CUT1 prom. | P23441 | 4835 | Greater res. to *Erysiphe* |
| G28 | AP2 (145-208) | 2 | G28 | Epidermal and vascular-specific LTP1 prom. | P23543 | 4846 | Greater res. to *Erysiphe* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G28 | AP2 (145-208) | 2 | G28 | Leaf-specific RBCS3 prom. | P23544 | 4847 | Greater res. to *Erysiphe* |
| G28 | AP2 (145-208) | 2 | G28 | Leaf-specific RBCS3 prom. | P23544 | 4847 | Darker green leaf color |
| G28 | AP2 (145-208) | 2 | G28 | Protein-GFP C terminal fusion, 35S | P26497 | 5015 | Greater res. to *Sclerotinia* |
| G1006 | AP2 (113-177) | 752 | G28 | Const. 35S prom. | P417 | 3931 | Greater res. to *Erysiphe* |
| G1006 | AP2 (113-177) | 752 | G28 | Const. 35S prom. | P417 | 3931 | Greater res. to *Sclerotinia* |
| G1006 | AP2 (113-177) | 752 | G28 | Const. 35S prom. | P417 | 3931 | Darker green leaf color |
| G22 | AP2 (88-152) | 56 | G28 | Const. 35S prom. | P806 | 3977 | Late flowering |
| G22 | AP2 (88-152) | 56 | G28 | Const. 35S prom. | P806 | 3977 | Greater tol. to NaCl (determined with 150 mM NaCl) |
| G22 | AP2 (88-152) | 56 | G28 | 2 comp. including P5326 (AP1 prom.) | P3376 | 4509 | Significantly greater soluble solids (Brix) in tomato plants |
| G22 | AP2 (88-152) | 56 | G28 | 2 comp. including P5318 (STM prom.) | P3376 | 4509 | Significantly greater soluble solids (Brix) in tomato plants |
| G22 | AP2 (88-152) | 56 | G28 | 2 comp. including P5284 (RBCS3 prom.) | P3376 | 4509 | Significantly greater lycopene in tomato plants |
| G3659 | AP2 (130-194) | 2054 | G28 | Const. 35S prom. | P23452 | 4836 | Greater res. to *Erysiphe* |
| G3659 | AP2 (130-194) | 2054 | G28 | Const. 35S prom. | P23452 | 4836 | Late flowering |
| G3659 | AP2 (130-194) | 2054 | G28 | Const. 35S prom. | P23452 | 4836 | Greater res. to *Sclerotinia* |
| G3659 | AP2 (130-194) | 2054 | G28 | Const. 35S prom. | P23452 | 4836 | Glossy leaves |
| G3659 | AP2 (130-194) | 2054 | G28 | Const. 35S prom. | P23452 | 4836 | Darker green leaf color |
| G3660 | AP2 (119-183) | 2056 | G28 | Const. 35S prom. | P23418 | 4831 | Glossy leaves |
| G3660 | AP2 (119-183) | 2056 | G28 | Const. 35S prom. | P23418 | 4831 | Late flowering |
| G3660 | AP2 (119-183) | 2056 | G28 | Const. 35S prom. | P23418 | 4831 | Greater res. to *Sclerotinia* |
| G3660 | AP2 (119-183) | 2056 | G28 | Const. 35S prom. | P23418 | 4831 | Greater res. to *Botrytis* |
| G3660 | AP2 (119-183) | 2056 | G28 | Const. 35S prom. | P23418 | 4831 | Greater res. to *Erysiphe* |
| G3717 | AP2 (130-194) | 2076 | G28 | Const. 35S prom. | P23421 | 4833 | Greater res. to *Erysiphe* |
| G3717 | AP2 (130-194) | 2076 | G28 | Const. 35S prom. | P23421 | 4833 | Greater res. to *Sclerotinia* |
| G3717 | AP2 (130-194) | 2076 | G28 | Const. 35S prom. | P23421 | 4833 | Late flowering |
| G3717 | AP2 (130-194) | 2076 | G28 | Const. 35S prom. | P23421 | 4833 | Glossy leaves |
| G3717 | AP2 (130-194) | 2076 | G28 | Const. 35S prom. | P23421 | 4833 | Darker green leaf color |
| G3717 | AP2 (130-194) | 2076 | G28 | Const. 35S prom. | P23421 | 4833 | Altered C/N sensing: Greater tol. to low nitrogen conditions in C/N sensing assay |
| G3718 | AP2 (139-203) | 2078 | G28 | Const. 35S prom. | P23423 | 4834 | Greater res. to *Erysiphe* |
| G3718 | AP2 (139-203) | 2078 | G28 | Const. 35S prom. | P23423 | 4834 | Greater res. to *Sclerotinia* |
| G3718 | AP2 (139-203) | 2078 | G28 | Const. 35S prom. | P23423 | 4834 | Glossy leaves |
| G3718 | AP2 (139-203) | 2078 | G28 | Const. 35S prom. | P23423 | 4834 | Darker green leaf color |
| G3718 | AP2 (139-203) | 2078 | G28 | Const. 35S prom. | P23423 | 4834 | Late flowering |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3718 | AP2 (139-203) | 2078 | G28 | Const. 35S prom. | P23423 | 4834 | Altered C/N sensing: Greater tol. to low nitrogen conditions in C/N sensing assay |
| G3841 | AP2 (102-166) | 2158 | G28 | Const. 35S prom. | P25573 | 4912 | Greater res. to *Erysiphe* |
| G3841 | AP2 (102-166) | 2158 | G28 | Const. 35S prom. | P26576 | 5021 | Greater res. to *Erysiphe* |
| G3841 | AP2 (102-166) | 2158 | G28 | Const. 35S prom. | P25573 | 4912 | Greater res. to *Sclerotinia* |
| G3841 | AP2 (102-166) | 2158 | G28 | Const. 35S prom. | P26576 | 5021 | Greater res. to *Sclerotinia* |
| G3841 | AP2 (102-166) | 2158 | G28 | Const. 35S prom. | P25573 | 4912 | Late flowering |
| G3841 | AP2 (102-166) | 2158 | G28 | Const. 35S prom. | P26576 | 5021 | Late flowering |
| G3841 | AP2 (102-166) | 2158 | G28 | Const. 35S prom. | P25573 | 4912 | Altered leaf shape |
| G3841 | AP2 (102-166) | 2158 | G28 | Const. 35S prom. | P26576 | 5021 | Altered leaf shape |
| G3841 | AP2 (102-166) | 2158 | G28 | Const. 35S prom. | P25573 | 4912 | Glossy leaves |
| G3841 | AP2 (102-166) | 2158 | G28 | Const. 35S prom. | P26576 | 5021 | Glossy leaves |
| G3841 | AP2 (102-166) | 2158 | G28 | Const. 35S prom. | P25573 | 4912 | Darker green leaf color |
| G3841 | AP2 (102-166) | 2158 | G28 | Const. 35S prom. | P26576 | 5021 | Darker green leaf color |
| G3841 | AP2 (102-166) | 2158 | G28 | Const. 35S prom. | P25573 | 4912 | Altered C/N sensing: Greater tol. to low nitrogen conditions in C/N sensing assay |
| G3841 | AP2 (102-166) | 2158 | G28 | Const. 35S prom. | P26576 | 5021 | Altered C/N sensing: Greater tol. to low nitrogen conditions in C/N sensing assay |
| G3843 | AP2 (130-194) | 2160 | G28 | — | — | | n/d |
| G3852 | AP2 (102-167) | 2170 | G28 | — | — | | n/d |
| G3844 | AP2 (141-205) | 2162 | G28 | — | — | | n/d |
| G3845 | AP2 (101-165) | 2164 | G28 | — | — | | n/d |
| G3846 | AP2 (95-159) | 2166 | G28 | — | — | | n/d |
| G3857 | AP2 (98-162) | 2174 | G28 | — | — | | n/d |
| G3858 | AP2 (108-172) | 2176 | G28 | — | — | | n/d |
| G3430 | AP2 (145-209) | 4 | G28 | Const. 35S prom. | P21267 | 4768 | Greater res. to *Erysiphe* |
| G3430 | AP2 (145-209) | 4 | G28 | Const. 35S prom. | P21267 | 4768 | Greater res. to *Sclerotinia* |
| G3430 | AP2 (145-209) | 4 | G28 | Const. 35S prom. | P21267 | 4768 | Late flowering |
| G3430 | AP2 (145-209) | 4 | G28 | Const. 35S prom. | P21267 | 4768 | Darker green leaf color |
| G3848 | AP2 (149-213) | 2168 | G28 | Const. 35S prom. | P25571 | 4910 | Greater res. to *Erysiphe* |
| G3848 | AP2 (149-213) | 2168 | G28 | Const. 35S prom. | P25571 | 4910 | Greater res. to *Sclerotinia* |
| G3848 | AP2 (149-213) | 2168 | G28 | Const. 35S prom. | P25571 | 4910 | Late flowering |
| G3848 | AP2 (149-213) | 2168 | G28 | Const. 35S prom. | P25571 | 4910 | Glossy leaves |
| G3848 | AP2 (149-213) | 2168 | G28 | Const. 35S prom. | P25571 | 4910 | Darker green leaf color |
| G3856 | AP2 (140-204) | 2172 | G28 | Const. 35S prom. | P25572 | 4911 | Greater res. to *Erysiphe* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3856 | AP2 (140-204) | 2172 | G28 | Const. 35S prom. | P25572 | 4911 | Greater res. to *Sclerotinia* |
| G3856 | AP2 (140-204) | 2172 | G28 | Const. 35S prom. | P25572 | 4911 | Glossy leaves |
| G3856 | AP2 (140-204) | 2172 | G28 | Const. 35S prom. | P25572 | 4911 | Darker green leaf color |
| G3661 | AP2 (126-190) | 2058 | G28 | Const. 35S prom. | P23419 | 4832 | Greater res. to *Erysiphe* |
| G3661 | AP2 (126-190) | 2058 | G28 | Const. 35S prom. | P23419 | 4832 | Late flowering |
| G3661 | AP2 (126-190) | 2058 | G28 | Const. 35S prom. | P23419 | 4832 | Glossy leaves |
| G3864 | AP2 (127-191) | 2178 | G28 | — | — | | n/d |
| G3865 | AP2 (125-189) | 2180 | G28 | — | — | | n/d |
| G47 | AP2 (10-75) | 6 | G47 | Const. 35S prom. | P894 | 3994 | More lignin |
| G47 | AP2 (10-75) | 6 | G47 | 2 comp. including P6506 (35S prom.) | P3853 | 4532 | More lignin |
| G47 | AP2 (10-75) | 6 | G47 | Const. 35S prom. | P894 | 3994 | Altered stem morphology; wider stem diameter, large irregular vascular bundles with a much greater number of xylem vessels; xylem vessels within the bundles appeared narrow and more lignified |
| G47 | AP2 (10-75) | 6 | G47 | 2 comp. including P6506 (35S prom.) | P3853 | 4532 | Altered stem morphology; wider stem diameter, large irregular vascular bundles with a much greater number of xylem vessels; xylem vessels within the bundles appeared narrow and more lignified |
| G47 | AP2 (10-75) | 6 | G47 | Const. 35S prom. | P894 | 3994 | Better root growth under hyperosmotic stress with PEG |
| G47 | AP2 (10-75) | 6 | G47 | 2 comp. including P6506 (35S prom.) | P3853 | 4532 | Better root growth under hyperosmotic stress with PEG |
| G47 | AP2 (10-75) | 6 | G47 | Const. 35S prom. | P894 | 3994 | Late flowering |
| G47 | AP2 (10-75) | 6 | G47 | 2 comp. including P5284 (RBCS3 prom.) | P3853 | 4532 | Late flowering |
| G47 | AP2 (10-75) | 6 | G47 | Const. 35S prom. | P894 | 3994 | Altered architecture and inflorescence development; thick, fleshy inflorescences, reduced apical dominance, reduced internode elongation, stem branching pattern altered - primary shoot 'kinked' at each coflorescence node, reduced fertility, |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G47 | AP2 (10-75) | 6 | G47 | 2 comp. including P6506 (35S prom.) | P3853 | 4532 | small siliques borne on short pedicels held vertically and close against the stem Altered architecture and inflorescence development; thick, fleshy inflorescences, reduced apical dominance, reduced internode elongation, stem branching pattern altered - primary shoot 'kinked' at each coflorescence node, reduced fertility, small siliques borne on short pedicels held vertically and close against the stem |
| G47 | AP2 (10-75) | 6 | G47 | Const. 35S prom. | P894 | 3994 | More tol. to drought* and better recovery from drought treatment* |
| G47 | AP2 (10-75) | 6 | G47 | 2 comp. including P6506 (35S prom.) | P3853 | 4532 | More tol. to drought* and better recovery from drought treatment* |
| G47 | AP2 (10-75) | 6 | G47 | 2 comp. including P5311 (ARSK1 prom.) | P3853 | 4532 | Greater tol. to dehydration |
| G47 | AP2 (10-75) | 6 | G47 | 2 comp. including P5288 (CUT1 prom.) | P3853 | 4532 | Greater tol. to dehydration |
| G47 | AP2 (10-75) | 6 | G47 | 2 comp. including P5288 (CUT1 prom.) | P3853 | 4532 | More tol. to drought* and better recovery from drought treatment* |
| G47 | AP2 (10-75) | 6 | G47 | 2 comp. including P5287 (LTP1 prom.) | P3853 | 4532 | Significantly greater tomato plant volume |
| G47 | AP2 (10-75) | 6 | G47 | 2 comp. including P5284 (RBCS3 prom.) | P3853 | 4532 | Greater tol. to cold (8 C.) |
| G47 | AP2 (10-75) | 6 | G47 | 2 comp. including P5284 (RBCS3 prom.) | P3853 | 4532 | Late flowering |
| G47 | AP2 (10-75) | 6 | G47 | 2 comp. including P9002 (RD29A prom.) | P3853 | 4532 | Decreased sens. to ABA |
| G47 | AP2 (10-75) | 6 | G47 | 2 comp. including P9002 (RD29A prom.) | P3853 | 4532 | Greater tol. to dehydration |
| G47 | AP2 (10-75) | 6 | G47 | 2 comp. including P9002 (RD29A prom.) | P3853 | 4532 | Better recovery from drought treatment* |
| G47 | AP2 (10-75) | 6 | G47 | 2 comp. including P9002 (RD29A prom.) | P3853 | 4532 | Late flowering |
| G47 | AP2 (10-75) | 6 | G47 | 2 comp. including P9002 (RD29A prom.) | P3853 | 4532 | Larger leaf size |
| G47 | AP2 (10-75) | 6 | G47 | 2 comp. including P5318 (STM prom.) | P3853 | 4532 | Larger leaf size |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G47 | AP2 (10-75) | 6 | G47 | 2 comp. including P5318 (STM prom.) | P3853 | 4532 | Greater tol. to cold (8 C.) |
| G47 | AP2 (10-75) | 6 | G47 | 2 comp. including P5318 (STM prom.) | P3853 | 4532 | More tol. to drought* and better recovery from drought treatment* |
| G47 | AP2 (10-75) | 6 | G47 | 2 comp. including P5318 (STM prom.) | P3853 | 4532 | Late flowering |
| G47 | AP2 (10-75) | 6 | G47 | 2 comp. including P5318 (STM prom.) | P3853 | 4532 | Altered sugar sensing; greater tol. to sucrose (determined in 9.4% sucrose) |
| G47 | AP2 (10-75) | 6 | G47 | 2 comp. including P5290 (SUC2 prom.) | P3853 | 4532 | Late flowering |
| G47 | AP2 (10-75) | 6 | G47 | 2 comp. including P5290 (SUC2 prom.) | P3853 | 4532 | Larger leaf size |
| G47 | AP2 (10-75) | 6 | G47 | 2 comp. including P5290 (SUC2 prom.) | P3853 | 4532 | Darker green leaf color |
| G47 | AP2 (10-75) | 6 | G47 | 2 comp. including P5290 (SUC2 prom.) | P3853 | 4532 | Thicker stem |
| G47 | AP2 (10-75) | 6 | G47 | 2 comp. including P5290 (SUC2 prom.) | P3853 | 4532 | Greater tol. to dehydration |
| G47 | AP2 (10-75) | 6 | G47 | GAL4 N-term (Super Active), 35S | P25186 | 4864 | Greater tol. to dehydration |
| G47 | AP2(10-75) | 6 | G47 | GAL4 N-term (Super Active), 35S | P25186 | 4864 | Greater tol. to drought* |
| G47 | AP2 (10-75) | 6 | G47 | GAL4 N-term (Super Active), 35S | P25186 | 4864 | Early flowering |
| G47 | AP2 (10-75) | 6 | G47 | GAL4 N-term (Super Active), 35S | P25186 | 4864 | Greater tol. to 300 mM mannitol |
| G47 | AP2 (10-75) | 6 | G47 | Point mutation, 35S | P25735 | 4921 | Greater tol. to cold (8 C.) |
| G47 | AP2 (10-75) | 6 | G47 | Point mutation, 35S | P25732 | 4920 | Greater tol. to dehydration |
| G47 | AP2 (10-75) | 6 | G47 | Point mutation, 35S | P25732 | 4920 | More tol. to drought* and better recovery from drought treatment* |
| G47 | AP2 (10-75) | 6 | G47 | Domain swap/chimeric variant, 35S | P25182 | 4863 | Greater tol. to cold (8 C.) |
| G47 | AP2 (10-75) | 6 | G47 | Domain swap/chimeric variant, 35S | P25182 | 4863 | Late flowering |
| G47 | AP2 (10-75) | 6 | G47 | Domain swap/chimeric variant, 35S | P25182 | 4863 | Altered leaf shape |
| G47 | AP2 (10-75) | 6 | G47 | Domain swap/chimeric variant, 35S | P25182 | 4863 | Altered leaf orientation; narrow curled leaves held in an upward orientation |
| G2133 | AP2 (10-77) | 8 | G47 | Const. 35S prom. | P1572 | 4192 | Decreased apical dominance and bushy inflorescences |
| G2133 | AP2 (10-77) | 8 | G47 | Const. 35S prom. | P1572 | 4192 | More lignin |
| G2133 | AP2 (10-77) | 8 | G47 | Const. 35S prom. | P1572 | 4192 | Greater tol. to cold (8 C.) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G2133 | AP2 (10-77) | 8 | G47 | Const. 35S prom. | P1572 | 4192 | Greater tol. to dehydration |
| G2133 | AP2 (10-77) | 8 | G47 | Const. 35S prom. | P1572 | 4192 | Thicker stem |
| G2133 | AP2 (10-77) | 8 | G47 | Const. 35S prom. | P1572 | 4192 | More tol. to drought* and better recovery from drought treatment* |
| G2133 | AP2 (10-77) | 8 | G47 | Const. 35S prom. | P1572 | 4192 | Greater tol. to glyphosate |
| G2133 | AP2 (10-77) | 8 | G47 | Const. 35S prom. | P1572 | 4192 | Late flowering |
| G2133 | AP2 (10-77) | 8 | G47 | Const. 35S prom. | P1572 | 4192 | Altered C/N sensing: much greater tol. to low nitrogen conditions in C/N sensing assay |
| G2133 | AP2 (10-77) | 8 | G47 | 2 comp. including P5326 (AP1 prom.) | P4361 | 4552 | Greater tol. to cold (8 C.) |
| G2133 | AP2 (10-77) | 8 | G47 | 2 comp. including P5288 (CUT1 prom.) | P4361 | 4552 | Altered sugar sensing; greater tol. to sucrose (determined in 9.4% sucrose) |
| G2133 | AP2 (10-77) | 8 | G47 | 2 comp. including P5284 (RBCS3 prom.) | P4361 | 4552 | Greater tol. to dehydration |
| G2133 | AP2 (10-77) | 8 | G47 | 2 comp. including P5284 (RBCS3 prom.) | P4361 | 4552 | Greater tol. to cold (8 C.) |
| G2133 | AP2 (10-77) | 8 | G47 | 2 comp. including P9002 (RD29A prom.) | P4361 | 4552 | Better recovery from drought treatment* |
| G2133 | AP2 (10-77) | 8 | G47 | 2 comp. including P9002 (RD29A prom.) | P4361 | 4552 | Greater tol. to dehydration |
| G2133 | AP2 (10-77) | 8 | G47 | 2 comp. including P5318 (STM prom.) | P4361 | 4552 | Greater tol. to cold (8 C.) |
| G2133 | AP2 (10-77) | 8 | G47 | 2 comp. including P5290 (SUC2 prom.) | P4361 | 4552 | Late flowering |
| G2133 | AP2 (10-77) | 8 | G47 | 2 comp. including P5290 (SUC2 prom.) | P4361 | 4552 | Greater biomass |
| G3646 | AP2 (10-77) | 2042 | G47 | — | — |  | n/d |
| G3645 | AP2 (10-75) | 2040 | G47 | — | — |  | n/d |
| G3643 | AP2 (13-78) | 2036 | G47 | Const. 35S prom. | P23465 | 4839 | More tol. to drought* and better recovery from drought treatment* |
| G3643 | AP2 (13-78) | 2036 | G47 | Const. 35S prom. | P23465 | 4839 | Greater tol. to cold (8 C.) |
| G3647 | AP2 (13-78) | 2044 | G47 | — | — |  | n/d |
| G3644 | AP2 (52-122) | 2038 | G47 | Const. 35S prom. | P23455 | 4837 | Thicker stem |
| G3644 | AP2 (52-122) | 2038 | G47 | Const. 35S prom. | P23455 | 4837 | Late flowering |
| G3644 | AP2 (52-122) | 2038 | G47 | Const. 35S prom. | P23455 | 4837 | Greater biomass |
| G3649 | AP2 (15-87) | 2046 | G47 | Const. 35S prom. | P23456 | 4838 | Late flowering |
| G3649 | AP2 (15-87) | 2046 | G47 | Const. 35S prom. | P23456 | 4838 | Thicker stem |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3649 | AP2 (15-87) | 2046 | G47 | Const. 35S prom. | P23456 | 4838 | Decreased apical dominance; short inflorescence internodes |
| G3649 | AP2 (15-87) | 2046 | G47 | Const. 35S prom. | P23456 | 4838 | Greater tol. to cold (8 C.) |
| G3649 | AP2 (15-87) | 2046 | G47 | Const. 35S prom. | P23456 | 4838 | More tol. to drought* and better recovery from drought treatment* |
| G3651 | AP2 (60-130) | 2050 | G47 | — | — | — | n/d |
| G3650 | AP2 (75-139) | 2048 | G47 | — | — | — | n/d |
| G481 | CAAT (20-109) | 10 | G481 | Const. 35S prom. | P46 | 3811 | Late flowering |
| G481 | CAAT (20-109) | 10 | G481 | Const. 35S prom. | P26891 | 5063 | Late flowering |
| G481 | CAAT (20-109) | 10 | G481 | Const. 35S prom. | P26496 | 5014 | Late flowering |
| G481 | CAAT (20-109) | 10 | G481 | 2 comp. including P6506 (35S prom.) | P6812 | 4601 | Late flowering |
| G481 | CAAT (20-109) | 10 | G481 | Const. 35S prom. | P26496 | 5014 | Greater tol. to 300 mM mannitol |
| G481 | CAAT (20-109) | 10 | G481 | Const. 35S prom. | P46 | 3811 | Diurnal fluctuation of malate levels in young leaves |
| G481 | CAAT (20-109) | 10 | G481 | 2 comp. including P6506 (35S prom.) | P6812 | 4601 | Diurnal fluctuation of malate levels in young leaves |
| G481 | CAAT (20-109) | 10 | G481 | Const. 35S prom. | P46 | 3811 | Photosynthesis rate increased |
| G481 | CAAT (20-109) | 10 | G481 | 2 comp. including P6506 (35S prom.) | P6812 | 4601 | Photosynthesis rate increased |
| G481 | CAAT (20-109) | 10 | G481 | Const. 35S prom. | P46 | 3811 | Greater starch levels at specific timepoints and conditions |
| G481 | CAAT (20-109) | 10 | G481 | 2 comp. including P6506 (35S prom.) | P6812 | 4601 | Greater starch levels at specific timepoints and conditions |
| G481 | CAAT (20-109) | 10 | G481 | Const. 35S prom. | P46 | 3811 | Greater proline levels in sink tissues (young leaves and inflorescences) |
| G481 | CAAT (20-109) | 10 | G481 | 2 comp. including P6506 (35S prom.) | P6812 | 4601 | Greater proline levels in sink tissues (young leaves and inflorescences) |
| G481 | CAAT (20-109) | 10 | G481 | Const. 35S prom. | P46 | 3811 | Altered sucrose levels; elevated sucrose levels in specific times and tissues |
| G481 | CAAT (20-109) | 10 | G481 | 2 comp. including P6506 (35S prom.) | P6812 | 4601 | Altered sucrose levels; elevated sucrose levels in specific times and tissues |
| G481 | CAAT (20-109) | 10 | G481 | Const. 35S prom. | P46 | 3811 | Higher chlorophyll level |
| G481 | CAAT (20-109) | 10 | G481 | 2 comp. including P6506 (35S prom.) | P6812 | 4601 | Higher chlorophyll level |
| G481 | CAAT (20-109) | 10 | G481 | Const. 35S prom. | P46 | 3811 | Greater tol. to cold (8 C.) |
| G481 | CAAT (20-109) | 10 | G481 | Const. 35S prom. | P25893 | 4937 | Greater tol. to cold (8 C.) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G481 | CAAT (20-109) | 10 | G481 | 2 comp. including P6506 (35S prom.) | P6812 | 4601 | Greater tol. to cold (8 C.) |
| G481 | CAAT (20-109) | 10 | G481 | Const. 35S prom. | P46 | 3811 | Decreased sens. to ABA |
| G481 | CAAT (20-109) | 10 | G481 | 2 comp. including P6506 (35S prom.) | P6812 | 4601 | Decreased sens. to ABA |
| G481 | CAAT (20-109) | 10 | G481 | Const. 35S prom. | P46 | 3811 | Greater seedling vigor |
| G481 | CAAT (20-109) | 10 | G481 | Const. 35S prom. | P46 | 3811 | Greater water use efficiency |
| G481 | CAAT (20-109) | 10 | G481 | Const. 35S prom. | P46 | 3811 | More tol. to drought* and better recovery from drought treatment* |
| G481 | CAAT (20-109) | 10 | G481 | 2 comp. including P6506 (35S prom.) | P6812 | 4601 | More tol. to drought* and better recovery from drought treatment* |
| G481 | CAAT (20-109) | 10 | G481 | Const. 35S prom. | P46 | 3811 | Greater non-photochemical quenching of chlorophyll fluorescence (NPQ) |
| G481 | CAAT (20-109) | 10 | G481 | 2 comp. including P6506 (35S prom.) | P6812 | 4601 | Greater non-photochemical quenching of chlorophyll fluorescence (NPQ) |
| G481 | CAAT (20-109) | 10 | G481 | Const. 35S prom. | P46 | 3811 | Early flowering |
| G481 | CAAT (20-109) | 10 | G481 | 2 comp. including P6506 (35S prom.) | P6812 | 4601 | Early flowering |
| G481 | CAAT (20-109) | 10 | G481 | Const. 35S prom. | P26496 | 5014 | Altered C/N sensing: greater tol. to low nitrogen conditions in C/N sensing assay |
| G481 | CAAT (20-109) | 10 | G481 | 2 comp. including P5319 (AS1 prom.) | P6812 | 4601 | Greater tol. to cold (8 C.) |
| G481 | CAAT (20-109) | 10 | G481 | 2 comp. including P5319 (AS1 prom.) | P6812 | 4601 | Altered leaf orientation |
| G481 | CAAT (20-109) | 10 | G481 | 2 comp. including P5319 (AS1 prom.) | P6812 | 4601 | Greater seedling vigor |
| G481 | CAAT (20-109) | 10 | G481 | 2 comp. including P5311 (ARSK1 prom.) | P6812 | 4601 | More tol. to drought* and better recovery from drought treatment* |
| G481 | CAAT (20-109) | 10 | G481 | 2 comp. including P5287 (LTP1 prom.) | P6812 | 4601 | Altered sugar sensing; greater tol. to sucrose (determined in 9.4% sucrose) |
| G481 | CAAT (20-109) | 10 | G481 | 2 comp. including P5287 (LTP1 prom.) | P6812 | 4601 | Greater tol. to dehydration |
| G481 | CAAT (20-109) | 10 | G481 | 2 comp. including P5287 (LTP1 prom.) | P6812 | 4601 | Greater tol. to cold (8 C.) |
| G481 | CAAT (20-109) | 10 | G481 | Leaf-specific RBCS3 prom. | P25287 | 4887 | Greater tol. to dehydration |
| G481 | CAAT (20-109) | 10 | G481 | Leaf-specific RBCS3 prom. | P25896 | 4938 | Greater tol. to cold (8 C.) |
| G481 | CAAT (20-109) | 10 | G481 | 2 comp. including P9002 (RD29A prom.) | P6812 | 4601 | Better recovery from drought treatment* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G481 | CAAT (20-109) | 10 | G481 | 2 comp. including P5310 (RS1 prom.) | P6812 | 4601 | Late flowering |
| G481 | CAAT (20-109) | 10 | G481 | Vascular-specific SUC2 prom. | P21522 | 4824 | Late flowering |
| G481 | CAAT (20-109) | 10 | G481 | 2 comp. including P5290 (SUC2 prom.) | P6812 | 4601 | Late flowering |
| G481 | CAAT (20-109) | 10 | G481 | Vascular-specific SUC2 prom. | P21522 | 4824 | Greater tol. to cold (8 C.) |
| G481 | CAAT (20-109) | 10 | G481 | 2 comp. including P5290 (SUC2 prom.) | P6812 | 4601 | Greater tol. to cold (8 C.) |
| G481 | CAAT (20-109) | 10 | G481 | Vascular-specific SUC2 prom. | P21522 | 4824 | Greater tol. to dehydration |
| G481 | CAAT (20-109) | 10 | G481 | 2 comp. including P5290 (SUC2 prom.) | P6812 | 4601 | Greater tol. to dehydration |
| G481 | CAAT (20-109) | 10 | G481 | Vascular-specific SUC2 prom. | P21522 | 4824 | More tol. to drought* and better recovery from drought treatment* |
| G481 | CAAT (20-109) | 10 | G481 | Vascular-specific SUC2 prom. | P21522 | 4824 | Darker green leaf color |
| G481 | CAAT (20-109) | 10 | G481 | Protein-GFP C terminal fusion, 35S | P25281 | 4886 | Greater tol. to hyperosmotic stress; more tol. to 9.4% sucrose or 150 mM NaCl |
| G481 | CAAT (20-109) | 10 | G481 | Protein-CFP C terminal fusion, 35S | P26040 | 4941 | Greater tol. to dehydration |
| G481 | CAAT (20-109) | 10 | G481 | GAL4 C-term (Super Active), 35S | P21146 | 4746 | Early flowering |
| G481 | CAAT (20-109) | 10 | G481 | GAL4 C-term (Super Active), 35S | P21146 | 4746 | Greater seedling vigor |
| G481 | CAAT (20-109) | 10 | G481 | GAL4 C-term (Super Active), 35S | P21146 | 4746 | Greater tol. to heat (32 C.) |
| G481 | CAAT (20-109) | 10 | G481 | GAL4 C-term (Super Active), 35S | P21146 | 4746 | Greater tol. to NaCl (determined with 150 mM NaCl) |
| G481 | CAAT (20-109) | 10 | G481 | 2 comp. hemagglutinin (HA) epitope C-terminal tag, 35S (w/P5486) | P21281 | 4775 | Early flowering |
| G481 | CAAT (20-109) | 10 | G481 | Hemagglutinin (HA) epitope N-terminal tag, 35S | P21287 | 4776 | Early flowering |
| G481 | CAAT (20-109) | 10 | G481 | 2 comp. hemagglutinin (HA) epitope C-terminal tag, 35S (w/P5486) | P26263 | 4964 | Greater seedling vigor |
| G481 | CAAT (20-109) | 10 | G481 | Point mutation, 35S | P25889 | 4934 | Greater seedling vigor, without marked changes in flowering time. |
| G481 | CAAT (20-109) | 10 | G481 | Deletion variant, 35S | P21274 | 4772 | More tol. to drought* and better recovery from drought treatment* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G481 | CAAT (20-109) | 10 | G481 | Deletion variant, 35S | P21274 | 4772 | Greater tol. to NaCl (determined with 150 mM NaCl) |
| G481 | CAAT (20-109) | 10 | G481 | Deletion variant, 35S | P21274 | 4772 | Late flowering |
| G481 | CAAT (20-109) | 10 | G481 | Deletion variant, 35S | P21274 | 4772 | Early flowering |
| G481 | CAAT (20-109) | 10 | G481 | Deletion variant, 35S | P21274 | 4772 | Altered leaf shape |
| G481 | CAAT (20-109) | 10 | G481 | Deletion variant, 35S | P21274 | 4772 | Darker green leaf color |
| G481 | CAAT (20-109) | 10 | G481 | Deletion variant, 35S | P21274 | 4772 | Greater ABA level |
| G481 | CAAT (20-109) | 10 | G481 | Deletion variant, 35S | P21274 | 4772 | Greater carotenoid level |
| G481 | CAAT (20-109) | 10 | G481 | Deletion variant, 35S | P21274 | 4772 | Higher chlorophyll level |
| G481 | CAAT (20-109) | 10 | G481 | Deletion variant, 35S | P21274 | 4772 | Higher proline level |
| G481 | CAAT (20-109) | 10 | G481 | Domain swap/chimeric variant, 35S | P25891 | 4935 | Early flowering |
| G481 | CAAT (20-109) | 10 | G481 | RNAi (clade) targeted to conserved domain, 35S | P21159 | 4747 | Late flowering |
| G481 | CAAT (20-109) | 10 | G481 | RNAi (clade) targeted to conserved domain, 35S | P21300 | 4779 | Late flowering |
| G481 | CAAT (20-109) | 10 | G481 | RNAi (clade) targeted to conserved domain, 35S | P21305 | 4783 | Late flowering |
| G481 | CAAT (20-109) | 10 | G481 | RNAi (clade) targeted to conserved domain, 35S | P21159 | 4747 | Greater tol. to heat (32 C.) |
| G481 | CAAT (20-109) | 10 | G481 | RNAi (clade) targeted to conserved domain, 35S | P21300 | 4779 | Greater tol. to heat (32 C.) |
| G481 | CAAT (20-109) | 10 | G481 | RNAi (clade) targeted to conserved domain, 35S | P21305 | 4783 | Greater tol. to heat (32 C.) |
| G481 | CAAT (20-109) | 10 | G481 | RNAi (clade) targeted to conserved domain, 35S | P21159 | 4747 | Altered leaf shape |
| G481 | CAAT (20-109) | 10 | G481 | RNAi (clade) targeted to conserved domain, 35S | P21300 | 4779 | Altered leaf shape |
| G481 | CAAT (20-109) | 10 | G481 | RNAi (clade) targeted to conserved domain, 35S | P21305 | 4783 | Altered leaf shape |
| G481 | CAAT (20-109) | 10 | G481 | RNAi (clade) targeted to conserved domain, 35S | P21159 | 4747 | Darker green leaf color |
| G481 | CAAT (20-109) | 10 | G481 | RNAi (clade) targeted to conserved domain, 35S | P21300 | 4779 | Darker green leaf color |
| G481 | CAAT (20-109) | 10 | G481 | RNAi (clade) targeted to conserved domain, 35S | P21305 | 4783 | Darker green leaf color |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G481 | CAAT (20-109) | 10 | G481 | RNAi (clade) targeted to conserved domain, 35S | P21305 | 4783 | Greater tol. to hyperosmotic stress; more tol. to 9.4% sucrose, 300 mM mannitol or 150 mM NaCl |
| G481 | CAAT (20-109) | 10 | G481 | RNAi (clade) targeted to conserved domain, 35S | P21159 | 4747 | Greater seedling vigor |
| G481 | CAAT (20-109) | 10 | G481 | RNAi (clade) targeted to conserved domain, 35S | P21300 | 4779 | Greater seedling vigor |
| G481 | CAAT (20-109) | 10 | G481 | RNAi (clade) targeted to conserved domain, 35S | P21305 | 4783 | Greater seedling vigor |
| G481 | CAAT (20-109) | 10 | G481 | RNAi Gene-Specific (GS), 35S | P21294 | 4777 | Greater tol. to cold (8 C.) |
| G481 | CAAT (20-109) | 10 | G481 | RNAi Gene-Specific (GS), 35S | P21294 | 4777 | More tol. to drought* and better recovery from drought treatment* |
| G481 | CAAT (20-109) | 10 | G481 | Knockout | not applicable | | Early flowering |
| G481 | CAAT (20-109) | 10 | G481 | Knockout | not applicable | | Decreased tol. to NaCl (determined with 150 mM NaCl) |
| G482 | CAAT (26-115) | 12 | G481 | 2 comp. including P6506 (35S prom.) | P5072 | 4594 | More tol. to drought* and better recovery from drought treatment* |
| G482 | CAAT (26-115) | 12 | G481 | Const. 35S prom. | P47 | 3812 | Early flowering |
| G482 | CAAT (26-115) | 12 | G481 | 2 comp. including P6506 (35S prom.) | P5072 | 4594 | Early flowering |
| G482 | CAAT (26-115) | 12 | G481 | Const. 35S prom. | P47 | 3812 | Greater tol. to 300 mM mannitol |
| G482 | CAAT (26-115) | 12 | G481 | 2 comp. including P6506 (35S prom.) | P5072 | 4594 | Greater tol. to 300 mM mannitol |
| G482 | CAAT (26-115) | 12 | G481 | Const. 35S prom. | P47 | 3812 | Greater tol. to heat (32 C.) |
| G482 | CAAT (26-115) | 12 | G481 | 2 comp. including P6506 (35S prom.) | P5072 | 4594 | Greater tol. to heat (32 C.) |
| G482 | CAAT (26-115) | 12 | G481 | 2 comp. including P5290 (SUC2 prom.) | P5072 | 4594 | Early flowering |
| G482 | CAAT (26-115) | 12 | G481 | Protein-CFP C-terminal fusion, 35S | P26041 | 4942 | Early flowering |
| G482 | CAAT (26-115) | 12 | G481 | Knockout | not applicable | | More tol. to drought* and better recovery from drought treatment* |
| G482 | CAAT (26-115) | 12 | G481 | Knockout | not applicable | | Late flowering |
| G485 | CAAT (20-109) | 394 | G481 | 2 comp. including P6506 (35S prom.) | P4190 | 4541 | Greater tol. to cold (8 C.) |
| G485 | CAAT (20-109) | 394 | G481 | 2 comp. including P6506 (35S prom.) | P4190 | 4541 | Greater tol. to hyperosmotic stress; more tol. to 9.4% sucrose or 150 mM NaCl |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G485 | CAAT (20-109) | 394 | G481 | Const. 35S prom. | P1441 | 4145 | More tol. to drought* and better recovery from drought treatment* |
| G485 | CAAT (20-109) | 394 | G481 | 2 comp. including P6506 (35S prom.) | P4190 | 4541 | More tol. to drought* and better recovery from drought treatment* |
| G485 | CAAT (20-109) | 394 | G481 | 2 comp. including P6506 (35S prom.) | P4190 | 4541 | Less sens. to ABA |
| G485 | CAAT (20-109) | 394 | G481 | 2 comp. including P6506 (35S prom.) | P4190 | 4541 | Greater tol. to NaCl (determined with 150 mM NaCl) |
| G485 | CAAT (20-109) | 394 | G481 | 2 comp. including P6506 (35S prom.) | P4190 | 4541 | Altered sugar sensing; greater tol. to sucrose (determined in 9.4% sucrose) |
| G485 | CAAT (20-109) | 394 | G481 | 2 comp. including P6506 (35S prom.) | P4190 | 4541 | Early flowering |
| G485 | CAAT (20-109) | 394 | G481 | 2 comp. including P5319 (AS1 prom.) | P4190 | 4541 | Greater tol. to cold (8 C.) |
| G485 | CAAT (20-109) | 394 | G481 | 2 comp. including P5319 (AS1 prom.) | P4190 | 4541 | Greater tol. to dehydration |
| G485 | CAAT (20-109) | 394 | G481 | 2 comp. including P5319 (AS1 prom.) | P4190 | 4541 | Greater seedling vigor |
| G485 | CAAT (20-109) | 394 | G481 | Protein-GFP C terminal fusion, 35S | P26044 | 4944 | Greater tol. to cold (8 C.) |
| G485 | CAAT (20-109) | 394 | G481 | Protein-GFP C terminal fusion, 35S | P26044 | 4944 | Greater tol. to dehydration |
| G485 | CAAT (20-109) | 394 | G481 | Domain swap/chimeric variant, 35S | P25892 | 4936 | Late flowering |
| G485 | CAAT (20-109) | 394 | G481 | Domain swap/chimeric variant, 35S | P25892 | 4936 | Darker green leaf color |
| G485 | CAAT (20-109) | 394 | G481 | Knockout | not applicable | | More tol. to drought* and better recovery from drought treatment* |
| G485 | CAAT (20-109) | 394 | G481 | Knockout | not applicable | | Less sens. to ABA |
| G485 | CAAT (20-109) | 394 | G481 | Knockout | not applicable | | Greater tol. to NaCl (determined with 150 mM NaCl) |
| G485 | CAAT (20-109) | 394 | G481 | Knockout | not applicable | | Late flowering |
| G1364 | CAAT (29-118) | 952 | G481 | 2 comp. including P6506 (35S prom.) | P4357 | 4550 | Better recovery from drought treatment* |
| G1364 | CAAT (29-118) | 952 | G481 | 2 comp. including P6506 (35S prom.) | P4357 | 4550 | Late flowering |
| G1364 | CAAT (29-118) | 952 | G481 | 2 comp. including P5284 (RBCS3 prom.) | P4357 | 4550 | Greater tol. to 300 mM mannitol |
| G1364 | CAAT (29-118) | 952 | G481 | 2 comp. including P5284 (RBCS3 prom.) | P4357 | 4550 | Greater tol. to cold (8 C.) |
| G1364 | CAAT (29-118) | 952 | G481 | 2 comp. including P9002 (RD29A prom.) | P4357 | 4550 | Greater tol. to cold (8 C.) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1364 | CAAT (29-118) | 952 | G481 | 2 comp. including P9002 (RD29A prom.) | P4357 | 4550 | Greater tol. to NaCl (determined with 150 mM NaCl) |
| G1364 | CAAT (29-118) | 952 | G481 | Protein-CFP C-terminal fusion, 35S | P26108 | 4953 | More tol. to drought* and better recovery from drought treatment* |
| G1364 | CAAT (29-118) | 952 | G481 | Protein-CFP C-terminal fusion, 35S | P26108 | 4953 | Late flowering |
| G1364 | CAAT (29-118) | 952 | G481 | Protein-CFP C-terminal fusion, 35S | P26108 | 4953 | Darker green leaf color |
| G2345 | CAAT (28-117) | 1476 | G481 | 2 comp. including P6506 (35S prom.) | P8079 | 4607 | More tol. to drought* and better recovery from drought treatment* |
| G2345 | CAAT (28-117) | 1476 | G481 | 2 comp. including P6506 (35S prom.) | P8079 | 4607 | Greater tol. to cold (8 C.) |
| G3470 | CAAT (27-116) | 1922 | G481 | GAL4 C-term (Super Active), 35S | P26500 | 5018 | Early flowering |
| G3470 | CAAT (27-116) | 1922 | G481 | Const. 35S prom. | P21341 | 4792 | Greater tol. to cold (8 C.) |
| G3470 | CAAT (27-116) | 1922 | G481 | Const. 35S prom. | P21341 | 4792 | More tol. to drought* and better recovery from drought treatment* |
| G3470 | CAAT (27-116) | 1922 | G481 | Const. 35S prom. | P21341 | 4792 | Late flowering |
| G3470 | CAAT (27-116) | 1922 | G481 | Const. 35S prom. | P21341 | 4792 | Greater tol. to dehydration |
| G3470 | CAAT (27-116) | 1922 | G481 | Const. 35S prom. | P21471 | 4818 | Less sens. to ABA |
| G3470 | CAAT (27-116) | 1922 | G481 | Const. 35S prom. | P21341 | 4792 | Darker green leaf color |
| G3470 | CAAT (27-116) | 1922 | G481 | Const. 35S prom. | P21471 | 4818 | Darker green leaf color |
| G3470 | CAAT (27-116) | 1922 | G481 | Const. 35S prom. | P21471 | 4818 | Greater tol. to hyperosmotic stress; more tol to 9.4% sucrose, 300 mM mannitol or 150 mM NaCl |
| G3470 | CAAT (27-116) | 1922 | G481 | Const. 35S prom. | P21471 | 4818 | Greater seedling vigor |
| G3470 | CAAT (27-116) | 1922 | G481 | Const. 35S prom. | P21471 | 4818 | Greater seedling vigor |
| G3470 | CAAT (27-116) | 1922 | G481 | Const. 35S prom. | P21471 | 4818 | Greater tol. to NaCl (determined with 150 mM NaCl) |
| G3470 | CAAT (27-116) | 1922 | G481 | Const. 35S prom. | P21471 | 4818 | Greater tol. to NaCl (determined with 150 mM NaCl) |
| G3471 | CAAT (26-115) | 1924 | G481 | Const. 35S prom. | P21342 | 4793 | More tol. to drought* and better recovery from drought treatment* |
| G3471 | CAAT (26-115) | 1924 | G481 | Const. 35S prom. | P21342 | 4793 | Darker green leaf color |
| G3471 | CAAT (26-115) | 1924 | G481 | Const. 35S prom. | P21342 | 4793 | Late flowering |
| G3472 | CAAT (25-114) | 1926 | G481 | Const. 35S prom. | P21348 | 4797 | More root hair |
| G3472 | CAAT (25-114) | 1926 | G481 | Const. 35S prom. | P21348 | 4797 | Greater tol. to NaCl (determined with 150 mM NaCl) |
| G3474 | CAAT (25-114) | 1930 | G481 | Const. 35S prom. | P21344 | 4794 | Early flowering |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3474 | CAAT (25-114) | 1930 | G481 | Const. 35S prom. | P21469 | 4817 | Early flowering |
| G3475 | CAAT (23-112) | 1932 | G481 | Const. 35S prom. | P21347 | 4796 | Early flowering |
| G3475 | CAAT (23-112) | 1932 | G481 | Const. 35S prom. | P21347 | 4796 | Greater tol. to cold (8 C.) |
| G3476 | CAAT (26-115) | 1934 | G481 | Const. 35S prom. | P21345 | 4795 | Greater tol. to cold (8 C.) |
| G3476 | CAAT (26-115) | 1934 | G481 | Const. 35S prom. | P21345 | 4795 | More tol. to drought* and better recovery from drought treatment* |
| G3476 | CAAT (26-115) | 1934 | G481 | Const. 35S prom. | P21345 | 4795 | Greater tol. to dehydration |
| G3476 | CAAT (26-115) | 1934 | G481 | Const. 35S prom. | P21345 | 4795 | Early flowering |
| G3478 | CAAT (23-112) | 1936 | G481 | Const. 35S prom. | P21350 | 4798 | Early flowering |
| G3873 | CAAT (29-118) | 2184 | G481 | Const. 35S prom. | P25777 | 4932 | Late flowering |
| G3874 | CAAT (25-114) | 2186 | G481 | Const. 35S prom. | P25778 | 4933 | Early flowering |
| G3874 | CAAT (25-114) | 2186 | G481 | Const. 35S prom. | P25778 | 4933 | Greater seedling vigor |
| G3875 | CAAT (25-114) | 2188 | G481 | Const. 35S prom. | P26609 | 5042 | Altered flowering time; some lines flowered early, others late |
| G3875 | CAAT (25-114) | 2188 | G481 | Const. 35S prom. | P26609 | 5042 | Greater tol. to cold (8 C.) |
| G3875 | CAAT (25-114) | 2188 | G481 | Const. 35S prom. | P26609 | 5042 | Darker green leaf color |
| G3473 | CAAT (23-113) | 1928 | G481 | — | — | | n/d |
| G3394 | CAAT (38-126) | 1860 | G481 | Const. 35S prom. | P23384 | 4830 | Late flowering |
| G3394 | CAAT (38-126) | 1860 | G481 | Const. 35S prom. | P23481 | 4840 | Late flowering |
| G3394 | CAAT (38-126) | 1860 | G481 | Const. 35S prom. | P21248 | 4756 | Early flowering |
| G3395 | CAAT (19-108) | 1862 | G481 | Const. 35S prom. | P21253 | 4759 | Altered flowering time; some lines flowered early, others late |
| G3395 | CAAT (19-108) | 1862 | G481 | Const. 35S prom. | P21253 | 4759 | More tol. to drought* and better recovery from drought treatment* |
| G3396 | CAAT (21-110) | 1864 | G481 | Const. 35S prom. | P23304 | 4826 | Greater tol. to cold (8 C.) |
| G3396 | CAAT (21-110) | 1864 | G481 | Const. 35S prom. | P23304 | 4826 | Late flowering |
| G3396 | CAAT (21-110) | 1864 | G481 | Const. 35S prom. | P23304 | 4826 | Less sens. to ABA |
| G3396 | CAAT (21-110) | 1864 | G481 | Const. 35S prom. | P23304 | 4826 | Larger leaf size |
| G3396 | CAAT (21-110) | 1864 | G481 | Const. 35S prom. | P23304 | 4826 | Altered leaf shape |
| G3396 | CAAT (21-110) | 1864 | G481 | Const. 35S prom. | P23304 | 4826 | Darker green leaf color |
| G3396 | CAAT (21-110) | 1864 | G481 | Const. 35S prom. | P23304 | 4826 | More tol. to drought* and better recovery from drought treatment* |
| G3396 | CAAT (21-110) | 1864 | G481 | GAL4 C-term (Super Active), 35S | P26499 | 5017 | Early flowering |
| G3397 | CAAT (23-112) | 1866 | G481 | Const. 35S prom. | P21265 | 4766 | Early flowering |
| G3397 | CAAT (23-112) | 1866 | G481 | Const. 35S prom. | P21265 | 4766 | Greater tol. to cold (8 C.) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3397 | CAAT (23-112) | 1866 | G481 | Const. 35S prom. | P21265 | 4766 | Greater seedling vigor |
| G3398 | CAAT (21-110) | 1868 | G481 | Const. 35S prom. | P21252 | 4758 | Early flowering |
| G3398 | CAAT (21-110) | 1868 | G481 | Const. 35S prom. | P21252 | 4758 | More tol. to drought* and better recovery from drought treatment* |
| G3429 | CAAT (40-124) | 1880 | G481 | Const. 35S prom. | P21251 | 4757 | Late flowering |
| G3429 | CAAT (40-124) | 1880 | G481 | Const. 35S prom. | P21251 | 4757 | Greater tol. to NaCl (determined with 150 mM NaCl) |
| G3434 | CAAT (18-107) | 1886 | G481 | Const. 35S prom. | P21466 | 4815 | Greater tol. to dehydration |
| G3434 | CAAT (18-107) | 1886 | G481 | Const. 35S prom. | P21466 | 4815 | Early flowering |
| G3434 | CAAT (18-107) | 1886 | G481 | Const. 35S prom. | P21466 | 4815 | Greater tol. to NaCl (determined with 150 mM NaCl) |
| G3434 | CAAT (18-107) | 1886 | G481 | Const. 35S prom. | P21466 | 4815 | More tol. to drought* and better recovery from drought treatment* |
| G3434 | CAAT (18-107) | 1886 | G481 | Const. 35S prom. | P21466 | 4815 | Greater tol. to hyperosmotic stress; more tol. to 9.4% sucrose, 300 mM mannitol or 150 mM NaCl |
| G3434 | CAAT (18-107) | 1886 | G481 | Point mutation, 35S | P26921 | 5064 | Greater biomass |
| G3434 | CAAT (18-107) | 1886 | G481 | Point mutation, 35S | P26921 | 5064 | Late flowering |
| G3434 | CAAT (18-107) | 1886 | G481 | Point mutation, 35S | P26922 | 5065 | Early flowering |
| G3435 | CAAT (22-111) | 1888 | G481 | Const. 35S prom. | P21314 | 4784 | More tol. to drought* and better recovery from drought treatment* |
| G3435 | CAAT (22-111) | 1888 | G481 | Const. 35S prom. | P21314 | 4784 | Early flowering |
| G3436 | CAAT (20-109) | 1890 | G481 | Const. 35S prom. | P21381 | 4805 | Early flowering |
| G3436 | CAAT (20-109) | 1890 | G481 | Const. 35S prom. | P21315 | 4785 | Early flowering |
| G3436 | CAAT (20-109) | 1890 | G481 | Const. 35S prom. | P21381 | 4805 | Greater tol. to heat (32 C.) |
| G3436 | CAAT (20-109) | 1890 | G481 | Const. 35S prom. | P21315 | 4785 | Greater tol. to heat (32 C.) |
| G3866 | CAAT (30-126) | 2182 | G481 | Const. 35S prom. | P26548 | 5020 | Late flowering |
| G3866 | CAAT (30-126) | 2182 | G481 | Const. 35S prom. | P26548 | 5020 | Darker green leaf color |
| G3866 | CAAT (30-126) | 2182 | G481 | Const. 35S prom. | P26548 | 5020 | Greater seedling vigor |
| G3866 | CAAT (30-126) | 2182 | G481 | GAL4 C-term (Super Active), 35S | P26587 | 5025 | Early flowering |
| G3866 | CAAT (30-126) | 2182 | G481 | GAL4 C-term (Super Active), 35S | P26587 | 5025 | Greater tol. to dehydration |
| G3866 | CAAT (30-126) | 2182 | G481 | Point mutation, 35S | P26888 | 5060 | Altered flowering time; some lines flowered early, others flowered late |
| G3866 | CAAT (30-126) | 2182 | G481 | Point mutation, 35S | P26889 | 5061 | Altered flowering time; some lines flowered early, others flowered late |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3866 | CAAT (30-126) | 2182 | G481 | Point mutation, 35S | P26890 | 5062 | Altered flowering time; some lines flowered early, others flowered late |
| G3866 | CAAT (30-126) | 2182 | G481 | Point mutation, 35S | P26888 | 5060 | Darker green leaf color |
| G3866 | CAAT (30-126) | 2182 | G481 | Point mutation, 35S | P26889 | 5061 | Darker green leaf color |
| G3866 | CAAT (30-126) | 2182 | G481 | Point mutation, 35S | P26890 | 5062 | Darker green leaf color |
| G3866 | CAAT (30-126) | 2182 | G481 | Point mutation, 35S | P27228 | 5081 | Darker green leaf color |
| G3866 | CAAT (30-126) | 2182 | G481 | Point mutation, 35S | P27229 | 5082 | Darker green leaf color |
| G3876 | CAAT (30-119) | 2190 | G481 | Const. 35S prom. | P25657 | 4913 | Greater tol. to cold (8 C.) |
| G3876 | CAAT (30-119) | 2190 | G481 | Const. 35S prom. | P25657 | 4913 | Greater tol. to dehydration |
| G3876 | CAAT (30-119) | 2190 | G481 | Const. 35S prom. | P25657 | 4913 | More tol. to drought* and better recovery from drought treatment* |
| G3437 | CAAT (54-143) | 1892 | G481 | — | — | — | n/d |
| G4272 | CAAT (22-118) | 2338 | G481 | — | — | — | n/d |
| G4276 | CAAT (19-108) | 2344 | G481 | — | — | — | n/d |
| G928 | CAAT (179-238) | 696 | G928 | Const. 35S prom. | P143 | 3842 | Greater tol. to cold (8 C.) |
| G928 | CAAT (179-238) | 696 | G928 | Const. 35S prom. | P143 | 3842 | Better recovery from drought treatment* |
| G928 | CAAT (179-238) | 696 | G928 | Const. 35S prom. | P143 | 3842 | Altered sugar sensing; greater tol. to sucrose (determined in 9.4% sucrose) |
| G928 | CAAT (179-238) | 696 | G928 | Protein-YFP C terminal fusion, 35S | P26223 | 4960 | Late flowering |
| G928 | CAAT (179-238) | 696 | G928 | Protein-YFP C terminal fusion, 35S | P26223 | 4960 | Darker green leaf color |
| G928 | CAAT (179-238) | 696 | G928 | Protein-YFP C terminal fusion, 35S | P26223 | 4960 | Greater seedling vigor |
| G931 | CAAT (172-231) | 700 | G928 | Protein-YFP C-terminal fusion, 35S | P26230 | 4961 | Darker green leaf color |
| G931 | CAAT (172-231) | 700 | G928 | Const. 35S prom. | P1608 | 4204 | Greater biomass |
| G3926 | CAAT (164-222) | 2230 | G928 | Const. 35S prom. | P26600 | 5035 | Darker green leaf color |
| G3926 | CAAT (164-222) | 2230 | G928 | Const. 35S prom. | P26600 | 5035 | Greater tol. to cold (8 C.) |
| G3926 | CAAT (164-222) | 2230 | G928 | Const. 35S prom. | P26600 | 5035 | Long petiole |
| G3926 | CAAT (164-222) | 2230 | G928 | Const. 35S prom. | P26600 | 5035 | Altered leaf orientation |
| G3926 | CAAT (164-222) | 2230 | G928 | Const. 35S prom. | P26600 | 5035 | Greater seedling vigor |
| G3921 | CAAT (148-207) | 2224 | G928 | — | — | — | n/d |
| G4264 | CAAT (155-214) | 2326 | G928 | Const. 35S prom. | P26593 | 5029 | Greater tol. to cold (8 C.) |
| G4264 | CAAT (155-214) | 2326 | G928 | Const. 35S prom. | P26593 | 5029 | Greater tol. to dehydration |
| G4264 | CAAT (155-214) | 2326 | G928 | Const. 35S prom. | P26593 | 5029 | Greater seedling vigor |
| G4264 | CAAT (155-214) | 2326 | G928 | Const. 35S prom. | P26593 | 5029 | Late flowering |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G4264 | CAAT (155-214) | 2326 | G928 | Const. 35S prom | P26593 | 5029 | Greater biomass |
| G4264 | CAAT (155-214) | 2326 | G928 | Const. 35S prom. | P26593 | 5029 | Greater biomass |
| G4265 | CAAT (149-208) | 2328 | G928 | — | — | — | n/d |
| G4269 | CAAT (103-162) | 2334 | G928 | — | — | — | n/d |
| G1782 | CAAT (178-237) | 1162 | G1782 | Const. 35S prom. | P966 | 4010 | Greater biomass |
| G1782 | CAAT (178-237) | 1162 | G1782 | Const. 35S prom. | P966 | 4010 | Darker green leaf color |
| G1363 | CAAT (171-230) | 950 | G1782 | Const. 35S prom. | P724 | 3956 | Early flowering |
| G1363 | CAAT (171-230) | 950 | G1782 | Const. 35S prom. | P724 | 3956 | Darker green leaf color |
| G1363 | CAAT (171-230) | 950 | G1782 | Const. 35S fprom. | P724 | 3956 | Greater resistance to *Fusarium* |
| G1363 | CAAT (171-230) | 950 | G1782 | Protein-YFP C-terminal fusion, 35S | P26121 | 4954 | Late flowering |
| G1363 | CAAT (171-230) | 950 | G1782 | Protein-YFP C-terminal fusion, 35S | P26121 | 4954 | Larger leaf size |
| G1363 | CAAT (171-230) | 950 | G1782 | Protein-YFP C-terminal fusion, 35S | P26121 | 4954 | Darker green leaf color |
| G3920 | CAAT (149-208) | 2222 | G1782 | Const. 35S prom. | P26608 | 5041 | More tol. to drought* and better recovery from drought treatment* |
| G3920 | CAAT (149-208) | 2222 | G1782 | Const. 35S prom. | P26608 | 5041 | Greater seedling vigor |
| G3925 | CAAT (138-197) | 2228 | G1782 | Const. 35S prom. | P26597 | 5032 | Darker green leaf color |
| G3925 | CAAT (138-197) | 2228 | G1782 | Const. 35S prom. | P26597 | 5032 | Late flowering |
| G4262 | CAAT (142-201) | 2322 | G1782 | — | — | — | n/d |
| G4263 | CAAT (137-196) | 2324 | G1782 | — | — | — | n/d |
| G4270 | CAAT (131-191) | 2336 | G1782 | — | — | — | n/d |
| G482 & G485 | CAAT (26-115) & CAAT (20-109) | 12 & 394 | G481-related sequences, double knockouts | Double Knockout | not applicable | — | Late flowering |
| G664 | MYB-(R1)R2R3 (14-116) | 528 | G664 | Const. 35S prom. | P98 | 3827 | Better germination and growth in cold (8 C.) |
| G664 | MYB-(R1)R2R3 (14-116) | 528 | G664 | Const. 35S prom. | P98 | 3827 | Altered light response; greater shade tol.; lack of shade avoidance phenotype |
| G197 | MYB-(R1)R2R3 (14-116) | 166 | G664 | Const. 35S prom. | P814 | 3980 | No positive physiological results (only 3 lines generated) |
| G255 | MYB-(R1)R2R3 (14-116) | 228 | G664 | Const. 35S prom. | P787 | 3968 | No positive physiological results (only 3 lines generated) |
| G255 | MYB-(R1)R2R3 (14-116) | 228 | G664 | Const. 35S prom. | P1277 | 4094 | Early flowering |
| G3529 | MYB-(R1)R2R3 (14-116) | 1994 | G664 | — | — | — | n/d |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3527 | MYB-(R1)R2R3 (13-117) | 1990 | G664 | — | — | — | n/d |
| G3528 | MYB-(R1)R2R3 (13-117) | 1992 | G664 | — | — | — | n/d |
| G3503 | MYB-(R1)R2R3 (14-116) | 1960 | G664 | — | — | — | n/d |
| G3504 | MYB-(R1)R2R3 (14-116) | 1962 | G664 | — | — | — | n/d |
| G3505 | MYB-(R1)R2R3 (14-116) | 1964 | G664 | — | — | — | n/d |
| G3506 | MYB-(R1)R2R3 (14-116) | 1966 | G664 | — | — | — | n/d |
| G3507 | MYB-(R1)R2R3 (14-116) | 1968 | G664 | — | — | — | n/d |
| G3508 | MYB-(R1)R2R3 (14-116) | 1970 | G664 | — | — | — | n/d |
| G3509 | MYB-(R1)R2R3 (14-116) | 1972 | G664 | — | — | — | n/d |
| G3531 | MYB-(R1)R2R3 (14-116) | 1996 | G664 | — | — | — | n/d |
| G3532 | MYB-(R1)R2R3 (14-116) | 1998 | G664 | — | — | — | n/d |
| G3533 | MYB-(R1)R2R3 (14-116) | 2000 | G664 | — | — | — | n/d |
| G3534 | MYB-(R1)R2R3 (14-116) | 2002 | G664 | — | — | — | n/d |
| G4637 | MYB-(R1)R2R3 (14-116) | 2366 | G664 | — | — | — | n/d |
| G4638 | MYB-(R1)R2R3 (14-116) | 2368 | G664 | — | — | — | n/d |
| G4639 | MYB-(R1)R2R3 (14-116) | 2370 | G664 | — | — | — | n/d |
| G4640 | MYB-(R1)R2R3 (76-178) | 2372 | G664 | — | — | — | n/d |
| G913 | AP2 (62-128) | 682 | G913 | Const. 35S prom. | P929 | 4001 | Darker green leaf color |
| G913 | AP2 (62-128) | 682 | G913 | 2 comp. including P6506 (35S prom.) | P3598 | 4516 | Darker green leaf color |
| G913 | AP2 (62-128) | 682 | G913 | Const. 35S prom. | P929 | 4001 | More tolerant to freezing |
| G913 | AP2 (62-128) | 682 | G913 | Const. 35S prom. | P929 | 4001 | Late flowering |
| G913 | AP2 (62-128) | 682 | G913 | 2 comp. including P9002 (RD29A prom.) | P3598 | 4516 | Greater tol. to dehydration |
| G913 | AP2 (62-128) | 682 | G913 | 2 comp. including P9002 (RD29A prom.) | P3598 | 4516 | Greater tol. to cold (8 C.) |
| G913 | AP2 (62-128) | 682 | G913 | 2 comp. including P9002 (RD29A prom.) | P3598 | 4516 | More tol. to drought* and better recovery from drought treatment* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G913 | AP2 (62-128) | 682 | G913 | 2 comp. including P9002 (RD29A prom.) | P3598 | 4516 | Decreased proline |
| G913 | AP2 (62-128) | 682 | G913 | 2 comp. including P9002 (RD29A prom.) | P3598 | 4516 | Photosynthesis rate reduced |
| G913 | AP2 (62-128) | 682 | G913 | 2 comp. including P9002 (RD29A prom.) | P3598 | 4516 | Late flowering |
| G913 | AP2 (62-128) | 682 | G913 | 2 comp. including P9002 (RD29A prom.) | P3598 | 4516 | Less sens. to ABA |
| G913 | AP2 (62-128) | 682 | G913 | 2 comp. including P9002 (RD29A prom.) | P3598 | 4516 | Darker green leaf color |
| G913 | AP2 (62-128) | 682 | G913 | 2 comp. including P9002 (RD29A prom.) | P3598 | 4516 | Greater tol. to NaCl (determined with 150 mM NaCl) |
| G913 | AP2 (62-128) | 682 | G913 | 2 comp. including P5290 (SUC2 prom.) | P3598 | 4516 | Late flowering |
| G913 | AP2 (62-128) | 682 | G913 | 2 comp. including P5290 (SUC2 prom.) | P3598 | 4516 | Darker green leaf color |
| G976 | AP2 (87-153) | 732 | G913 | Const. 35S prom. | P409 | 3930 | Darker green leaf color |
| G976 | AP2 (87-153) | 732 | G913 | Const. 35S prom. | P409 | 3930 | Waxy leaves |
| G976 | AP2 (87-153) | 732 | G913 | Const. 35S prom. | P409 | 3930 | Late flowering |
| G2514 | AP2 (16-82) | 1544 | G913 | Const. 35S prom | P2404.1 | 5102 | Darker green leaf color |
| G2514 | AP2 (16-82) |  | G913 | Const. 35S prom | — | — | Late flowering |
| G1753 | AP2 (12-80) | 1138 | G913 | Const. 35S prom. | P3326 | 4499 | Altered inflorescence architecture; inflorescences had short internodes, which led to a more compact bushier architecture |
| G1753 | AP2 (12-80) | 1138 | G913 | Const. 35S prom. | P3326 | 4499 | Altered sugar sensing and/or inc. tol. to hyperosmotic stress; greater tol. to sucrose (determined in 9.4% sucrose) |
| G1753 | AP2 (12-80) | 1138 | G913 | Const. 35S prom. | P3326 | 4499 | Inc. tol. to hyperosmotic stress (determined in 9.4% sucrose) |
| G1753 | AP2 (12-80) | 1138 | G913 | Const. 35S prom. | P3326 | 4499 | Darker green leaf color |
| G1073 | AT-hook (63-71, 71-216) | 18 | G1073 | Const. 35S prom. | P448 | 3936 | Altered branching, short internodes |
| G1073 | AT-hook (63-71, 71-216) | 18 | G1073 | Const. 35S prom. | P448 | 3936 | Greater to substantially greater plant size |
| G1073 | AT-hook (63-71, 71-216) | 18 | G1073 | Const. 35S prom. | P448 | 3936 | Greater seed yield |
| G1073 | AT-hook (63-71, 71-216) | 18 | G1073 | Const. 35S prom. | P448 | 3936 | More root hair |
| G1073 | AT-hook (63-71, 71-216) | 18 | G1073 | Const. 35S prom. | P448 | 3936 | Greater root mass |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1073 | AT-hook (63-71, 71-216) | 18 | G1073 | 2 comp. including P6506 (35S prom.) | P3369 | 4504 | Greater tol. to hyperosmotic stress; more tol. to 9.4% sucrose, 300 mM mannitol or 150 mM NaCl |
| G1073 | AT-hook (63-71, 71-216) | 18 | G1073 | Const. 35S prom. | P25703 | 4919 | Greater tol. to dehydration |
| G1073 | AT-hook (63-71, 71-216) | 18 | G1073 | Const. 35S prom. | P448 | 3936 | More tol. to drought* and better recovery from drought treatment* |
| G1073 | AT-hook (63-71, 71-216) | 18 | G1073 | Const. 35S prom. | P25703 | 4919 | More tol. to drought* and better recovery from drought treatment* |
| G1073 | AT-hook (63-71, 71-216) | 18 | G1073 | 2 comp. including P6506 (35S prom.) | P3369 | 4504 | More tol. to drought* and better recovery from drought treatment* |
| G1073 | AT-hook (63-71, 71-216) | 18 | G1073 | Const. 35S prom. | P448 | 3936 | Large flower |
| G1073 | AT-hook (63-71, 71-216) | 18 | G1073 | Const. 35S prom. | P25703 | 4919 | Large flower |
| G1073 | AT-hook (63-71, 71-216) | 18 | G1073 | 2 comp. including P6506 (35S prom.) | P3369 | 4504 | Large flower |
| G1073 | AT-hook (63-71, 71-216) | 18 | G1073 | 2 comp. including P5326 (AP1 prom.) | P3369 | 4504 | Greater tol. to cold (8 C.) |
| G1073 | AT-hook (63-71, 71-216) | 18 | G1073 | 2 comp. including P5311 (ARSK1 prom.) | P3369 | 4504 | Greater tol. to NaCl (determined with 150 mM NaCl) |
| G1073 | AT-hook (63-71, 71-216) | 18 | G1073 | 2 comp. including P5311 (ARSK1 prom.) | P3369 | 4504 | More tol. to drought* and better recovery from drought treatment* |
| G1073 | AT-hook (63-71, 71-216) | 18 | G1073 | 2 comp. including P5311 (ARSK1 prom.) | P3369 | 4504 | Greater tol. to NaCl (determined with 150 mM NaCl) |
| G1073 | AT-hook (63-71, 71-216) | 18 | G1073 | 2 comp. including P5319 (AS1 prom.) | P3369 | 4504 | Greater tol. to cold (8 C.) |
| G1073 | AT-hook (63-71, 71-216) | 18 | G1073 | 2 comp. including P5319 (AS1 prom.) | P3369 | 4504 | Greater seedling vigor |
| G1073 | AT-hook (63-71, 71-216) | 18 | G1073 | 2 comp. including P5288 (CUT1 prom.) | P3369 | 4504 | More tol. to hyperosmotic stress; greater tol. to 9.4% sucrose, 300 mM mannitol or 150 mM NaCl |
| G1073 | AT-hook (63-71, 71-216) | 18 | G1073 | 2 comp. including P5288 (CUT1 prom.) | P3369 | 4504 | More tol. to hyperosmotic stress; greater tol. to 9.4% sucrose, 300 mM mannitol or 150 mM NaCl |
| G1073 | AT-hook (63-71, 71-216) | 18 | G1073 | 2 comp. including P5284 (RBCS3 prom.) | P3369 | 4504 | Greater tol. to heat (32 C.) |
| G1073 | AT-hook (63-71, 71-216) | 18 | G1073 | 2 comp. including P5284 (RBCS3 prom.) | P3369 | 4504 | Late flowering |
| G1073 | AT-hook (63-71, 71-216) | 18 | G1073 | 2 comp. including P5284 (RBCS3 prom.) | P3369 | 4504 | Greater biomass |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1073 | AT-hook (63-71, 71-216) | 18 | G1073 | 2 comp. including P5284 (RBCS3 prom.) | P3369 | 4504 | Greater tol. to NaCl (determined with 150 mM NaCl) |
| G1073 | AT-hook (63-71, 71-216) | 18 | G1073 | 2 comp. including P5318 (STM prom.) | P3369 | 4504 | Greater tol. to dehydration |
| G1073 | AT-hook (63-71, 71-216) | 18 | G1073 | 2 comp. including P5318 (STM prom.) | P3369 | 4504 | More tol. to drought* and better recovery from drought treatment* |
| G1073 | AT-hook (63-71, 71-216) | 18 | G1073 | Vascular-specific SUC2 prom. | P21521 | 4823 | More tol. to drought* and better recovery from drought treatment* |
| G1073 | AT-hook (63-69, 71-216) | 18 | G1073 | Vascular-specific SUC2 prom. | P21521 | 4823 | Greater biomass |
| G1073 | AT-hook (63-69, 71-216) | 18 | G1073 | 2 comp. including P5290 (SUC2 prom.) | P3369 | 4504 | Greater biomass |
| G1073 | AT-hook (63-71, 71-216) | 18 | G1073 | Vascular-specific SUC2 prom. | P21521 | 4823 | Greater tol. to cold (8 C.) |
| G1073 | AT-hook (63-71, 71-216) | 18 | G1073 | 2 comp. including P5290 (SUC2 prom.) | P3369 | 4504 | Greater tol. to cold (8 C.) |
| G1073 | AT-hook (63-71, 71-216) | 18 | G1073 | Vascular-specific SUC2 prom. | P21521 | 4823 | Late flowering |
| G1073 | AT-hook (63-71, 71-216) | 18 | G1073 | 2 comp. including P5290 (SUC2 prom.) | P3369 | 4504 | Late flowering |
| G1073 | AT-hook (63-71, 71-216) | 18 | G1073 | GAL4 N-term (Super Active), 35S | P21199 | 4751 | Late flowering |
| G1073 | AT-hook (63-71, 71-216) | 18 | G1073 | GAL4 N-term (Super Active), 35S | P21199 | 4751 | Less sens. to ABA |
| G1073 | AT-hook (63-71, 71-216) | 18 | G1073 | GAL4 N-term (Super Active), 35S | P21199 | 4751 | Altered leaf shape |
| G1073 | AT-hook (63-71, 71-216) | 18 | G1073 | GAL4 N-term (Super Active), 35S | P21199 | 4751 | Darker green leaf color |
| G1073 | AT-hook (63-71, 71-216) | 18 | G1073 | GAL4 C-term (Super Active), 35S | P21145 | 4745 | Greater tol. to dehydration |
| G1073 | AT-hook (63-71, 71-216) | 18 | G1073 | GAL4 C-term (Super Active), 35S | P21145 | 4745 | More tol. to drought* and better recovery from drought treatment* |
| G1073 | AT-hook (63-71, 71-216) | 18 | G1073 | Protein-GFP C terminal fusion, 35S | P25263 | 4884 | More tol. to drought* and better recovery from drought treatment* |
| G1073 | AT-hook (63-71, 71-216) | 18 | G1073 | RNAi (clade) targeted to conserved domain, 35S | P21301 | 4780 | Greater tol. to dehydration |
| G1073 | AT-hook (63-71, 71-216) | 18 | G1073 | RNAi (clade) targeted to conserved domain, 35S | P21160 | 4748 | Greater tol. to dehydration |
| G1073 | AT-hook (63-71, 71-216) | 18 | G1073 | RNAi Gene-Specific (GS), 35S | P21117 | 4743 | Greater tol. to dehydration |
| G1073 | AT-hook (63-71, 71-216) | 18 | G1073 | RNAi Gene-Specific (GS), 35S | P21117 | 4743 | Greater tol. to NaCl (determined with 150 mM NaCl) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1073 | AT-hook (63-71, 71-216) | 18 | G1073 | Deletion variant, 35S | P21271 | 4770 | Greater biomass |
| G1073 | AT-hook (63-71, 71-216) | 18 | G1073 | Deletion variant, 35S | P21272 | 4771 | Altered leaf shape |
| G1073 | AT-hook (63-71, 71-216) | 18 | G1073 | Knockout | not applicable | | Greater tol. to drought* |
| G1073 | AT-hook (63-71, 71-216) | 18 | G1073 | Knockout | not applicable | | Greater root mass |
| G1069 | AT-hook (67-75, 75-218) | 802 | G1073 | Const. 35S prom. | P1178 | 4058 | Larger leaf size |
| G1069 | AT-hook (67-75, 75-218) | 802 | G1073 | Const. 35S prom. | P1178 | 4058 | Altered leaf shape |
| G1069 | AT-hook (67-75, 75-218) | 802 | G1073 | Const. 35S prom. | P1178 | 4058 | Less sens. to ABA |
| G1069 | AT-hook (67-75, 75-218) | 802 | G1073 | Const. 35S prom. | P1178 | 4058 | Altered sugar sensing; greater tol. to sucrose (determined in 9.4% sucrose) |
| G1069 | AT-hook (67-75, 75-218) | 802 | G1073 | Const. 35S prom. | P1178 | 4058 | Altered C/N sensing: greater tol. to low nitrogen conditions in C/N sensing assay |
| G1069 | AT-hook (67-75, 75-218) | 802 | G1073 | Const. 35S prom. | P1178 | 4058 | Altered leaf glucosinolate composition; inc. M39497 |
| G1069 | AT-hook (67-75, 75-218) | 802 | G1073 | Const. 35S prom. | P1178 | 4058 | Altered light response; greater shade tol.; lack of shade avoidance phenotype |
| G1069 | AT-hook (67-75, 75-218) | 802 | G1073 | Const. 35S prom. | P1178 | 4058 | More tol. to drought* |
| G1067 | AT-hook (86-94, 94-247) | 798 | G1073 | 2 comp. including P6506 (35S prom.) | P7832 | 4606 | Greater tol. to cold (8 C.) |
| G1067 | AT-hook (86-94, 94-247) | 798 | G1073 | 2 comp. including P6506 (35S prom.) | P7832 | 4606 | More tol. to drought* and better recovery from drought treatment* |
| G1067 | AT-hook (86-94, 94-247) | 798 | G1073 | 2 comp. including P6506 (35S prom.) | P7832 | 4606 | Altered leaf shape; twisted and up-curled rosette leaves |
| G1067 | AT-hook (86-94, 94-247) | 798 | G1073 | 2 comp. including P6506 (35S prom.) | P7832 | 4606 | Smaller plants |
| G1067 | AT-hook (86-94, 94-247) | 798 | G1073 | 2 comp. including P6506 (35S prom.) | P7832 | 4606 | Reduced fertility |
| G1067 | AT-hook (86-94, 94-247) | 798 | G1073 | 2 comp. including P6506 (35S prom.) | P7832 | 4606 | Less sens. to ABA |
| G1067 | AT-hook (86-94, 94-247) | 798 | G1073 | 2 comp. including P5311 (ARSK1 prom.) | P7832 | 4606 | Greater tol. to dehydration |
| G1067 | AT-hook (86-94, 94-247) | 798 | G1073 | 2 comp. including P5311 (ARSK1 prom.) | P7832 | 4606 | Greater tol. to NaCl (determined with 150 mM NaCl) |
| G1067 | AT-hook (86-94, 94-247) | 798 | G1073 | 2 comp. including P5311 (ARSK1 prom.) | P7832 | 4606 | Greater tol. to NaCl (determined with 150 mM NaCl) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1067 | AT-hook (86-94, 94-247) | 798 | G1073 | 2 comp. including P5284 (RBCS3 prom.) | P7832 | 4606 | Larger leaf size |
| G1067 | AT-hook (86-94, 94-247) | 798 | G1073 | 2 comp. including P5284 (RBCS3 prom.) | P7832 | 4606 | More tol. to drought* and better recovery from drought treatment* |
| G1067 | AT-hook (86-94, 94-247) | 798 | G1073 | 2 comp. including P5284 (RBCS3 prom.) | P7832 | 4606 | Late flowering |
| G1067 | AT-hook (86-94, 94-247) | 798 | G1073 | 2 comp. including P5284 (RBCS3 prom.) | P7832 | 4606 | Altered leaf shape |
| G1067 | AT-hook (86-94, 94-247) | 798 | G1073 | 2 comp. including P5284 (RBCS3 prom.) | P7832 | 4606 | Greater tol. to NaCl (determined with 150 mM NaCl) |
| G1067 | AT-hook (86-94, 94-247) | 798 | G1073 | 2 comp. including P9002 (RD29A prom.) | P7832 | 4606 | Greater tol. to dehydration |
| G1067 | AT-hook (86-94, 94-247) | 798 | G1073 | 2 comp. including P9002 (RD29A prom.) | P7832 | 4606 | More tol. to drought* and better recovery from drought treatment* |
| G1067 | AT-hook (86-94, 94-247) | 798 | G1073 | 2 comp. including P9002 (RD29A prom.) | P7832 | 4606 | Larger leaf size |
| G1067 | AT-hook (86-94, 94-247) | 798 | G1073 | 2 comp. including P9002 (RD29A prom.) | P7832 | 4606 | More root hair |
| G1067 | AT-hook (86-94, 94-247) | 798 | G1073 | 2 comp. including P9002 (RD29A prom.) | P7832 | 4606 | Late flowering |
| G1067 | AT-hook (86-94, 94-247) | 798 | G1073 | 2 comp. including P9002 (RD29A prom.) | P7832 | 4606 | Altered leaf shape |
| G1067 | AT-hook (86-94, 94-247) | 798 | G1073 | 2 comp. including P9002 (RD29A prom.) | P7832 | 4606 | Greater tol. to 300 mM mannitol or to NaCl (determined with 150 mM NaCl) |
| G1067 | AT-hook (86-94, 94-247) | 798 | G1073 | 2 comp. including P9002 (RD29A prom.) | P7832 | 4606 | Greater tol. to NaCl (determined with 150 mM NaCl) |
| G1667 | AT-hook (53-61, 61-204) | 1116 | G1073 | Const. 35S prom. | P1079 | 4046 | Inc. seed protein, decreased seed oil, inc. leaf ?-carotene levels |
| G1075 | AT-hook (78-86, 86-229) | 804 | G1073 | Const. 35S prom. | P450 | 3937 | Reduced or absent flower petals, sepals or stamens |
| G1075 | AT-hook (78-86, 86-229) | 804 | G1073 | Const. 35S prom. | P450 | 3937 | Reduced fertility |
| G2153 | AT-hook (80-88, 88-239) | 1420 | G1073 | Const. 35S prom. | P1740 | 4245 | Less sens. to ABA |
| G2153 | AT-hook (80-88, 88-239) | 1420 | G1073 | 2 comp. including P6506 (35S prom.) | P4524 | 4568 | Less sens. to ABA |
| G2153 | AT-hook (80-88, 88-239) | 1420 | G1073 | Const. 35S prom. | P1740 | 4245 | Greater tol. to cold (8 C.) |
| G2153 | AT-hook (80-88, 88-239) | 1420 | G1073 | 2 comp. including P6506 (35S prom.) | P4524 | 4568 | Greater tol. to cold (8 C.) |
| G2153 | AT-hook (80-88, 88-239) | 1420 | G1073 | Const. 35S prom. | P1740 | 4245 | Large flower |
| G2153 | AT-hook (80-88, 88-239) | 1420 | G1073 | 2 comp. including P6506 (35S prom.) | P4524 | 4568 | Large flower |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G2153 | AT-hook (80-88, 88-239) | 1420 | G1073 | Const. 35S prom. | P1740 | 4245 | Late flowering |
| G2153 | AT-hook (80-88, 88-239) | 1420 | G1073 | 2 comp. including P6506 (35S prom.) | P4524 | 4568 | Late flowering |
| G2153 | AT-hook (80-88, 88-239) | 1420 | G1073 | Const. 35S prom. | P1740 | 4245 | Greater biomass |
| G2153 | AT-hook (80-88, 88-239) | 1420 | G1073 | 2 comp. including P6506 (35S prom.) | P4524 | 4568 | Greater biomass |
| G2153 | AT-hook (80-88, 88-239) | 1420 | G1073 | Const. 35S prom. | P1740 | 4245 | More tol. to drought* and better recovery from drought treatment* |
| G2153 | AT-hook (80-88, 88-239) | 1420 | G1073 | Const. 35S prom. | P1740 | 4245 | More tol to hyperosmotic stress; better germination in 9.4% sucrose or 150 mM NaCl |
| G2153 | AT-hook (80-88, 88-239) | 1420 | G1073 | 2 comp. including P6506 (35S prom.) | P4524 | 4568 | More tol to hyperosmotic stress; better germination in 9.4% sucrose or 150 mM NaCl |
| G3462 | AT hook | | G2153 | Const. 35S prom. | | | Late flowering |
| G2156 | AT-hook (72-80, 80-232) | 1424 | G1073 | 2 comp. including P6506 (35S prom.) | P4418 | 4565 | Less sens. to ABA |
| G2156 | AT-hook (72-80, 80-232) | 1424 | G1073 | Const. 35S prom. | P1721 | 4238 | Large flower |
| G2156 | AT-hook (72-80, 80-232) | 1424 | G1073 | 2 comp. including P6506 (35S prom.) | P4418 | 4565 | Large flower |
| G2156 | AT-hook (72-80, 80-232) | 1424 | G1073 | Const. 35S prom. | P1721 | 4238 | Larger leaf size |
| G2156 | AT-hook (72-80, 80-232) | 1424 | G1073 | Const. 35S prom. | P1721 | 4238 | Greater biomass |
| G2156 | AT-hook (72-80, 80-232) | 1424 | G1073 | Const. 35S prom. | P1721 | 4238 | Late flowering |
| G2156 | AT-hook (72-80, 80-232) | 1424 | G1073 | 2 comp. including P6506 (35S prom.) | P4418 | 4565 | Late flowering |
| G2156 | AT-hook (72-80, 80-232) | 1424 | G1073 | Const. 35S prom. | P1721 | 4238 | Greater tol. to cold (8 C.) |
| G2156 | AT-hook (72-80, 80-232) | 1424 | G1073 | 2 comp. including P6506 (35S prom.) | P4418 | 4565 | Greater tol. to cold (8 C.) |
| G2156 | AT-hook (72-80, 80-232) | 1424 | G1073 | Const. 35S prom. | P1721 | 4238 | Greater tol. to hyperosmotic stress; more tol. to 9.4% sucrose or 150 mM NaCl |
| G2156 | AT-hook (72-80, 80-232) | 1424 | G1073 | 2 comp. including P6506 (35S prom.) | P4418 | 4565 | Greater tol. to hyperosmotic stress; more tol. to 9.4% sucrose or 150 mM NaCl |
| G2156 | AT-hook (72-80, 80-232) | 1424 | G1073 | Const. 35S prom. | P1721 | 4238 | More tol. to drought* and better recovery from drought treatment* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G2156 | AT-hook (72-80, 80-232) | 1424 | G1073 | 2 comp. including P5311 (ARSK1 prom.) | P4418 | 4565 | Late flowering |
| G2156 | AT-hook (72-80, 80-232) | 1424 | G1073 | 2 comp. including P5311 (ARSK1 prom.) | P4418 | 4565 | Greater tol. to dehydration |
| G2156 | AT-hook (72-80, 80-232) | 1424 | G1073 | 2 comp. including P5284 (RBCS3 prom.) | P4418 | 4565 | Larger leaf size |
| G2156 | AT-hook (72-80, 80-232) | 1424 | G1073 | 2 comp. including P5284 (RBCS3 prom.) | P4418 | 4565 | Greater biomass |
| G2156 | AT-hook (72-80, 80-232) | 1424 | G1073 | 2 comp. including P5284 (RBCS3 prom.) | P4418 | 4565 | Late flowering |
| G2156 | AT-hook (72-80, 80-232) | 1424 | G1073 | 2 comp. including P5284 (RBCS3 prom.) | P4418 | 4565 | Less sens. to ABA |
| G2156 | AT-hook (72-80, 80-232) | 1424 | G1073 | 2 comp. including P5284 (RBCS3 prom.) | P4418 | 4565 | Altered leaf shape |
| G2156 | AT-hook (72-80, 80-232) | 1424 | G1073 | 2 comp. including P9002 (RD29A prom.) | P4418 | 4565 | Late flowering |
| G2156 | AT-hook (72-80, 80-232) | 1424 | G1073 | 2 comp. including P9002 (RD29A prom.) | P4418 | 4565 | Less sens. to ABA |
| G2156 | AT-hook (72-80, 80-232) | 1424 | G1073 | 2 comp. including P9002 (RD29A prom.) | P4418 | 4565 | Greater biomass |
| G2157 | AT-hook (88-96, 96-240) | 1426 | G1073 | Const. 35S prom. | P1722 | 4239 | Altered leaf shape |
| G2157 | AT-hook (88-96, 96-240) | 1426 | G1073 | Const. 35S prom. | P1722 | 4239 | Greater tol. to dehydration |
| G2157 | AT-hook (88-96, 96-240) | 1426 | G1073 | Const. 35S prom. | P1722 | 4239 | Larger leaf size |
| G2157 | AT-hook (88-96, 96-240) | 1426 | G1073 | 2 comp. including P5326 (AP1 prom.) | P4419 | 4566 | Significantly greater tomato plant volume |
| G2157 | AT-hook (88-96, 96-240) | 1426 | G1073 | 2 comp. including P5287 (LTP1 prom.) | P4419 | 4566 | Significantly greater tomato plant volume |
| G2157 | AT-hook (88-96, 96-240) | 1426 | G1073 | 2 comp. including P5318 (STM prom.) | P4419 | 4566 | Significantly greater plant volume in tomato plants |
| G3456 | AT-hook (44-52, 52-195) | 1916 | G1073 | Const. 35S prom. | P21328 | 4789 | More tol. to drought* and better recovery from drought treatment* |
| G3456 | AT-hook (44-52, 52-195) | 1916 | G1073 | Const. 35S prom. | P21328 | 4789 | Greater tol. to cold (8 C.) |
| G3456 | AT-hook (44-52, 52-195) | 1916 | G1073 | Const. 35S prom. | P21328 | 4789 | Greater tol. to NaCl (determined with 150 mM NaCl) |
| G3456 | AT-hook (44-52, 52-195) | 1916 | G1073 | Const. 35S prom. | P21328 | 4789 | Larger leaf size |
| G3456 | AT-hook (44-52, 52-195) | 1916 | G1073 | Const. 35S prom. | P21467 | 4816 | Larger leaf size |
| G3456 | AT-hook (44-52, 52-195) | 1916 | G1073 | Const. 35S prom. | P21328 | 4789 | Greater biomass |
| G3456 | AT-hook (44-52, 52-195) | 1916 | G1073 | Const. 35S prom. | P21467 | 4816 | Greater biomass |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3456 | AT-hook (44-52, 52-195) | 1916 | G1073 | Const. 35S prom. | P21328 | 4789 | Darker green leaf color |
| G3456 | AT-hook (44-52, 52-195) | 1916 | G1073 | Const. 35S prom. | P21467 | 4816 | Darker green leaf color |
| G3456 | AT-hook (44-52, 52-195) | 1916 | G1073 | Const. 35S prom. | P21328 | 4789 | Delayed senescence |
| G3456 | AT-hook (44-52, 52-195) | 1916 | G1073 | Const. 35S prom. | P21467 | 4816 | Delayed senescence |
| G3456 | AT-hook (44-52, 52-195) | 1916 | G1073 | Const. 35S prom. | P21328 | 4789 | Decreased apical dominance; slightly short inflorescence internodes leading to a somewhat bushy architecture |
| G3456 | AT-hook (44-52, 52-195) | 1916 | G1073 | Const. 35S prom. | P21467 | 4816 | Decreased apical dominance; slightly short inflorescence internodes leading to a somewhat bushy architecture |
| G3456 | AT-hook (44-52, 52-195) | 1916 | G1073 | Const. 35S prom. | P21328 | 4789 | Late flowering |
| G3456 | AT-hook (44-52, 52-195) | 1916 | G1073 | Const. 35S prom. | P21467 | 4816 | Late flowering |
| G3456 | AT-hook (44-52, 52-195) | 1916 | G1073 | Const. 35S prom. | P21328 | 4789 | Altered leaf shape; curled leaves |
| G3456 | AT-hook (44-52, 52-195) | 1916 | G1073 | Const. 35S prom. | P21467 | 4816 | Altered leaf shape; curled leaves |
| G3459 | AT-hook (77-85, 85-228) | 1918 | G1073 | Const. 35S prom. | P21331 | 4790 | Greater tol. to cold (8 C.) |
| G3459 | AT-hook (77-85, 85-228) | 1918 | G1073 | Const. 35S prom. | P21331 | 4790 | Multiple alterations |
| G3459 | AT-hook (77-85, 85-228) | 1918 | G1073 | Const. 35S prom. | P21331 | 4790 | Late flowering |
| G3459 | AT-hook (77-85, 85-228) | 1918 | G1073 | Const. 35S prom. | P21331 | 4790 | Greater tol. to heat (32 C.) |
| G3459 | AT-hook (77-85, 85-228) | 1918 | G1073 | Const. 35S prom. | P21331 | 4790 | Larger leaf size |
| G3459 | AT-hook (77-85, 85-228) | 1918 | G1073 | Const. 35S prom. | P21331 | 4790 | Greater tol. to NaCl (determined with 150 mM NaCl) |
| G3460 | AT-hook (74-82, 82-225) | 1920 | G1073 | Const. 35S prom. | P21332 | 4791 | Greater biomass |
| G3460 | AT-hook (74-82, 82-225) | 1920 | G1073 | Const. 35S prom. | P21332 | 4791 | More tol. to drought* and better recovery from drought treatment* |
| G3460 | AT-hook (74-82, 82-225) | 1920 | G1073 | Const. 35S prom. | P21332 | 4791 | Greater tol. to heat (32 C.) |
| G3460 | AT-hook (74-82, 82-225) | 1920 | G1073 | Const. 35S prom. | P21332 | 4791 | Darker green leaf color |
| G3460 | AT-hook (74-82, 82-225) | 1920 | G1073 | Const. 35S prom. | P21332 | 4791 | Late flowering |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3407 | AT-hook (63-71, 71-220) | 1876 | G1073 | Const. 35S prom. | P21243 | 4753 | Greater seedling vigor |
| G3400 | AT-hook (83-91, 91-237) | 1872 | G1073 | Const. 35S prom. | P21244 | 4754 | Greater biomass |
| G3400 | AT-hook (83-91, 91-237) | 1872 | G1073 | Const. 35S prom. | P21244 | 4754 | Large flower |
| G3400 | AT-hook (83-91, 91-237) | 1872 | G1073 | Const. 35S prom. | P21244 | 4754 | Late flowering |
| G3400 | AT-hook (83-91, 91-237) | 1872 | G1073 | Const. 35S prom. | P21244 | 4754 | Larger leaf size |
| G3400 | AT-hook (83-91, 91-237) | 1872 | G1073 | Const. 35S prom. | P21244 | 4754 | Altered leaf shape |
| G3400 | AT-hook (83-91, 91-237) | 1872 | G1073 | Const. 35S prom. | P21244 | 4754 | Greater tol. to cold (8 C.) |
| G3400 | AT-hook (83-91, 91-237) | 1872 | G1073 | Const. 35S prom. | P21244 | 4754 | More tol. to drought* and better recovery from drought treatment* |
| G3401 | AT-hook (35-43, 43-186) | 1874 | G1073 | Const. 35S prom. | P21264 | 4765 | More tol. to drought* and better recovery from drought treatment* |
| G3401 | AT-hook (35-43, 43-186) | 1874 | G1073 | Const. 35S prom. | P21264 | 4765 | Late flowering |
| G3401 | AT-hook (35-43, 43-186) | 1874 | G1073 | Const. 35S prom. | P21264 | 4765 | Larger leaf size |
| G3401 | AT-hook (35-43, 43-186) | 1874 | G1073 | Const. 35S prom. | P21264 | 4765 | Altered sugar sensing; greater tol. to sucrose (determined in 9.4% sucrose) |
| G3399 | AT-hook (99-107, 107-253) | 1870 | G1073 | Const. 35S prom. | P21465 | 4814 | More tol. to drought* and better recovery from drought treatment* |
| G3399 | AT-hook (99-107, 107-253) | 1870 | G1073 | Const. 35S prom. | P21465 | 4814 | Large flower |
| G3399 | AT-hook (99-107, 107-253) | 1870 | G1073 | Const. 35S prom. | P21465 | 4814 | Greater tol. to dehydration |
| G3399 | AT-hook (99-107, 107-253) | 1870 | G1073 | Const. 35S prom. | P21269 | 4769 | Greater biomass |
| G3399 | AT-hook (99-107, 107-253) | 1870 | G1073 | Const. 35S prom. | P21465 | 4814 | Greater biomass |
| G3399 | AT-hook (99-107, 107-253) | 1870 | G1073 | Const. 35S prom. | P21269 | 4769 | Late flowering |
| G3399 | AT-hook (99-107, 107-253) | 1870 | G1073 | Const. 35S prom. | P21465 | 4814 | Late flowering |
| G3399 | AT-hook (99-107, 107-253) | 1870 | G1073 | Const. 35S prom. | P21269 | 4769 | Larger leaf size |
| G3399 | AT-hook (99-107, 107-253) | 1870 | G1073 | Const. 35S prom. | P21465 | 4814 | Larger leaf size |
| G3399 | AT-hook (99-105, 107-253) | 1870 | G1073 | Const. 35S prom. | P21269 | 4769 | More root hair |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3399 | AT-hook (99-107, 107-253) | 1870 | G1073 | Const. 35S prom. | P21465 | 4814 | More root hair |
| G3399 | AT-hook (99-107, 107-253) | 1870 | G1073 | Const. 35S prom. | P21269 | 4769 | More root mass |
| G3399 | AT-hook (99-107, 107-253) | 1870 | G1073 | Const. 35S prom. | P21465 | 4814 | More root mass |
| G3556 | AT-hook (45-53, 53-196) | 2034 | G1073 | Const. 35S prom. | P21493 | 4819 | Greater tol. to dehydration |
| G3556 | AT-hook (45-53, 53-196) | 2034 | G1073 | Const. 35S prom. | P21493 | 4819 | Greater tol. to NaCl (determined with 150 mM NaCl) |
| G1266 | AP2 (79-147) | 884 | G1266 | Const. 35S prom. | P483 | 3944 | Greater res. to *Botrytis* |
| G1266 | AP2 (79-147) | 884 | G1266 | Const. 35S prom. | P483 | 3944 | Greater res. to *Erysiphe* |
| G1266 | AP2 (79-147) | 884 | G1266 | Const. 35S prom. | P483 | 3944 | Greater res. to *Sclerotinia* |
| G1266 | AP2 (79-147) | 884 | G1266 | Const. 35S prom. | P483 | 3944 | Less sens. to ABA |
| G1266 | AP2 (79-147) | 884 | G1266 | Const. 35S prom. | P483 | 3944 | Late flowering |
| G1266 | AP2 (79-147) | 884 | G1266 | Const. 35S prom. | P483 | 3944 | Darker green leaf color |
| G1266 | AP2 (79-147) | 884 | G1266 | Const. 35S prom. | P483 | 3944 | Reduced sens. to ABA |
| G1266 | AP2 (79-147) | 884 | G1266 | Const. 35S prom. | P483 | 3944 | Altered C/N sensing: greater tol. to low nitrogen conditions in C/N sensing assay |
| G1266 | AP2 (79-147) | 884 | G1266 | Const. 35S prom. | P483 | 3944 | Altered leaf insoluble sugars, including rhamnose, arabinose, xylose, and mannose, and galactose |
| G1266 | AP2 (79-147) | 884 | | Const. 35S prom. | P483 | 3944 | Greater resistance to *Erysiphe* |
| G1266 | AP2 (79-147) | 884 | | Const. 35S prom. | P483 | 3944 | Reduced sens. to ABA |
| G1274 | WRKY (110-166) | 20 | G1274 | 2 comp. including P6506 (35S prom.) | P8239 | 4609 | Less sens. to ABA |
| G1274 | WRKY (110-166) | 20 | G1274 | Const. 35S prom. | P15038 | 4665 | Greater res. to *Erysiphe* |
| G1274 | WRKY (110-166) | 20 | G1274 | Const. 35S prom. | P15038 | 4665 | Trilocular silique |
| G1274 | WRKY (110-166) | 20 | G1274 | Const. 35S prom. | P15038 | 4665 | Greater seed number |
| G1274 | WRKY (110-166) | 20 | G1274 | Const. 35S prom. | P15038 | 4665 | Altered sugar sensing; greater tol. to sucrose (determined in 9.4% sucrose) |
| G1274 | WRKY (110-166) | 20 | G1274 | Const. 35S prom. | P15038 | 4665 | Greater tol. to cold (8 C.) |
| G1274 | WRKY (110-166) | 20 | G1274 | 2 comp. including P6506 (35S prom.) | P8239 | 4609 | Greater tol. to cold (8 C.) |
| G1274 | WRKY (110-166) | 20 | G1274 | 2 comp. including P6506 (35S prom.) | P8239 | 4609 | Large leaves, greater biomass |
| G1274 | WRKY (110-166) | 20 | G1274 | Const. 35S prom. | P15038 | 4665 | More tol. to drought* and better recovery from drought treatment* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1274 | WRKY (110-166) | 20 | G1274 | 2 comp. including P6506 (35S prom.) | P8239 | 4609 | More tol. to drought* and better recovery from drought treatment* |
| G1274 | WRKY (110-166) | 20 | G1274 | 2 comp. including P5311 (ARSK1 prom.) | P8239 | 4609 | Greater tol. to dehydration |
| G1274 | WRKY (110-166) | 20 | G1274 | 2 comp. including P5319 (AS1 prom.) | P8239 | 4609 | More root hair |
| G1274 | WRKY (110-166) | 20 | G1274 | 2 comp. including P5319 (AS1 prom.) | P8239 | 4609 | More root mass |
| G1274 | WRKY (110-166) | 20 | G1274 | 2 comp. including P5288 (CUT1 prom.) | P8239 | 4609 | Altered C/N sensing: greater tol. to low nitrogen conditions in C/N sensing assay |
| G1274 | WRKY (110-166) | 20 | G1274 | 2 comp. including P5284 (RBCS3 prom.) | P8239 | 4609 | Less sens. to ABA |
| G1274 | WRKY (110-166) | 20 | G1274 | 2 comp. including P5284 (RBCS3 prom.) | P8239 | 4609 | Altered C/N sensing: greater tol. to low nitrogen conditions in C/N sensing assay |
| G1274 | WRKY (110-166) | 20 | G1274 | 2 comp. including P5284 (RBCS3 prom.) | P8239 | 4609 | Greater tol. to 300 mM mannitol |
| G1274 | WRKY (110-166) | 20 | G1274 | 2 comp. including P9002 (RD29A prom.) | P8239 | 4609 | Better recovery from drought treatment* |
| G1274 | WRKY (110-166) | 20 | G1274 | 2 comp. including P5318 (STM prom.) | P8239 | 4609 | Greater tol. to cold (8 C.) |
| G1274 | WRKY (110-166) | 20 | G1274 | 2 comp. including P5318 (STM prom.) | P8239 | 4609 | Greater tol. to dehydration |
| G1274 | WRKY (110-166) | 20 | G1274 | 2 comp. including P5318 (STM prom.) | P8239 | 4609 | Better recovery from drought treatment* |
| G1274 | WRKY (110-166) | 20 | G1274 | 2 comp. including P5290 (SUC2 prom.) | P8239 | 4609 | Greater tol. to dehydration |
| G1274 | WRKY (110-166) | 20 | G1274 | 2 comp. including P5290 (SUC2 prom.) | P8239 | 4609 | Altered C/N sensing: greater tol. to low nitrogen conditions in C/N sensing assay |
| G1274 | WRKY (110-166) | 20 | G1274 | GAL4 N-term (Super Active), 35S | P25659 | 4915 | Greater tol. to dehydration |
| G1274 | WRKY (110-166) | 20 | G1274 | GAL4 C-term (Super Active), 35S | P25658 | 4914 | Decreased apical dominance; short bushy inflorescences |
| G1274 | WRKY (110-166) | 20 | G1274 | GAL4 C-term (Super Active), 35S | P25658 | 4914 | Larger leaf size |
| G1274 | WRKY (110-166) | 20 | G1274 | GAL4 C-term (Super Active), 35S | P25658 | 4914 | Greater tol. to dehydration |
| G1274 | WRKY (110-166) | 20 | G1274 | Point mutation, 35S | P25744 | 4929 | Less sens. to ABA |
| G1274 | WRKY (110-166) | 20 | G1274 | Point mutation, 35S | P25744 | 4929 | Greater tol. to dehydration |
| G1274 | WRKY (110-166) | 20 | G1274 | Point mutation, 35S | P25746 | 4931 | Greater tol. to low nitrogen conditions |
| G1274 | WRKY (110-166) | 20 | G1274 | Point mutation, 35S | P25742 | 4927 | Altered sugar sensing; greater tol. to sucrose (determined in 9.4% sucrose) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1274 | WRKY (110-166) | 20 | G1274 | Point mutation, 35S | P25746 | 4931 | Altered sugar sensing; greater tol. to sucrose (determined in 9.4% sucrose) |
| G1274 | WRKY (110-166) | 20 | G1274 | Point mutation, 35S | P25742 | 4927 | Altered C/N sensing: greater tol. to low nitrogen conditions in C/N sensing assay |
| G1274 | WRKY (110-166) | 20 | G1274 | Point mutation, 35S | P25743 | 4928 | Altered C/N sensing: greater tol. to low nitrogen conditions in C/N sensing assay |
| G1274 | WRKY (110-166) | 20 | G1274 | Point mutation, 35S | P25745 | 4930 | Altered C/N sensing: greater tol. to low nitrogen conditions in C/N sensing assay |
| G1274 | WRKY (110-166) | 20 | G1274 | Point mutation, 35S | P25742 | 4927 | Greater tol. to cold (8 C.) |
| G1274 | WRKY (110-166) | 20 | G1274 | Point mutation, 35S | P25743 | 4928 | Greater tol. to cold (8 C.) |
| G1274 | WRKY (110-166) | 20 | G1274 | Point mutation, 35S | P25745 | 4930 | Greater tol. to cold (8 C.) |
| G1274 | WRKY (110-166) | 20 | G1274 | Point mutation, 35S | P25746 | 4931 | Greater tol. to cold (8 C.) |
| G1274 | WRKY (110-166) | 20 | G1274 | Point mutation, 35S | P25742 | 4927 | More tol. to drought* and show better recovery from drought treatment* |
| G1274 | WRKY (110-166) | 20 | G1274 | Point mutation, 35S | P25743 | 4928 | More tol. to drought* and show better recovery from drought treatment* |
| G1274 | WRKY (110-166) | 20 | G1274 | Point mutation, 35S | P25745 | 4930 | More tol. to drought* and show better recovery from drought treatment* |
| G1274 | WRKY (110-166) | 20 | G1274 | Point mutation, 35S | P25746 | 4931 | More tol. to drought* and show better recovery from drought treatment* |
| G1274 | WRKY (110-166) | 20 | G1274 | Point mutation, 35S | P25742 | 4927 | Larger leaf size |
| G1274 | WRKY (110-166) | 20 | G1274 | Point mutation, 35S | P25743 | 4928 | Larger leaf size |
| G1274 | WRKY (110-166) | 20 | G1274 | Point mutation, 35S | P25745 | 4930 | Larger leaf size |
| G1274 | WRKY (110-166) | 20 | G1274 | Point mutation, 35S | P25746 | 4931 | Larger leaf size |
| G1274 | WRKY (110-166) | 20 | G1274 | Point mutation, 35S | P25744 | 4929 | Larger leaf size |
| G1274 | WRKY (110-166) | 20 | G1274 | Point mutation, 35S | P25742 | 4927 | Inflorescence: decreased apical dominance |
| G1274 | WRKY (110-166) | 20 | G1274 | Point mutation, 35S | P25743 | 4928 | Inflorescence: decreased apical dominance |
| G1274 | WRKY (110-166) | 20 | G1274 | Point mutation, 35S | P25745 | 4930 | Inflorescence: decreased apical dominance |
| G1274 | WRKY (110-166) | 20 | G1274 | Point mutation, 35S | P25746 | 4931 | Inflorescence: decreased apical dominance |
| G1274 | WRKY (110-166) | 20 | G1274 | Point mutation, 35S | P25744 | 4929 | Inflorescence: decreased apical dominance |
| G1274 | WRKY (110-166) | 20 | G1274 | Domain swap/chimeric variant, 35S | P25435 | 4901 | Greater tol. to cold (8 C.) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1274 | WRKY (110-166) | 20 | G1274 | Domain swap/chimeric variant, 35S | P25435 | 4901 | Altered C/N sensing: greater tol. to low nitrogen conditions in C/N sensing assay |
| G1274 | WRKY (110-166) | 20 | G1274 | Domain swap/chimeric variant, 35S | P25435 | 4901 | Greater tol. to dehydration |
| G1274 | WRKY (110-166) | 20 | G1274 | Domain swap/chimeric variant, 35S | P25435 | 4901 | Larger leaf size |
| G1274 | WRKY (110-166) | 20 | G1274 | Domain swap/chimeric variant, 35S | P25435 | 4901 | Altered sugar sensing; greater tol. to sucrose (determined in 9.4% sucrose) |
| G1274 | WRKY (110-166) | 20 | G1274 | Knockout | not applicable | | Altered C/N sensing: greater tol. to low nitrogen conditions in C/N sensing assay |
| G1275 | WRKY (113-169) | 894 | G1274 | Const. 35S prom. | P486 | 3946 | Greater tol. to cold (8 C.) |
| G1275 | WRKY (113-169) | 894 | G1274 | Const. 35S prom. | P486 | 3946 | Greater tol. to heat (32 C.) |
| G1275 | WRKY (113-169) | 894 | G1274 | Const. 35S prom. | P486 | 3946 | Reduced apical dominance |
| G1275 | WRKY (113-169) | 894 | G1274 | Const. 35S prom. | P486 | 3946 | Smaller plants |
| G1275 | WRKY (113-169) | 894 | G1274 | 2 comp. including P5319 (AS1 prom.) | P3412 | 4511 | More root mass |
| G1275 | WRKY (113-169) | 894 | G1274 | 2 comp. including P5319 (AS1 prom.) | P3412 | 4511 | Larger leaf size |
| G1275 | WRKY (113-169) | 894 | G1274 | 2 comp. including P5288 (CUT1 prom.) | P3412 | 4511 | Greater tol. to cold (8 C.) |
| G1275 | WRKY (113-169) | 894 | G1274 | 2 comp. including P5288 (CUT1 prom.) | P3412 | 4511 | Better recovery from drought treatment* |
| G1275 | WRKY (113-169) | 894 | G1274 | 2 comp. including P5288 (CUT1 prom.) | P3412 | 4511 | Altered C/N sensing: greater tol. to low nitrogen conditions in C/N sensing assay |
| G1275 | WRKY (113-169) | 894 | G1274 | 2 comp. including P5288 (CUT1 prom.) | P3412 | 4511 | Altered sugar sensing; greater tol. to sucrose (determined in 9.4% sucrose) |
| G1275 | WRKY (113-169) | 894 | G1274 | 2 comp. including P9002 (RD29A prom.) | P3412 | 4511 | More tol. to drought* and better recovery from drought treatment* |
| G1275 | WRKY (113-169) | 894 | G1274 | 2 comp. including P9002 (RD29A prom.) | P3412 | 4511 | Less sens. to ABA |
| G1275 | WRKY (113-169) | 894 | G1274 | 2 comp. including P5318 (STM prom.) | P3412 | 4511 | Greater tol. to low nitrogen conditions |
| G1275 | WRKY (113-169) | 894 | G1274 | 2 comp. including P5290 (SUC2 prom.) | P3412 | 4511 | Altered C/N sensing: greater tol. to low nitrogen conditions in C/N sensing assay |
| G1275 | WRKY (113-169) | 894 | G1274 | 2 comp. including P5290 (SUC2 prom.) | P3412 | 4511 | Late flowering |
| G1275 | WRKY (113-169) | 894 | G1274 | 2 comp. including P5290 (SUC2 prom.) | P3412 | 4511 | Darker green leaf color |
| G1275 | WRKY (113-169) | 894 | G1274 | 2 comp. including P5290 (SUC2 prom.) | P3412 | 4511 | Decreased root mass |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G194 | WRKY (174-230) | 162 | G1274 | Const. 35S prom. | P197 | 3863 | Greater tol. to dehydration |
| G194 | WRKY (174-230) | 162 | G1274 | Const. 35S prom. | P197 | 3863 | Small plant |
| G1758 | WRKY (109-165) | 1144 | G1274 | Const. 35S prom. | P1224 | 4071 | Greater tol. to cold (8 C.) |
| G2517 | WRKY (117-177) | 1548 | G1274 | Const. 35S prom. | P1833 | 4268 | Greater tol. to dehydration |
| G2517 | WRKY (117-177) | 1548 | G1274 | Const. 35S prom. | P1833 | 4268 | Early flowering |
| G2517 | WRKY (117-177) | 1548 | G1274 | Const. 35S prom. | P1833 | 4268 | More tol. to glyphosate |
| G179 | WRKY (65-121) | 138 | G1274 | Domain swap/chimeric variant, 35S | P25439 | 4904 | Less sens. to ABA |
| G179 | WRKY (65-121) | 138 | G1274 | Domain swap/chimeric variant, 35S | P25439 | 4904 | Altered sugar sensing; greater tol. to sucrose (determined in 9.4% sucrose) |
| G3723 | WRKY (112-168) | 2088 | G1274 | Const. 35S prom. | P25208 | 4868 | Inflorescence: decreased apical dominance |
| G3723 | WRKY (112-168) | 2088 | G1274 | Const. 35S prom. | P25208 | 4868 | Larger leaf size |
| G3723 | WRKY (112-168) | 2088 | G1274 | Const. 35S prom. | P25208 | 4868 | Altered leaf shape |
| G3723 | WRKY (112-168) | 2088 | G1274 | Const. 35S prom. | P25208 | 4868 | Greater seedling vigor |
| G3724 | WRKY (107-163) | 2090 | G1274 | Const. 35S prom. | P25384 | 4895 | Greater tol. to cold (8 C.) |
| G3724 | WRKY (107-163) | 2090 | G1274 | Const. 35S prom. | P25384 | 4895 | Less sens. to ABA |
| G3724 | WRKY (107-163) | 2090 | G1274 | Const. 35S prom. | P25384 | 4895 | Larger leaf size |
| G3724 | WRKY (107-163) | 2090 | G1274 | Const. 35S prom. | P25384 | 4895 | More root mass |
| G3724 | WRKY (107-163) | 2090 | G1274 | Const. 35S prom. | P25384 | 4895 | Greater biomass |
| G3724 | WRKY (107-163) | 2090 | G1274 | Const. 35S prom. | P25384 | 4895 | Greater tol. to NaCl (determined with 150 mM NaCl) |
| G3724 | WRKY (107-163) | 2090 | G1274 | Const. 35S prom. | P25384 | 4895 | More tol. to drought* and better recovery from drought treatment* |
| G3724 | WRKY (107-163) | 2090 | G1274 | Const. 35S prom. | P25384 | 4895 | Late flowering |
| G3724 | WRKY (107-163) | 2090 | G1274 | Const. 35S prom. | P25384 | 4895 | Altered leaf shape |
| G3724 | WRKY (107-163) | 2090 | G1274 | Const. 35S prom. | P25384 | 4895 | Greater tol. to hyperosmotic stress; more tol. to 9.4% sucrose or to 150 mM NaCl |
| G3803 | WRKY (111-167) | 2134 | G1274 | Const. 35S prom. | P25218 | 4874 | Inflorescence: decreased apical dominance |
| G3803 | WRKY (111-167) | 2134 | G1274 | Const. 35S prom. | P25218 | 4874 | Decreased tol. to cold (8 C.) |
| G3803 | WRKY (111-167) | 2134 | G1274 | Const. 35S prom. | P25218 | 4874 | Late flowering |
| G3803 | WRKY (111-167) | 2134 | G1274 | Const. 35S prom. | P25218 | 4874 | Early flowering |
| G3803 | WRKY (111-167) | 2134 | G1274 | Const. 35S prom. | P25218 | 4874 | Altered leaf shape |
| G3803 | WRKY (111-167) | 2134 | G1274 | Const. 35S prom. | P25218 | 4874 | Altered silique development |
| G3721 | WRKY (96-152) | 2084 | G1274 | Const. 35S prom. | P25368 | 4893 | Greater tol. to cold (8 C.) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3721 | WRKY (96-152) | 2084 | G1274 | Const. 35S prom. | P25368 | 4893 | More tol. to drought* and better recovery from drought treatment* |
| G3721 | WRKY (96-152) | 2084 | G1274 | Const. 35S prom. | P25368 | 4893 | Less sens. to ABA |
| G3721 | WRKY (96-152) | 2084 | G1274 | Const. 35S prom. | P25368 | 4893 | Greater tol. to NaCl (determined with 150 mM NaCl) |
| G3721 | WRKY (96-152) | 2084 | G1274 | Const. 35S prom. | P25368 | 4893 | Inflorescence: decreased apical dominance |
| G3721 | WRKY (96-152) | 2084 | G1274 | Const. 35S prom. | P25368 | 4893 | Greater tol. to 300 mM mannitol or to NaCl (determined with 150 mM NaCl) |
| G3725 | WRKY (158-214) | 2092 | G1274 | Const. 35S prom. | P25210 | 4869 | More root mass |
| G3726 | WRKY (135-191) | 2094 | G1274 | Const. 35S prom. | P25211 | 4870 | Inflorescence: decreased apical dominance |
| G3726 | WRKY (135-191) | 2094 | G1274 | Const. 35S prom. | P25211 | 4870 | Greater tol. to cold (8 C.) |
| G3726 | WRKY (135-191) | 2094 | G1274 | Const. 35S prom. | P25211 | 4870 | More tol. to drought* and better recovery from drought treatment* |
| G3726 | WRKY (135-191) | 2094 | G1274 | Const. 35S prom. | P25211 | 4870 | Early flowering |
| G3729 | WRKY (137-193) | 2100 | G1274 | Const. 35S prom. | P25214 | 4872 | Altered C/N sensing: greater tol. to low nitrogen conditions in C/N sensing assay |
| G3729 | WRKY (137-193) | 2100 | G1274 | Const. 35S prom. | P25214 | 4872 | Greater tol. to cold (8 C.) |
| G3729 | WRKY (137-193) | 2100 | G1274 | Const. 35S prom. | P25214 | 4872 | Larger leaf size |
| G3729 | WRKY (137-193) | 2100 | G1274 | Const. 35S prom. | P25214 | 4872 | Trilocular silique |
| G3729 | WRKY (137-193) | 2100 | G1274 | Const. 35S prom. | P25214 | 4872 | Greater seed number |
| G3729 | WRKY (137-193) | 2100 | G1274 | Const. 35S prom. | P25214 | 4872 | Greater biomass |
| G3730 | WRKY (107-163) | 2102 | G1274 | Const. 35S prom. | P25215 | 4873 | Inflorescence: decreased apical dominance |
| G3730 | WRKY (107-163) | 2102 | G1274 | Const. 35S prom. | P25215 | 4873 | Late flowering |
| G3730 | WRKY (107-163) | 2102 | G1274 | Const. 35S prom. | P25215 | 4873 | Altered leaf shape |
| G3730 | WRKY (107-163) | 2102 | G1274 | Const. 35S prom. | P25215 | 4873 | Leaf orientation |
| G3730 | WRKY (107-163) | 2102 | G1274 | Const. 35S prom. | P25215 | 4873 | Trilocular silique |
| G3730 | WRKY (107-163) | 2102 | G1274 | Const. 35S prom. | P25215 | 4873 | Greater seed number |
| G3719 | WRKY (98-154) | 2080 | G1274 | Const. 35S prom. | P25204 | 4865 | Inflorescence: decreased apical dominance |
| G3720 | WRKY (135-191) | 2082 | G1274 | Const. 35S prom. | P25205 | 4866 | Inflorescence: decreased apical dominance |
| G3720 | WRKY (135-191) | 2082 | G1274 | Const. 35S prom. | P25205 | 4866 | Greater tol. to low nitrogen conditions |
| G3722 | WRKY (129-185) | 2086 | G1274 | Const. 35S prom. | P25207 | 4867 | Inflorescence: decreased apical dominance |
| G3722 | WRKY (129-185) | 2086 | G1274 | Const. 35S prom. | P25207 | 4867 | Altered C/N sensing: greater tol. to low nitrogen conditions in C/N sensing assay |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3727 | WRKY (102-158) | 2096 | G1274 | Const. 35S prom. | P25385 | 4896 | Inflorescence: decreased apical dominance |
| G3727 | WRKY (102-158) | 2096 | G1274 | Const. 35S prom. | P25385 | 4896 | Early flowering |
| G3727 | WRKY (102-158) | 2096 | G1274 | Const. 35S prom. | P25385 | 4896 | Greater tol. to low nitrogen conditions |
| G3727 | WRKY (102-158) | 2096 | G1274 | Const. 35S prom. | P25385 | 4896 | Trilocular silique |
| G3727 | WRKY (102-158) | 2096 | G1274 | Const. 35S prom. | P25385 | 4896 | Greater seed number |
| G3728 | WRKY (108-164) | 2098 | G1274 | Const. 35S prom. | P25213 | 4871 | Inflorescence: decreased apical dominance |
| G3728 | WRKY (108-164) | 2098 | G1274 | Const. 35S prom. | P25213 | 4871 | Altered silique development |
| G3804 | WRKY (108-164) | 2136 | G1274 | Const. 35S prom. | P25219 | 4875 | More tol. to drought* and better recovery from drought treatment* |
| G3804 | WRKY (108-164) | 2136 | G1274 | Const. 35S prom. | P25219 | 4875 | Greater tol. to cold (8 C.) |
| G3804 | WRKY (108-164) | 2136 | G1274 | Const. 35S prom. | P25219 | 4875 | Greater tol. to cold (8 C.) |
| G3804 | WRKY (108-164) | 2136 | G1274 | Const. 35S prom. | P25219 | 4875 | Early flowering |
| G3804 | WRKY (108-164) | 2136 | G1274 | Const. 35S prom. | P25219 | 4875 | Altered leaf shape |
| G3804 | WRKY (108-164) | 2136 | G1274 | Const. 35S prom. | P25219 | 4875 | Trilocular silique |
| G1543 | HB (135-195) | 1062 | G1543 | Const. 35S prom. | P1051 | 4038 | Altered architecture, compact plant |
| G1543 | HB (135-195) | 1062 | G1543 | Const. 35S prom. | P1051 | 4038 | Darker green color |
| G1543 | HB (135-195) | 1062 | G1543 | Const. 35S prom. | P1051 | 4038 | Decreased seed oil content |
| G1543 | HB (135-195) | 1062 | G1543 | Const. 35S prom. | P1051 | 4038 | Altered leaf prenyl lipids; more chlorophyll a and b |
| G1543 | HB (135-195) | 1062 | G1543 | 2 comp. including P5287 (LTP1 prom.) | P3424 | 4512 | Significantly greater tomato plant volume |
| G1543 | HB (135-195) | 1062 | G1543 | 2 comp. including P5297 (PG prom.) | P3424 | 4512 | Significantly greater tomato plant volume |
| G3524 | HB (60-121) | 1988 | G1543 | — | — | | n/d |
| G3510 | HB (74-134) | 1974 | G1543 | — | — | | n/d |
| G3490 | HB (60-120) | 1958 | G1543 | — | — | | n/d |
| G4369 | HB (76-136) | 17833 | G1543 | — | — | | n/d |
| G4370 | HB (80-140) | 17837 | G1543 | — | — | | n/d |
| G4371 | HB (62-121) | 17829 | G1543 | — | — | | n/d |
| G1760 | MADS (2-57) | 22 | G1760 | 2 comp. including P6506 (35S prom.) | P3371 | 4505 | Greater tol. to cold (8 C.) |
| G1760 | MADS (2-57) | 22 | G1760 | Const. 35S prom. | P1461 | 4152 | Altered C/N sensing: greater tol. to low nitrogen conditions in C/N sensing assay |
| G1760 | MADS (2-57) | 22 | G1760 | 2 comp. including P6506 (35S prom.) | P3371 | 4505 | Altered C/N sensing: greater tol. to low nitrogen conditions in C/N sensing assay |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1760 | MADS (2-57) | 22 | G1760 | 2 comp. including P6506 (35S prom.) | P3371 | 4505 | Altered sugar sensing; greater tol. to sucrose (determined in 9.4% sucrose) |
| G1760 | MADS (2-57) | 22 | G1760 | Const. 35S prom | — | — | Early flowering, etiolated seedling |
| G1760 | MADS (2-57) | 22 | G1760 | STM | — | — | Increased fruit weight |
| G152 | MADS (2-57) | 110 | G1760 | Const. 35S prom. | P896 | 3996 | Only 3 lines produced, no positive physiological results at this time |
| G153 | MADS (2-57) | 112 | G1760 | Const. 35S prom. | P15260 | 4691 | Altered C/N sensing: greater tol. to low nitrogen conditions in C/N sensing assay |
| G153 | MADS (2-57) | 112 | G1760 | Const. 35S prom. | P15260 | 4691 | Greater tol. to low nitrogen conditions |
| G153 | MADS (2-57) | 112 | G1760 | Const. 35S prom. | P15260 | 4691 | Early flowering |
| G860 | MADS (2-57) | 640 | G1760 | Const. 35S prom. | P1269 | 4091 | Only 3 lines produced, no positive physiological results at this time |
| G860 | MADS (2-57) | 640 | G1760 | Const. 35S prom | — | — | Increased trichome density, Brighter leaf color |
| G3484 | MADS (2-57) | 1948 | G1760 | Const. 35S prom. | P26744 | 5049 | Reduced or delayed floral organ abscission |
| G3484 | MADS (2-57) | 1948 | G1760 | Const. 35S prom. | P26744 | 5049 | Early flowering |
| G3485 | MADS (2-57) | 1950 | G1760 | — | — | — | n/d |
| G3980 | MADS (2-57) | 2246 | G1760 | Const. 35S prom. | P26799 | 5052 | Early flowering |
| G3981 | MADS (2-57) | 2248 | G1760 | — | — | — | n/d |
| G3479 | MADS (2-57) | 1938 | G1760 | Const. 35S prom. | P26738 | 5048 | Early flowering |
| G3480 | MADS (2-57) | 1940 | G1760 | — | — | — | n/d |
| G3481 | MADS (2-57) | 1942 | G1760 | — | — | — | n/d |
| G3482 | MADS (2-57) | 1944 | G1760 | — | — | — | n/d |
| G3483 | MADS (2-57) | 1946 | G1760 | — | — | — | n/d |
| G3487 | MADS (2-57) | 1952 | G1760 | — | — | — | n/d |
| G3488 | MADS (2-57) | 1954 | G1760 | — | — | — | n/d |
| G3489 | MADS (2-57) | 1956 | G1760 | — | — | — | n/d |
| G1792 | AP2 (16-80) | 24 | G1792 | Const. 35S prom. | P6071 | 4598 | Greater tol. to cold (8 C.) |
| G1792 | AP2 (16-80) | 24 | G1792 | 2 comp. including P6506 (35S prom.) | P6071 | 4598 | Altered C/N sensing: greater tol. to low nitrogen conditions in C/N sensing assay |
| G1792 | AP2 (16-80) | 24 | G1792 | Const. 35S prom. | P1695 | 4227 | Altered C/N sensing: greater tol. to low nitrogen conditions in C/N sensing assay |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1792 | AP2 (16-80) | 24 | G1792 | Const. 35S prom. | P1695 | 4227 | More tol. to nitrogen-limited medium |
| G1792 | AP2 (16-80) | 24 | G1792 | 2 comp. including P6506 (35S prom.) | P6071 | 4598 | More root hair |
| G1792 | AP2 (16-80) | 24 | G1792 | Const. 35S prom. | P1695 | 4227 | More root hair |
| G1792 | AP2 (16-80) | 24 | G1792 | 2 comp. including P6506 (35S prom.) | P6071 | 4598 | More root mass |
| G1792 | AP2 (16-80) | 24 | G1792 | Const. 35S prom. | P1695 | 4227 | More root mass |
| G1792 | AP2 (16-80) | 24 | G1792 | Const. 35S prom. | P1695 | 4227 | Two lines of plants had higher chlorophyll content and higher total nitrogen concentration |
| G1792 | AP2 (16-80) | 24 | G1792 | 2 comp. including P6506 (35S prom.) | P6071 | 4598 | Altered leaf shape |
| G1792 | AP2 (16-80) | 24 | G1792 | Const. 35S prom. | P1695 | 4227 | Altered leaf shape |
| G1792 | AP2 (16-80) | 24 | G1792 | Const. 35S prom. | P26498 | 5016 | Altered leaf shape |
| G1792 | AP2 (16-80) | 24 | G1792 | 2 comp. including P6506 (35S prom.) | P6071 | 4598 | Darker green leaf color, shiny leaves |
| G1792 | AP2 (16-80) | 24 | G1792 | Const. 35S prom. | P1695 | 4227 | Darker green leaf color, shiny leaves |
| G1792 | AP2 (16-80) | 24 | G1792 | Const. 35S prom. | P26498 | 5016 | Darker green leaf color, shiny leaves |
| G1792 | AP2 (16-80) | 24 | G1792 | Const. 35S prom. | P1695 | 4227 | Greater resistance to *Erysiphe* |
| G1792 | AP2 (16-80) | 24 | G1792 | Const. 35S prom. | P1695 | 4227 | Greater resistance to *Botrytis* |
| G1792 | AP2 (16-80) | 24 | G1792 | Const. 35S prom. | P1695 | 4227 | Greater resistance to *Fusarium* |
| G1792 | AP2 (16-80) | 24 | G1792 | 2 comp. including P6506 (35S prom.) | P6071 | 4598 | More tol. to dehydration |
| G1792 | AP2 (16-80) | 24 | G1792 | Const. 35S prom. | P1695 | 4227 | More tol. to dehydration |
| G1792 | AP2 (16-80) | 24 | G1792 | Const. 35S prom. | P26498 | 5016 | More tol. to dehydration |
| G1792 | AP2 (16-80) | 24 | G1792 | Const. 35S prom. | P1695 | 4227 | Inc. seed oil content |
| G1792 | AP2 (16-80) | 24 | G1792 | 2 comp. including P6506 (35S prom.) | P6071 | 4598 | More tol. to drought* and better recovery from drought treatment* |
| G1792 | AP2 (16-80) | 24 | G1792 | Const. 35S prom. | P1695 | 4227 | More tol. to drought* and better recovery from drought treatment* |
| G1792 | AP2 (16-80) | 24 | G1792 | Const. 35S prom. | P26498 | 5016 | More tol. to drought* and better recovery from drought treatment* |
| G1792 | AP2 (16-80) | 24 | G1792 | 2 comp. including P5326 (AP1 prom.) | P6071 | 4598 | Altered sugar sensing; greater tol. to sucrose (determined in 9.4% sucrose) |
| G1792 | AP2 (16-80) | 24 | G1792 | 2 comp. including P5326 (AP1 prom.) | P6071 | 4598 | Greater tol. to dehydration |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1792 | AP2 (16-80) | 24 | G1792 | 2 comp. including P5319 (AS1 prom.) | P6071 | 4598 | Altered C/N sensing: greater tol. to low nitrogen conditions in C/N sensing assay |
| G1792 | AP2 (16-80) | 24 | G1792 | 2 comp. including P5288 (CUT1 prom.) | P6071 | 4598 | Altered C/N sensing: greater tol. to low nitrogen conditions in C/N sensing assay |
| G1792 | AP2 (16-80) | 24 | G1792 | 2 comp. including P5288 (CUT1 prom.) | P6071 | 4598 | Greater tol. to cold (8 C.) |
| G1792 | AP2 (16-80) | 24 | G1792 | 2 comp. including P5288 (CUT1 prom.) | P6071 | 4598 | Better recovery from drought treatment* |
| G1792 | AP2 (16-80) | 24 | G1792 | 2 comp. including P5288 (CUT1 prom.) | P6071 | 4598 | Late flowering |
| G1792 | AP2 (16-80) | 24 | G1792 | 2 comp. including P5287 (LTP1 prom.) | P6071 | 4598 | Greater tol. to low nitrogen conditions |
| G1792 | AP2 (16-80) | 24 | G1792 | 2 comp. including P5284 (RBCS3 prom.) | P6071 | 4598 | More res. to *Botrytis* |
| G1792 | AP2 (16-80) | 24 | G1792 | 2 comp. including P5284 (RBCS3 prom.) | P6071 | 4598 | Darker green leaf color |
| G1792 | AP2 (16-80) | 24 | G1792 | 2 comp. including P5284 (RBCS3 prom.) | P6071 | 4598 | Greater tol. to NaCl (determined with 150 mM NaCl) |
| G1792 | AP2 (16-80) | 24 | G1792 | 2 comp. including P9002 (RD29A prom.) | P6071 | 4598 | More tol. to drought* and better recovery from drought treatment* |
| G1792 | AP2 (16-80) | 24 | G1792 | 2 comp. including P9002 (RD29A prom.) | P6071 | 4598 | Less sens. to ABA |
| G1792 | AP2 (16-80) | 24 | G1792 | 2 comp. including P9002 (RD29A prom.) | P6071 | 4598 | Greater tol. to low nitrogen conditions |
| G1792 | AP2 (16-80) | 24 | G1792 | 2 comp. including P9002 (RD29A prom.) | P6071 | 4598 | Greater tol. to NaCl (determined with 150 mM NaCl) |
| G1792 | AP2 (16-80) | 24 | G1792 | 2 comp. including P5310 (RS1 prom.) | P6071 | 4598 | Altered C/N sensing: greater tol. to low nitrogen conditions in C/N sensing assay |
| G1792 | AP2 (16-80) | 24 | G1792 | 2 comp. including P5318 (STM prom.) | P6071 | 4598 | Greater tol. to cold (8 C.) |
| G1792 | AP2 (16-80) | 24 | G1792 | 2 comp. including P5318 (STM prom.) | P6071 | 4598 | Greater tol. to 300 mM mannitol |
| G1792 | AP2 (16-80) | 24 | G1792 | 2 comp. including P5290 (SUC2 prom.) | P6071 | 4598 | Greater tol. to dehydration |
| G1792 | AP2 (16-80) | 24 | G1792 | 2 comp. including P5290 (SUC2 prom.) | P6071 | 4598 | Altered C/N sensing: greater tol. to low nitrogen conditions in C/N sensing assay |
| G1792 | AP2 (16-80) | 24 | G1792 | 2 comp. including P5290 (SUC2 prom.) | P6071 | 4598 | Greater tol. to cold (8 C.) |
| G1792 | AP2 (16-80) | 24 | G1792 | Deletion variant, 35S | P25437 | 4902 | Gray leaf color |
| G1792 | AP2 (16-80) | 24 | G1792 | Domain swap/chimeric variant, 35S | P25448 | 4909 | More tol. to drought* and better recovery from drought treatment* |
| G1792 | AP2 (16-80) | 24 | G1792 | Domain swap/chimeric variant, 35S | P25446 | 4907 | Greater res. to *Erysiphe* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1792 | AP2 (16-80) | 24 | G1792 | Domain swap/chimeric variant, 35S | P25447 | 4908 | Greater res. to *Erysiphe* |
| G1792 | AP2 (16-80) | 24 | G1792 | Domain swap/chimeric variant, 35S | P25448 | 4909 | Greater res. to *Erysiphe* |
| G1792 | AP2 (16-80) | 24 | G1792 | Domain swap/chimeric variant, 35S | P25445 | 4906 | Greater res. to *Erysiphe* |
| G1792 | AP2 (16-80) | 24 | G1792 | Domain swap/chimeric variant, 35S | P25448 | 4909 | Altered C/N sensing: greater tol. to low nitrogen conditions in C/N sensing assay |
| G1792 | AP2 (16-80) | 24 | G1792 | Domain swap/chimeric variant, 35S | P25446 | 4907 | Greater res. to *Sclerotinia* |
| G1792 | AP2 (16-80) | 24 | G1792 | Domain swap/chimeric variant, 35S | P25448 | 4909 | Greater res. to *Sclerotinia* |
| G1792 | AP2 (16-80) | 24 | G1792 | Domain swap/chimeric variant, 35S | P25445 | 4906 | Greater res. to *Sclerotinia* |
| G1792 | AP2 (16-80) | 24 | G1792 | Domain swap/chimeric variant, 35S | P25438 | 4903 | Late flowering |
| G1792 | AP2 (16-80) | 24 | G1792 | Domain swap/chimeric variant, 35S | P25446 | 4907 | Late flowering |
| G1792 | AP2 (16-80) | 24 | G1792 | Domain swap/chimeric variant, 35S | P25447 | 4908 | Late flowering |
| G1792 | AP2 (16-80) | 24 | G1792 | Domain swap/chimeric variant, 35S | P25448 | 4909 | Late flowering |
| G1792 | AP2 (16-80) | 24 | G1792 | Domain swap/chimeric variant, 35S | P25445 | 4906 | Late flowering |
| G1792 | AP2 (16-80) | 24 | G1792 | Domain swap/chimeric variant, 35S | P25438 | 4903 | Altered leaf shape |
| G1792 | AP2 (16-80) | 24 | G1792 | Domain swap/chimeric variant, 35S | P25446 | 4907 | Altered leaf shape |
| G1792 | AP2 (16-80) | 24 | G1792 | Domain swap/chimeric variant, 35S | P25447 | 4908 | Altered leaf shape |
| G1792 | AP2 (16-80) | 24 | G1792 | Domain swap/chimeric variant, 35S | P25448 | 4909 | Altered leaf shape |
| G1792 | AP2 (16-80) | 24 | G1792 | Domain swap/chimeric variant, 35S | P25445 | 4906 | Altered leaf shape |
| G1792 | AP2 (16-80) | 24 | G1792 | Domain swap/chimeric variant, 35S | P25438 | 4903 | Glossy leaves |
| G1792 | AP2 (16-80) | 24 | G1792 | Domain swap/chimeric variant, 35S | P25446 | 4907 | Glossy leaves |
| G1792 | AP2 (16-80) | 24 | G1792 | Domain swap/chimeric variant, 35S | P25447 | 4908 | Glossy leaves |
| G1792 | AP2 (16-80) | 24 | G1792 | Domain swap/chimeric variant, 35S | P25448 | 4909 | Glossy leaves |
| G1792 | AP2 (16-80) | 24 | G1792 | Domain swap/chimeric variant, 35S | P25445 | 4906 | Glossy leaves |
| G1792 | AP2 (16-80) | 24 | G1792 | Domain swap/chimeric variant, 35S | P25438 | 4903 | Darker green leaf color |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1792 | AP2 (16-80) | 24 | G1792 | Domain swap/chimeric variant, 35S | P25446 | 4907 | Darker green leaf color |
| G1792 | AP2 (16-80) | 24 | G1792 | Domain swap/chimeric variant, 35S | P25447 | 4908 | Darker green leaf color |
| G1792 | AP2 (16-80) | 24 | G1792 | Domain swap/chimeric variant, 35S | P25448 | 4909 | Darker green leaf color |
| G1792 | AP2 (16-80) | 24 | G1792 | Domain swap/chimeric variant, 35S | P25445 | 4906 | Darker green leaf color |
| G1792 | AP2 (16-80) | 24 | G1792 | Glucocorticoid receptor (GR) fusion (dexamethasone-inducible), 35S prom. (w/P5486) | P6071 | 4598 | More res. to *Botrytis* |
| G1792 | AP2 (16-80) | 24 | G1792 | Glucocorticoid receptor (GR) fusion (dexamethasone-inducible), 35S prom. (w/P5486) | P6071 | 4598 | More res. to *Fusarium* |
| G1792 | AP2 (16-80) | 24 | G1792 | 2 comp. hemagglutinin (HA) epitope C-terminal tag, 35S (w/P5486) | P25118 | 4853 | More res. to *Botrytis* |
| G1792 | AP2 (16-80) | 24 | G1792 | 2 comp. hemagglutinin (HA) epitope C-terminal tag, 35S (w/P5486) | P25118 | 4853 | More tol. to drought* and better recovery from drought treatment* |
| G1792 | AP2 (16-80) | 24 | G1792 | 2 comp. hemagglutinin (HA) epitope C-terminal tag, 35S (w/P5486) | P25118 | 4853 | Greater res. to *Erysiphe* |
| G1792 | AP2 (16-80) | 24 | G1792 | 2 comp. hemagglutinin (HA) epitope C-terminal tag, 35S (w/P5486) | P25118 | 4853 | Altered C/N sensing: greater tol. to low nitrogen conditions in C/N sensing assay |
| G1792 | AP2 (16-80) | 24 | G1792 | 2 comp. hemagglutinin (HA) epitope C-terminal tag, 35S (w/P5486) | P25118 | 4853 | Greater tol. to cold (8 C.) |
| G1792 | AP2 (16-80) | 24 | G1792 | 2 comp. hemagglutinin (HA) epitope C-terminal tag, 35S (w/P5486) | P25118 | 4853 | Late flowering |
| G1792 | AP2 (16-80) | 24 | G1792 | 2 comp. hemagglutinin (HA) epitope C-terminal tag, 35S (w/P5486) | P25118 | 4853 | Glossy leaves |
| G1792 | AP2 (16-80) | 24 | G1792 | 2 comp. hemagglutinin (HA) epitope C-terminal tag, 35S (w/P5486) | P25118 | 4853 | Darker green leaf color |
| G1792 | AP2 (16-80) | 24 | G1792 | 2 comp. hemagglutinin (HA) epitope C-terminal tag, 35S (w/P5486) | P25118 | 4853 | Greater res. to *Sclerotinia* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1792 | AP2 (16-80) | 24 | G1792 | 2 comp. hemagglutinin (HA) epitope C-terminal tag, 35S (w/P5486) | P25118 | 4853 | Altered sugar sensing; greater tol. to sucrose (determined in 9.4% sucrose) |
| G1792 | AP2 (16-80) | 24 | G1792 | 2 comp. hemagglutinin (HA) epitope C-terminal tag, 35S (w/P5486) | P26259 | 4963 | Altered sugar sensing; greater tol. to sucrose (determined in 9.4% sucrose) |
| G1792 | AP2 (16-80) | 24 | G1792 | 2 comp. hemagglutinin (HA) epitope C-terminal tag, 35S (w/P5486) | P26259 | 4963 | More tol. to drought* and better recovery from drought treatment* |
| G1792 | AP2 (16-80) | 24 | G1792 | 2-components-supertransformation-TAP-C-terminus (w/P5486) | P25119 | 4854 | More tol. to drought* and better recovery from drought treatment* |
| G1792 | AP2 (16-80) | 24 | G1792 | Protein-GFP C terminal fusion, 35S | P25271 | 4885 | More tol. to drought* and better recovery from drought treatment* |
| G1792 | AP2 (16-80) | 24 | G1792 | Protein-GFP C terminal fusion, 35S | P25271 | 4885 | Greater res. to *Erysiphe* |
| G1792 | AP2 (16-80) | 24 | G1792 | Protein-GFP C terminal fusion, 35S | P25271 | 4885 | Altered C/N sensing: greater tol. to low nitrogen conditions in C/N sensing assay |
| G1792 | AP2 (16-80) | 24 | G1792 | Protein-GFP C terminal fusion, 35S | P25271 | 4885 | Greater tol. to dehydration |
| G1792 | AP2 (16-80) | 24 | G1792 | Protein-GFP C terminal fusion, 35S | P25271 | 4885 | Greater res. to *Sclerotinia* |
| G1792 | AP2 (16-80) | 24 | G1792 | Protein-GFP C terminal fusion, 35S | P25271 | 4885 | Greater tol. to cold (8 C.) |
| G1792 | AP2 (16-80) | 24 | G1792 | Protein-GFP C terminal fusion, 35S | P25271 | 4885 | Late flowering |
| G1792 | AP2 (16-80) | 24 | G1792 | Protein-GFP C terminal fusion, 35S | P25271 | 4885 | Altered leaf shape |
| G1792 | AP2 (16-80) | 24 | G1792 | Protein-GFP C terminal fusion, 35S | P25271 | 4885 | Glossy leaves |
| G1792 | AP2 (16-80) | 24 | G1792 | Protein-GFP C terminal fusion, 35S | P25271 | 4885 | Darker green leaf color |
| G1792 | AP2 (16-80) | 24 | G1792 | Protein-GFP C terminal fusion, 35S | P25271 | 4885 | Greater tol. to low nitrogen conditions |
| G1792 | AP2 (16-80) | 24 | G1792 | Point mutation, 35S | P25738 | 4923 | Greater res. to *Erysiphe* |
| G1792 | AP2 (16-80) | 24 | G1792 | Point mutation, 35S | P25739 | 4924 | Greater res. to *Erysiphe* |
| G1792 | AP2 (16-80) | 24 | G1792 | Point mutation, 35S | P25739 | 4924 | Gray leaf color |
| G1792 | AP2 (16-80) | 24 | G1792 | Point mutation, 35S | P25740 | 4925 | Gray leaf color |
| G1792 | AP2 (16-80) | 24 | G1792 | Point mutation, 35S | P25741 | 4926 | Gray leaf color |
| G1792 | AP2 (16-80) | 24 | G1792 | Point mutation, 35S | P25739 | 4924 | Altered C/N sensing: greater tol. to low nitrogen conditions in C/N sensing assay |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1792 | AP2 (16-80) | 24 | G1792 | Point mutation, 35S | P25740 | 4925 | Altered C/N sensing: greater tol. to low nitrogen conditions in C/N sensing assay |
| G1792 | AP2 (16-80) | 24 | G1792 | Point mutation, 35S | P25739 | 4924 | Greater tol. to low nitrogen conditions |
| G1792 | AP2 (16-80) | 24 | G1792 | Point mutation, 35S | P25740 | 4925 | Altered sugar sensing; greater tol. to sucrose (determined in 9.4% sucrose) |
| G1792 | AP2 (16-80) | 24 | G1792 | Point mutation, 35S | P25739 | 4924 | Greater res. to *Botrytis* and *Erysiphe* |
| G1792 | AP2 (16-80) | 24 | G1792 | Point mutation, 35S | P25739 | 4924 | More tol. to drought* and better recovery from drought treatment* |
| G1792 | AP2 (16-80) | 24 | G1792 | Point mutation, 35S | P25741 | 4926 | More tol. to drought* and better recovery from drought treatment* |
| G1792 | AP2 (16-80) | 24 | G1792 | Direct disease-inducible prom. fusion | P27085 | 5076 | Greater res. to *Erysiphe* |
| G1792 | AP2 (16-80) | 24 | G1792 | Direct disease-inducible prom. fusion | P27086 | 5077 | Greater res. to *Erysiphe* |
| G1792 | AP2 (16-80) | 24 | G1792 | Direct disease-inducible prom. fusion | P27087 | 5078 | Greater res. to *Erysiphe* |
| G1792 | AP2 (16-80) | 24 | G1792 | Direct disease-inducible prom. fusion | P27035 | 5067 | Greater res. to *Erysiphe* |
| G1792 | AP2 (16-80) | 24 | G1792 | Direct disease-inducible prom. fusion | P27201 | 5080 | Greater res. to *Erysiphe* |
| G1792 | AP2 (16-80) | 24 | G1792 | Direct disease-inducible prom. fusion | P27036 | 5068 | Greater res. to *Botrytis* and *Erysiphe* |
| G1792 | AP2 (16-80) | 24 | G1792 | Direct disease-inducible prom. fusion | P27030 | 5066 | Greater res. to *Botrytis* and *Erysiphe* |
| G1792 | AP2 (16-80) | 24 | G1792 | Direct disease-inducible prom. fusion | P27199 | 5079 | Greater res. to *Botrytis* and *Erysiphe* |
| G1791 | AP2 (10-74) | 1172 | G1792 | 2 comp. including P5319 (AS1 prom.) | P4406 | 4562 | More res. to *Botrytis* |
| G1791 | AP2 (10-74) | 1172 | G1792 | 2 comp. including P5319 (AS1 prom.) | P4406 | 4562 | Altered C/N sensing: greater tol. to low nitrogen conditions in C/N sensing assay |
| G1791 | AP2 (10-74) | 1172 | G1792 | 2 comp. including P5319 (AS1 prom.) | P4406 | 4562 | Greater tol. to cold (8 C.) |
| G1791 | AP2 (10-74) | 1172 | G1792 | 2 comp. including P5319 (AS1 prom.) | P4406 | 4562 | Late flowering |
| G1791 | AP2 (10-74) | 1172 | G1792 | 2 comp. including P5288 (CUT1 prom.) | P4406 | 4562 | Greater tol. to dehydration |
| G1791 | AP2 (10-74) | 1172 | G1792 | 2 comp. including P5288 (CUT1 prom.) | P4406 | 4562 | Greater res. to *Sclerotinia* |
| G1791 | AP2 (10-74) | 1172 | G1792 | 2 comp. including P5287 (LTP1 prom.) | P4406 | 4562 | More res. to *Botrytis* |
| G1791 | AP2 (10-74) | 1172 | G1792 | 2 comp. including P5284 (RBCS3 prom.) | P4406 | 4562 | Less sens. to ABA |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1791 | AP2 (10-74) | 1172 | G1792 | 2 comp. including P5284 (RBCS3 prom.) | P4406 | 4562 | Greater tol. to cold (8 C.) |
| G1791 | AP2 (10-74) | 1172 | G1792 | 2 comp. including P5284 (RBCS3 prom.) | P4406 | 4562 | More tol. to drought* and better recovery from drought treatment* |
| G1791 | AP2 (10-74) | 1172 | G1792 | 2 comp. including P5284 (RBCS3 prom.) | P4406 | 4562 | Late flowering |
| G1791 | AP2 (10-74) | 1172 | G1792 | 2 comp. including P9002 (RD29A prom.) | P4406 | 4562 | Late flowering |
| G1791 | AP2 (10-74) | 1172 | G1792 | 2 comp. including P9002 (RD29A prom.) | P4406 | 4562 | Greater tol. to low nitrogen conditions |
| G1791 | AP2 (10-74) | 1172 | G1792 | 2 comp. including P5290 (SUC2 prom.) | P4406 | 4562 | Late flowering |
| G1791 | AP2 (10-74) | 1172 | G1792 | 2 comp. including P5290 (SUC2 prom.) | P4406 | 4562 | Glossy leaves |
| G1791 | AP2 (10-74) | 1172 | G1792 | 2 comp. including P5290 (SUC2 prom.) | P4406 | 4562 | Altered C/N sensing: greater tol. to low nitrogen conditions in C/N sensing assay |
| G1791 | AP2 (10-74) | 1172 | G1792 | 2 comp. including P5297 (PG prom.) | P4406 | 4562 | Significantly greater soluble solids (Brix) in tomato plants |
| G1791 | AP2 (10-74) | 1172 | G1792 | Glucocorticoid receptor (GR) fusion (dexamethasone-inducible), 35S prom. (w/P5486) | P4406 | 4562 | More res. to *Botrytis* |
| G1791 | AP2 (10-74) | 1172 | G1792 | Glucocorticoid receptor (GR) fusion (dexamethasone-inducible), 35S prom. (w/P5486) | P4406 | 4562 | Greater res. to *Sclerotinia* |
| G1791 | AP2 (10-74) | 1172 | G1792 | Knockout | not applicable | | Altered C/N sensing: greater tol. to low nitrogen conditions in C/N sensing assay |
| G1791 | AP2 (10-74) | 1172 | G1792 | Knockout | not applicable | | Altered sugar sensing; greater tol. to sucrose (determined in 9.4% sucrose) |
| G1795 | AP2 (11-75) | 26 | G1792 | 2 comp. including P5288 (CUT1 prom.) | P6424 | 4600 | Greater res. to *Erysiphe* |
| G1795 | AP2 (11-75) | 26 | G1792 | 2 comp. including P5288 (CUT1 prom.) | P6424 | 4600 | Late flowering |
| G1795 | AP2 (11-75) | 26 | G1792 | 2 comp. including P5288 (CUT1 prom.) | P6424 | 4600 | Glossy leaves |
| G1795 | AP2 (11-75) | 26 | G1792 | 2 comp. including P5288 (CUT1 prom.) | P6424 | 4600 | Darker green leaf color |
| G1795 | AP2 (11-75) | 26 | G1792 | 2 comp. including P5288 (CUT1 prom.) | P6424 | 4600 | Greater res. to *Sclerotinia* |
| G1795 | AP2 (11-75) | 26 | G1792 | 2 comp. including P5288 (CUT1 prom.) | P6424 | 4600 | Greater tol. to dehydration |
| G1795 | AP2 (11-75) | 26 | G1792 | 2 comp. including P5287 (LTP1 prom.) | P6424 | 4600 | More res. to *Botrytis* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1795 | AP2 (11-75) | 26 | G1792 | 2 comp. including P5287 (LTP1 prom.) | P6424 | 4600 | Greater res. to *Erysiphe* |
| G1795 | AP2 (11-75) | 26 | G1792 | 2 comp. including P5287 (LTP1 prom.) | P6424 | 4600 | Greater res. to *Sclerotinia* |
| G1795 | AP2 (11-75) | 26 | G1792 | 2 comp. including P5287 (LTP1 prom.) | P6424 | 4600 | Late flowering |
| G1795 | AP2 (11-75) | 26 | G1792 | 2 comp. including P5287 (LTP1 prom.) | P6424 | 4600 | Glossy leaves |
| G1795 | AP2 (11-75) | 26 | G1792 | 2 comp. including P5287 (LTP1 prom.) | P6424 | 4600 | Darker green leaf color |
| G1795 | AP2 (11-75) | 26 | G1792 | 2 comp. including P5287 (LTP1 prom.) | P6424 | 4600 | Early flowering |
| G1795 | AP2 (11-75) | 26 | G1792 | 2 comp. including P5284 (RBCS3 prom.) | P6424 | 4600 | More res. to *Botrytis* |
| G1795 | AP2 (11-75) | 26 | G1792 | 2 comp. including P5284 (RBCS3 prom.) | P6424 | 4600 | Greater res. to *Erysiphe* |
| G1795 | AP2 (11-75) | 26 | G1792 | 2 comp. including P5284 (RBCS3 prom.) | P6424 | 4600 | Greater res. to *Sclerotinia* |
| G1795 | AP2 (11-75) | 26 | G1792 | 2 comp. including P5284 (RBCS3 prom.) | P6424 | 4600 | Late flowering |
| G1795 | AP2 (11-75) | 26 | G1792 | 2 comp. including P5284 (RBCS3 prom.) | P6424 | 4600 | Glossy leaves |
| G1795 | AP2 (11-75) | 26 | G1792 | 2 comp. including P5284 (RBCS3 prom.) | P6424 | 4600 | Darker green leaf color |
| G1795 | AP2 (11-75) | 26 | G1792 | 2 comp. including P5290 (SUC2 prom.) | P6424 | 4600 | Greater res. to *Sclerotinia* |
| G1795 | AP2 (11-75) | 26 | G1792 | 2 comp. including P5290 (SUC2 prom.) | P6424 | 4600 | Less sens. to ABA |
| G1795 | AP2 (11-75) | 26 | G1792 | 2 comp. including P5290 (SUC2 prom.) | P6424 | 4600 | Greater tol. to 300 mM mannitol |
| G1795 | AP2 (11-75) | 26 | G1792 | 2 comp. including P5290 (SUC2 prom.) | P6424 | 4600 | Greater tol. to dehydration |
| G1795 | AP2 (11-75) | 26 | G1792 | 2 comp. including P5290 (SUC2 prom.) | P6424 | 4600 | Better recovery from drought treatment* |
| G1795 | AP2 (11-75) | 26 | G1792 | 2 comp. including P5290 (SUC2 prom.) | P6424 | 4600 | Late flowering |
| G1795 | AP2 (11-75) | 26 | G1792 | 2 comp. including P5290 (SUC2 prom.) | P6424 | 4600 | Altered leaf shape |
| G1795 | AP2 (11-75) | 26 | G1792 | 2 comp. including P5290 (SUC2 prom.) | P6424 | 4600 | Glossy leaves |
| G1795 | AP2 (11-75) | 26 | G1792 | 2 comp. including P5290 (SUC2 prom.) | P6424 | 4600 | Darker green leaf color |
| G1795 | AP2 (11-75) | 26 | G1792 | 2 comp. including P5290 (SUC2 prom.) | P6424 | 4600 | Greater tol. to low nitrogen conditions |
| G1795 | AP2 (11-75) | 26 | G1792 | Direct disease-inducible prom. fusion | P26467 | 5003 | Altered C/N sensing: inc. tol. to low nitrogen conditions in C/N sensing assay |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1795 | AP2 (11-75) | 26 | G1792 | Direct disease-inducible prom. fusion | P26402 | 4973 | Greater res. to *Sclerotinia* and *Erysiphe* |
| G1795 | AP2 (11-75) | 26 | G1792 | Direct disease-inducible prom. fusion | P26396 | 4971 | Greater res. to *Erysiphe* |
| G1795 | AP2 (11-75) | 26 | G1792 | Direct disease-inducible prom. fusion | P26398 | 4972 | Greater res. to *Sclerotinia* and *Erysiphe* |
| G1795 | AP2 (11-75) | 26 | G1792 | Direct disease-inducible prom. fusion | P26404 | 4974 | Greater res. to *Sclerotinia* and *Erysiphe* |
| G1795 | AP2 (11-75) | 26 | G1792 | Direct disease-inducible prom. fusion | P26409 | 4978 | Greater res. to *Sclerotinia* |
| G1795 | AP2 (11-75) | 26 | G1792 | Direct disease-inducible prom. fusion | P26411 | 4980 | Greater res. to *Sclerotinia* and *Erysiphe* |
| G1795 | AP2 (11-75) | 26 | G1792 | Direct disease-inducible prom. fusion | P26407 | 4976 | Greater res. to *Sclerotinia* and *Erysiphe* |
| G1795 | AP2 (11-75) | 26 | G1792 | Direct disease-inducible prom. fusion | P26412 | 4981 | Greater res. to *Sclerotinia* and *Erysiphe* |
| G1795 | AP2 (11-75) | 26 | G1792 | Direct disease-inducible prom. fusion | P26410 | 4979 | Greater res. to *Sclerotinia* and *Erysiphe* |
| G1795 | AP2 (11-75) | 26 | G1792 | Direct disease-inducible prom. fusion | P26406 | 4975 | Greater res. to *Sclerotinia* and *Erysiphe* |
| G1795 | AP2 (11-75) | 26 | G1792 | Direct disease-inducible prom. fusion | P26408 | 4977 | Greater res. to *Sclerotinia* and *Erysiphe* |
| G1795 | AP2 (11-75) | 26 | G1792 | Direct disease-inducible prom. fusion | P26447 | 4986 | Greater res. to *Sclerotinia* and *Erysiphe* |
| G1795 | AP2 (11-75) | 26 | G1792 | Direct disease-inducible prom. fusion | P26448 | 4987 | Greater res. to *Sclerotinia* and *Erysiphe* |
| G1795 | AP2 (11-75) | 26 | G1792 | Direct disease-inducible prom. fusion | P26460 | 4997 | Greater res. to *Sclerotinia* and *Erysiphe* |
| G1795 | AP2 (11-75) | 26 | G1792 | Direct disease-inducible prom. fusion | P26472 | 5008 | Greater res. to *Sclerotinia* and *Erysiphe* |
| G1795 | AP2 (11-75) | 26 | G1792 | Direct disease-inducible prom. fusion | P26462 | 4999 | Greater res. to *Erysiphe* |
| G1795 | AP2 (11-75) | 26 | G1792 | Direct disease-inducible prom. fusion | P26463 | 5000 | Greater res. to *Sclerotinia* and *Erysiphe* |
| G1795 | AP2 (11-75) | 26 | G1792 | Direct disease-inducible prom. fusion | P26465 | 5001 | Greater res. to *Sclerotinia* and *Erysiphe* |
| G1795 | AP2 (11-75) | 26 | G1792 | Direct disease-inducible prom. fusion | P26466 | 5002 | Greater res. to *Sclerotinia* and *Erysiphe* |
| G1795 | AP2 (11-75) | 26 | G1792 | Direct disease-inducible prom. fusion | P26467 | 5003 | Greater res. to *Sclerotinia* and *Erysiphe* |
| G1795 | AP2 (11-75) | 26 | G1792 | Direct disease-inducible prom. fusion | P26468 | 5004 | Greater res. to *Sclerotinia* and *Erysiphe* |
| G1795 | AP2 (11-75) | 26 | G1792 | Direct disease-inducible prom. fusion | P26469 | 5005 | Greater res. to *Sclerotinia* and *Erysiphe* |
| G1795 | AP2 (11-75) | 26 | G1792 | Direct disease-inducible prom. fusion | P26470 | 5006 | Greater res. to *Sclerotinia* and *Erysiphe* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1795 | AP2 (11-75) | 26 | G1792 | Direct disease-inducible prom. fusion | P26471 | 5007 | Greater res. to *Sclerotinia* and *Erysiphe* |
| G1795 | AP2 (11-75) | 26 | G1792 | Direct disease-inducible prom. fusion | P26582 | 5024 | Greater res. to *Sclerotinia* and *Erysiphe* |
| G1795 | AP2 (11-75) | 26 | G1792 | Direct disease-inducible prom. fusion | P26579 | 5022 | Greater res. to *Sclerotinia* and *Erysiphe* |
| G1795 | AP2 (11-75) | 26 | G1792 | Direct disease-inducible prom. fusion | P26477 | 5011 | Greater res. to *Sclerotinia* and *Erysiphe* |
| G1795 | AP2 (11-75) | 26 | G1792 | Direct disease-inducible prom. fusion | P26479 | 5012 | Greater res. to *Sclerotinia* and *Erysiphe* |
| G1795 | AP2 (11-75) | 26 | G1792 | Direct disease-inducible prom. fusion | P26481 | 5013 | Greater res. to *Sclerotinia* and *Erysiphe* |
| G1795 | AP2 (11-75) | 26 | G1792 | Direct disease-inducible prom. fusion | P26442 | 4982 | Greater res. to *Sclerotinia* and *Erysiphe* |
| G1795 | AP2 (11-75) | 26 | G1792 | Direct disease-inducible prom. fusion | P26443 | 4983 | Greater res. to *Sclerotinia* and *Erysiphe* |
| G1795 | AP2 (11-75) | 26 | G1792 | Direct disease-inducible prom. fusion | P26445 | 4984 | Greater res. to *Sclerotinia* and *Erysiphe* |
| G1795 | AP2 (11-75) | 26 | G1792 | Direct disease-inducible prom. fusion | P26580 | 5023 | Greater res. to *Sclerotinia* and *Erysiphe* |
| G1795 | AP2 (11-75) | 26 | G1792 | Direct disease-inducible prom. fusion | P26446 | 4985 | Greater res. to *Sclerotinia* and *Erysiphe* |
| G1795 | AP2 (11-75) | 26 | G1792 | Direct disease-inducible prom. fusion | P26449 | 4988 | Greater res. to *Sclerotinia* and *Erysiphe* |
| G1795 | AP2 (11-75) | 26 | G1792 | Direct disease-inducible prom. fusion | P26450 | 4989 | Greater res. to *Sclerotinia* and *Erysiphe* |
| G1795 | AP2 (11-75) | 26 | G1792 | Direct disease-inducible prom. fusion | P26452 | 4990 | Greater res. to *Sclerotinia* and *Erysiphe* |
| G1795 | AP2 (11-75) | 26 | G1792 | Direct disease-inducible prom. fusion | P26453 | 4991 | Greater res. to *Sclerotinia* and *Erysiphe* |
| G1795 | AP2 (11-75) | 26 | G1792 | Direct disease-inducible prom. fusion | P26454 | 4992 | Greater res. to *Sclerotinia* and *Erysiphe* |
| G1795 | AP2 (11-75) | 26 | G1792 | Direct disease-inducible prom. fusion | P26474 | 5009 | Greater res. to *Sclerotinia* |
| G1795 | AP2 (11-75) | 26 | G1792 | Direct disease-inducible prom. fusion | P26456 | 4993 | Greater res. to *Sclerotinia* and *Erysiphe* |
| G1795 | AP2 (11-75) | 26 | G1792 | Direct disease-inducible prom. fusion | P26457 | 4994 | Greater res. to *Sclerotinia* and *Erysiphe* |
| G1795 | AP2 (11-75) | 26 | G1792 | Direct disease-inducible prom. fusion | P26458 | 4995 | Greater res. to *Sclerotinia* and *Erysiphe* |
| G1795 | AP2 (11-75) | 26 | G1792 | Direct disease-inducible prom. fusion | P26708 | 5047 | Greater res. to *Sclerotinia* and *Erysiphe* |
| G1795 | AP2 (11-75) | 26 | G1792 | Direct disease-inducible prom. fusion | P26459 | 4996 | Greater res. to *Sclerotinia* and *Erysiphe* |
| G1795 | AP2 (11-75) | 26 | G1792 | Direct disease-inducible prom. fusion | P26461 | 4998 | Greater res. to *Sclerotinia* and *Erysiphe* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1795 | AP2 (11-75) | 26 | G1792 | Direct disease-inducible prom. fusion | P26707 | 5046 | Greater res. to *Sclerotinia* and *Erysiphe* |
| G1795 | AP2 (11-75) | 26 | G1792 | Direct disease-inducible prom. fusion | P26476 | 5010 | Greater res. to *Sclerotinia* and *Erysiphe* |
| G1795 | AP2 (11-75) | 26 | G1792 | Glucocorticoid receptor (GR) fusion (dexamethasone-inducible), 35S prom. (w/P5486) | P6424 | 4600 | More res. to *Botrytis* |
| G1795 | AP2 (11-75) | 26 | G1792 | Glucocorticoid receptor (GR) fusion (dexamethasone-inducible), 35S prom. (w/P5486) | P6424 | 4600 | Greater res. to *Sclerotinia* |
| G30 | AP2 (16-80) | 66 | G1792 | Const. 35S prom. | P893 | 3993 | Glossy darker green leaves |
| G30 | AP2 (16-80) | 66 | G1792 | Const. 35S prom. | P893 | 3993 | Altered light response; greater shade tol.; lack of shade avoidance phenotype; long cotyledon petioles and hypocotyls |
| G30 | AP2 (16-80) | 66 | G1792 | 2 comp. including P5318 (STM prom.) | P3852 | 4531 | Late flowering |
| G30 | AP2 (16-80) | 66 | G1792 | 2 comp. including P5318 (STM prom.) | P3852 | 4531 | Glossy leaves |
| G30 | AP2 (16-80) | 66 | G1792 | 2 comp. including P5318 (STM prom.) | P3852 | 4531 | Darker green leaf color |
| G30 | AP2 (16-80) | 66 | G1792 | 2 comp. including P5319 (AS1 prom.) | P3852 | 4531 | Greater res. to *Erysiphe* |
| G30 | AP2 (16-80) | 66 | G1792 | 2 comp. including P5319 (AS1 prom.) | P3852 | 4531 | Leaf orientation |
| G30 | AP2 (16-80) | 66 | G1792 | 2 comp. including P5319 (AS1 prom.) | P3852 | 4531 | Greater res. to *Sclerotinia* |
| G30 | AP2 (16-80) | 66 | G1792 | 2 comp. including P5319 (AS1 prom.) | P3852 | 4531 | Late flowering |
| G30 | AP2 (16-80) | 66 | G1792 | 2 comp. including P5319 (AS1 prom.) | P3852 | 4531 | Darker green leaf color |
| G30 | AP2 (16-80) | 66 | G1792 | 2 comp. including P5288 (CUT1 prom.) | P3852 | 4531 | Greater tol. to cold (8 C.) |
| G30 | AP2 (16-80) | 66 | G1792 | 2 comp. including P5288 (CUT1 prom.) | P3852 | 4531 | Late flowering |
| G30 | AP2 (16-80) | 66 | G1792 | 2 comp. including P5288 (CUT1 prom.) | P3852 | 4531 | Darker green leaf color |
| G30 | AP2 (16-80) | 66 | G1792 | 2 comp. including P5288 (CUT1 prom.) | P3852 | 4531 | Leaf orientation |
| G30 | AP2 (16-80) | 66 | G1792 | 2 comp. including P5287 (LTP1 prom.) | P3852 | 4531 | Greater tol. to cold (8 C.) |
| G30 | AP2 (16-80) | 66 | G1792 | 2 comp. including P5287 (LTP1 prom.) | P3852 | 4531 | Late flowering |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G30 | AP2 (16-80) | 66 | G1792 | 2 comp. including P5287 (LTP1 prom.) | P3852 | 4531 | Darker green leaf color |
| G30 | AP2 (16-80) | 66 | G1792 | 2 comp. including P5287 (LTP1 prom.) | P3852 | 4531 | Greater tol. to low nitrogen conditions |
| G30 | AP2 (16-80) | 66 | G1792 | 2 comp. including P5284 (RBCS3 prom.) | P3852 | 4531 | More res. to *Botrytis* |
| G30 | AP2 (16-80) | 66 | G1792 | 2 comp. including P5284 (RBCS3 prom.) | P3852 | 4531 | Greater res. to *Sclerotinia* |
| G30 | AP2 (16-80) | 66 | G1792 | 2 comp. including P5284 (RBCS3 prom.) | P3852 | 4531 | Late flowering |
| G30 | AP2 (16-80) | 66 | G1792 | 2 comp. including P5284 (RBCS3 prom.) | P3852 | 4531 | Darker green leaf color |
| G30 | AP2 (16-80) | 66 | G1792 | 2 comp. including P9002 (RD29A prom.) | P3852 | 4531 | Greater tol. to NaCl (determined with 150 mM NaCl) |
| G30 | AP2 (16-80) | 66 | G1792 | 2 comp. including P9002 (RD29A prom.) | P3852 | 4531 | Late flowering |
| G30 | AP2 (16-80) | 66 | G1792 | 2 comp. including P9002 (RD29A prom.) | P3852 | 4531 | Less sens. to ABA |
| G30 | AP2 (16-80) | 66 | G1792 | 2 comp. including P9002 (RD29A prom.) | P3852 | 4531 | Glossy leaves |
| G30 | AP2 (16-80) | 66 | G1792 | 2 comp. including P9002 (RD29A prom.) | P3852 | 4531 | Darker green leaf color |
| G30 | AP2 (16-80) | 66 | G1792 | 2 comp. including P5310 (RSI prom.) | P3852 | 4531 | Greater tol. to cold (8 C.) |
| G30 | AP2 (16-80) | 66 | G1792 | 2 comp. including P5310 (RS1 prom.) | P3852 | 4531 | Darker green leaf color |
| G30 | AP2 (16-80) | 66 | G1792 | 2 comp. including P5290 (SUC2 prom.) | P3852 | 4531 | Greater tol. to cold (8 C.) |
| G30 | AP2 (16-80) | 66 | G1792 | 2 comp. including P5290 (SUC2 prom.) | P3852 | 4531 | Altered C/N sensing: greater tol. to low nitrogen conditions in C/N sensing assay |
| G30 | AP2 (16-80) | 66 | G1792 | 2 comp. including P5290 (SUC2 prom.) | P3852 | 4531 | Glossy leaves |
| G30 | AP2 (16-80) | 66 | G1792 | 2 comp. including P5290 (SUC2 prom.) | P3852 | 4531 | Greater tol. to 300 mM mannitol |
| G30 | AP2 (16-80) | 66 | G1792 | 2 comp. including P5290 (SUC2 prom.) | P3852 | 4531 | Greater tol. to dehydration |
| G30 | AP2 (16-80) | 66 | G1792 | 2 comp. including P5290 (SUC2 prom.) | P3852 | 4531 | Late flowering |
| G30 | AP2 (16-80) | 66 | G1792 | 2 comp. including P5290 (SUC2 prom.) | P3852 | 4531 | Darker green leaf color |
| G30 | AP2 (16-80) | 66 | G1792 | 2 comp. including P5290 (SUC2 prom.) | P3852 | 4531 | Greater tol. to low nitrogen conditions |
| G30 | AP2 (16-80) | 66 | G1792 | Knockout | not applicable | | C/N sensing: greater sens. |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G30 | AP2 (16-80) | 66 | G1792 | Glucocorticoid receptor (GR) fusion (dexamethasone-inducible), 35S prom. (w/P5486) | P3852 | 4531 | More res. to *Botrytis* |
| G30 | AP2 (16-80) | 66 | G1792 | Glucocorticoid receptor (GR) fusion (dexamethasone-inducible), 35S prom. | P25086 | 4849 | Greater res. to *Sclerotinia* |
| G30 | AP2 (16-80) | 66 | G1792 | Glucocorticoid receptor (GR) fusion (dexamethasone-inducible), 35S prom. (w/P5486) | P3852 | 4531 | Greater res. to *Sclerotinia* |
| G3518 | AP2 (13-77) | 1982 | G1792 | Const. 35S prom. | P21404 | 4809 | Greater tol. to cold (8 C.) |
| G3518 | AP2 (13-77) | 1982 | G1792 | Const. 35S prom. | P21404 | 4809 | More tol. to drought* and better recovery from drought treatment* |
| G3518 | AP2 (13-77) | 1982 | G1792 | Const. 35S prom. | P21404 | 4809 | Greater res. to *Erysiphe* |
| G3518 | AP2 (13-77) | 1982 | G1792 | Const. 35S prom. | P21404 | 4809 | Altered C/N sensing: greater tol. to low nitrogen conditions in C/N sensing assay |
| G3518 | AP2 (13-77) | 1982 | G1792 | Const. 35S prom. | P21404 | 4809 | Greater tol. to NaCl (determined with 150 mM NaCl) |
| G3518 | AP2 (13-77) | 1982 | G1792 | Const. 35S prom. | P21404 | 4809 | Greater sens, to heat (32 C.) |
| G3518 | AP2 (13-77) | 1982 | G1792 | Const. 35S prom. | P21404 | 4809 | Altered leaf shape |
| G3518 | AP2 (13-77) | 1982 | G1792 | Const. 35S prom. | P21404 | 4809 | Glossy leaves |
| G3518 | AP2 (13-77) | 1982 | G1792 | Const. 35S prom. | P21404 | 4809 | Darker green leaf color |
| G3519 | AP2 (13-77) | 1984 | G1792 | Const. 35S prom. | P21405 | 4810 | Greater res. to *Erysiphe* |
| G3519 | AP2 (13-77) | 1984 | G1792 | Const. 35S prom. | P21405 | 4810 | Late flowering |
| G3519 | AP2 (13-77) | 1984 | G1792 | Const. 35S prom. | P21405 | 4810 | Altered leaf shape |
| G3519 | AP2 (13-77) | 1984 | G1792 | Const. 35S prom. | P21405 | 4810 | Glossy leaves |
| G3519 | AP2 (13-77) | 1984 | G1792 | Const. 35S prom. | P21405 | 4810 | Darker green leaf color |
| G3520 | AP2 (14-78) | 1986 | G1792 | Const. 35S prom. | P21406 | 4811 | Greater res. to *Erysiphe* |
| G3520 | AP2 (14-78) | 1986 | G1792 | Const. 35S prom. | P21406 | 4811 | Altered C/N sensing: greater tol. to low nitrogen conditions in C/N sensing assay |
| G3520 | AP2 (14-78) | 1986 | G1792 | Const. 35S prom. | P21406 | 4811 | Greater res. to *Sclerotinia* |
| G3520 | AP2 (14-78) | 1986 | G1792 | Const. 35S prom. | P21406 | 4811 | Late flowering |
| G3520 | AP2 (14-78) | 1986 | G1792 | Const. 35S prom. | P21406 | 4811 | Altered leaf shape |
| G3520 | AP2 (14-78) | 1986 | G1792 | Const. 35S prom. | P21406 | 4811 | Glossy leaves |
| G3520 | AP2 (14-78) | 1986 | G1792 | Const. 35S prom. | P21406 | 4811 | Darker green leaf color |
| G3380 | AP2 (18-82) | 1846 | G1792 | Const. 35S prom. | P21460 | 4812 | More tol. to drought* and better recovery from drought treatment* |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3380 | AP2 (18-82) | 1846 | G1792 | Const. 35S prom. | P21460 | 4812 | Greater res. to *Erysiphe* |
| G3380 | AP2 (18-82) | 1846 | G1792 | Const. 35S prom. | P21460 | 4812 | Less sens. to ABA |
| G3380 | AP2 (18-82) | 1846 | G1792 | Const. 35S prom. | P21460 | 4812 | Greater tol. to 300 mM mannitol |
| G3380 | AP2 (18-82) | 1846 | G1792 | Const. 35S prom. | P21460 | 4812 | Greater tol. to cold (8 C.) |
| G3380 | AP2 (18-82) | 1846 | G1792 | Const. 35S prom. | P21460 | 4812 | Late flowering |
| G3381 | AP2 (14-78) | 1848 | G1792 | Const. 35S prom. | P21461 | 4813 | Greater tol. to cold (8 C.) |
| G3381 | AP2 (14-78) | 1848 | G1792 | Const. 35S prom. | P21461 | 4813 | Greater res. to *Erysiphe* |
| G3381 | AP2 (14-78) | 1848 | G1792 | Const. 35S prom. | P21461 | 4813 | Greater res. to *Sclerotinia* |
| G3381 | AP2 (14-78) | 1848 | G1792 | Const. 35S prom. | P21461 | 4813 | More tol. to drought* and better recovery from drought treatment* |
| G3381 | AP2 (14-78) | 1848 | G1792 | Const. 35S prom. | P21461 | 4813 | Late flowering |
| G3381 | AP2 (14-78) | 1848 | G1792 | Const. 35S prom. | P21461 | 4813 | Darker green leaf color |
| G3381 | AP2 (14-78) | 1848 | G1792 | Const. 35S prom. | P21461 | 4813 | Greater tol. to hyperosmotic stress; more tol. to 300 mM mannitol or to NaCl (determined with 150 mM NaCl) |
| G3383 | AP2 (9-73) | 1850 | G1792 | Const. 35S prom. | P23523 | 4844 | Greater tol. to cold (8 C.) |
| G3383 | AP2 (9-73) | 1850 | G1792 | Const. 35S prom. | P23523 | 4844 | Greater tol. to dehydration |
| G3383 | AP2 (9-73) | 1850 | G1792 | Const. 35S prom. | P23523 | 4844 | Greater tol. to 300 mM mannitol |
| G3515 | AP2 (11-75) | 1976 | G1792 | Const. 35S prom. | P21401 | 4806 | More tol. to drought* and better recovery from drought treatment* |
| G3515 | AP2 (11-75) | 1976 | G1792 | Const. 35S prom. | P21401 | 4806 | More root hair |
| G3515 | AP2 (11-75) | 1976 | G1792 | Const. 35S prom. | P21401 | 4806 | More root mass |
| G3737 | AP2 (8-72) | 2104 | G1792 | Const. 35S prom. | P25089 | 4850 | Greater tol. to cold (8 C.) |
| G3737 | AP2 (8-72) | 2104 | G1792 | Const. 35S prom. | P25089 | 4850 | More tol. to drought* and better recovery from drought treatment* |
| G3737 | AP2 (8-72) | 2104 | G1792 | Const. 35S prom. | P25089 | 4850 | Less sens. to ABA |
| G3737 | AP2 (8-72) | 2104 | G1792 | Const. 35S prom. | P25089 | 4850 | Greater tol. to dehydration |
| G3737 | AP2 (8-72) | 2104 | G1792 | Const. 35S prom. | P25089 | 4850 | Greater tol. to NaCl (determined with 150 mM NaCl) |
| G3737 | AP2 (8-72) | 2104 | G1792 | Const. 35S prom. | P25089 | 4850 | Inflorescence: decreased apical dominance |
| G3737 | AP2 (8-72) | 2104 | G1792 | Const. 35S prom. | P25089 | 4850 | Greater res. to *Erysiphe* |
| G3737 | AP2 (8-72) | 2104 | G1792 | Const. 35S prom. | P25089 | 4850 | Late flowering |
| G3737 | AP2 (8-72) | 2104 | G1792 | Const. 35S prom. | P25089 | 4850 | Altered leaf shape |
| G3737 | AP2 (8-72) | 2104 | G1792 | Const. 35S prom. | P25089 | 4850 | Darker green leaf color |
| G3737 | AP2 (8-72) | 2104 | G1792 | Const. 35S prom. | P25089 | 4850 | Glossy leaves |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G3516 | AP2 (6-70) | 1978 | G1792 | Const. 35S prom. | P21402 | 4807 | Greater tol. to cold (8 C.) |
| G3516 | AP2 (6-70) | 1978 | G1792 | Const. 35S prom. | P21402 | 4807 | Altered C/N sensing: greater tol. to low nitrogen conditions in C/N sensing assay |
| G3517 | AP2 (13-77) | 1980 | G1792 | Const. 35S prom. | P21403 | 4808 | Greater res. to *Erysiphe* |
| G3517 | AP2 (13-77) | 1980 | G1792 | Const. 35S prom. | P21403 | 4808 | More res. to *Botrytis* |
| G3517 | AP2 (13-77) | 1980 | G1792 | Const. 35S prom. | P21403 | 4808 | Greater tol. to cold (8 C.) |
| G3517 | AP2 (13-77) | 1980 | G1792 | Const. 35S prom. | P21403 | 4808 | Greater tol. to heat (32 C.) |
| G3739 | AP2 (13-77) | 2106 | G1792 | Const. 35S prom. | P25090 | 4851 | Greater res. to *Erysiphe* |
| G3739 | AP2 (13-77) | 2106 | G1792 | Const. 35S prom. | P25090 | 4851 | Greater tol. to 300 mM mannitol |
| G3739 | AP2 (13-77) | 2106 | G1792 | Const. 35S prom. | P25090 | 4851 | Greater tol. to cold (8 C.) |
| G3739 | AP2 (13-77) | 2106 | G1792 | Const. 35S prom. | P25090 | 4851 | Greater tol. to dehydration |
| G3739 | AP2 (13-77) | 2106 | G1792 | Const. 35S prom. | P25090 | 4851 | Less sens. to ABA |
| G3739 | AP2 (13-77) | 2106 | G1792 | Const. 35S prom. | P25090 | 4851 | Altered inflorescence: decreased apical dominance |
| G3739 | AP2 (13-77) | 2106 | G1792 | Const. 35S prom. | P25090 | 4851 | Late flowering |
| G3739 | AP2 (13-77) | 2106 | G1792 | Const. 35S prom. | P25090 | 4851 | Altered leaf shape |
| G3739 | AP2 (13-77) | 2106 | G1792 | Const. 35S prom. | P25090 | 4851 | Glossy leaves |
| G3739 | AP2 (13-77) | 2106 | G1792 | Const. 35S prom. | P25090 | 4851 | Darker green leaf color |
| G3794 | AP2 (6-70) | 2132 | G1792 | Const. 35S prom. | P25092 | 4852 | Greater tol. to cold (8 C.) |
| G3794 | AP2 (6-70) | 2132 | G1792 | Const. 35S prom. | P25092 | 4852 | Greater tol. to dehydration |
| G3794 | AP2 (6-70) | 2132 | G1792 | Const. 35S prom. | P25092 | 4852 | Altered leaf shape |
| G1988 | Z—CO-like (5-50) | 30 | G1988 | Const. 35S prom. | P2499 | 4407 | Altered sugar sensing; greater tol. to sucrose (determined in 9.4% sucrose) |
| G1988 | Z—CO-like (5-50) | 30 | G1988 | Const. 35S prom. | P2499 | 4407 | Greater tol. to dehydration |
| G1988 | Z—CO-like (5-50) | 30 | G1988 | Const. 35S prom. | P2499 | 4407 | Better recovery from drought treatment* |
| G1988 | Z—CO-like (5-50) | 30 | G1988 | Const. 35S prom. | P2499 | 4407 | Late developing |
| G1988 | Z—CO-like (5-50) | 30 | G1988 | Const. 35S prom. | P2499 | 4407 | More root mass |
| G1988 | Z—CO-like (5-50) | 30 | G1988 | Const. 35S prom. | P2499 | 4407 | Altered light response; greater shade tol.; lack of shade avoidance phenotype; altered leaf orientation; upright leaves, longer hypocotyls, elongated petioles |
| G1988 | Z—CO-like (5-50) | 30 | G1988 | Const. 35S prom. | P2499 | 4407 | Altered C/N sensing: greater tol. to low nitrogen conditions in C/N sensing assay |
| G1988 | Z—CO-like (5-50) | 30 | G1988 | Const. 35S prom. | P2499 | 4407 | Greater tol. to cold (8 C.) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1988 | Z—CO-like (5-50) | 30 | G1988 | Const. 35S prom. | P2499 | 4407 | Improved yield |
| G4004 | Z—CO-like (6-51) | 2252 | G1988 | Const. 35S prom. | P26748 | 5050 | Greater tol. to cold (8 C.) |
| G4004 | Z—CO-like (6-51) | 2252 | G1988 | Const. 35S prom. | P26748 | 5050 | Long petiole |
| G4004 | Z—CO-like (6-51) | 2252 | G1988 | Const. 35S prom. | P26748 | 5050 | Altered light response; greater shade tol.; lack of shade avoidance phenotype; altered leaf orientation; upright leaves, longer hypocotyls, elongated and upright petioles |
| G4004 | Z—CO-like (6-51) | 2252 | G1988 | Const. 35S prom. | P26748 | 5050 | Altered C/N sensing: greater tol. to low nitrogen conditions in C/N sensing assay |
| G4004 | Z—CO-like (6-51) | 2252 | G1988 | Const. 35S prom. | P26748 | 5050 | Long hypocotyls |
| G4004 | Z—CO-like (6-51) | 2252 | G1988 | Const. 35S prom. | P26748 | 5050 | Late developing |
| G4005 | Z—CO-like (6-51) | 2254 | G1988 | Const. 35S prom. | P26749 | 5051 | Long petiole |
| G4005 | Z—CO-like (6-51) | 2254 | G1988 | Const. 35S prom. | P26749 | 5051 | Altered light response; greater shade tol.; lack of shade avoidance phenotype; altered leaf orientation; upright leaves, light green, elongated and upright petioles |
| G4005 | Z—CO-like (6-51) | 2254 | G1988 | Const. 35S prom. | P26749 | 5051 | Late developing |
| G4005 | Z—CO-like (6-51) | 2254 | G1988 | Const. 35S prom. | P26749 | 5051 | Altered C/N sensing: greater tol. to low nitrogen conditions in C/N sensing assay |
| G4005 | Z—CO-like (6-51) | 2254 | G1988 | Const. 35S prom. | P26749 | 5051 | Some lines have decreased tol. to cold (8 C.), but more lines are more tol to cold (8 C.) |
| G4005 | Z—CO-like (6-51) | 2254 | G1988 | Const. 35S prom. | P26749 | 5051 | Altered sugar sensing; some lines have decreased tol. to 9.4% sucrose, but more lines are more tol to 9.4% sucrose |
| G4007 | Z—CO-like (5-50) | 2256 | G1988 | — | — | — | n/d |
| G4011 | Z—CO-like (8-49) | 2260 | G1988 | Const. 35S prom | P27405 | 5084 | Altered sugar sensing; greater tol. to sucrose (determined in 9.4% sucrose) |
| G4011 | Z—CO-like (8-49) | 2260 | G1988 | Const. 35S prom | P27405 | 5084 | More tol. to cold (8 C.) |
| G4011 | Z—CO-like (8-49) | 2260 | G1988 | Const. 35S prom | P27405 | 5084 | Altered C/N sensing: greater tol. to low nitrogen conditions in C/N sensing assay |
| G4012 | Z—CO-like (15-56) | 2262 | G1988 | Const. 35S prom | P27406 | 5085 | Altered light response; greater shade tol.; lack of shade avoidance phenotype; altered leaf orientation; |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| | | | | | | | upright leaves, longer hypocotyls, elongated and upright petioles |
| G4012 | Z—CO-like (15-56) | 2262 | G1988 | Const. 35S prom | P27406 | 5085 | Late flowering |
| G4012 | Z—CO-like (15-56) | 2262 | G1988 | Const. 35S prom | P27406 | 5085 | Altered sugar sensing; greater tol. to sucrose (determined in 9.4% sucrose) |
| G4012 | Z—CO-like (15-56) | 2262 | G1988 | Const. 35S prom | P27406 | 5085 | More tol. to cold (8 C.) |
| G4012 | Z—CO-like (15-56) | 2262 | G1988 | Const. 35S prom | P27406 | 5085 | Altered C/N sensing: greater tol. to low nitrogen conditions in C/N sensing assay |
| G4298 | Z—CO-like (15-56) | 2350 | G1988 | — | — | | n/d |
| G4009 | Z—CO-like (6-51) | 2258 | G1988 | — | — | | n/d |
| G4299 | Z—CO-like (9-54) | 2352 | G1988 | Const. 35S prom. | P27428 | 5086 | Long petiole |
| G4299 | Z—CO-like (9-54) | 2352 | G1988 | Const. 35S prom. | P27428 | 5086 | Long hypocotyls |
| G4299 | Z—CO-like (9-54) | 2352 | G1988 | Const. 35S prom. | P27428 | 5086 | Altered light response; greater shade tol.; lack of shade avoidance phenotype; altered leaf orientation; upright pale leaves, longer hypocotyls |
| G4299 | Z—CO-like (9-54) | 2352 | G1988 | Const. 35S prom. | P27428 | 5086 | Late developing |
| G4299 | Z—CO-like (9-54) | 2352 | G1988 | Const. 35S prom. | P27428 | 5086 | Altered sugar sensing; greater tol. to sucrose (determined in 9.4% sucrose) |
| G4299 | Z—CO-like (9-54) | 2352 | G1988 | Const. 35S prom. | P27428 | 5086 | More tol. to cold (8 C.) |
| G4299 | Z—CO-like (9-54) | 2352 | G1988 | Const. 35S prom. | P27428 | 5086 | Altered C/N sensing: greater tol. to low nitrogen conditions in C/N sensing assay |
| G4000 | Z—CO-like (20-61) | 2250 | G1988 | Const. 35S prom. | P27404 | 5083 | Altered light response; greater shade tol.; lack of shade avoidance phenotype; altered leaf orientation; narrow upright leaves, longer hypocotyls |
| G4000 | Z—CO-like (20-61) | 2250 | G1988 | Const. 35S prom. | P27404 | 5083 | Late developing |
| G903 | Z-C2H2 (68-92) | 670 | | Const. 35S prom. | P138 | 3840 | Altered leaf morphology; narrow twisted leaves |
| G4000 | Z—CO-like (20-61) | 2250 | G1988 | Const. 35S prom. | P27404 | 5083 | Some lines more sens. to cold (8 C.) |
| G4000 | Z—CO-like (20-61) | 2250 | G1988 | Const. 35S prom. | P27404 | 5083 | Altered sugar sensing; greater tol. to sucrose (determined in 9.4% sucrose) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G4000 | Z—CO-like (20-61) | 2250 | G1988 | Const. 35S prom. | P27404 | 5083 | Altered C/N sensing: greater tol. to low nitrogen conditions in C/N sensing assay |
| G4297 | Z—CO-like (14-55) | 2348 | G1988 | — | — | — | n/d |
| G142 | MADS (2-57) | 98 | G142 | Const. 35S prom. | P2109 | 4352 | Early flowering |
| G148 | MADS (1-57) | 106 | G142 | Const. 35S prom. | P13734 | 4636 | Early flowering |
| G154 | MADS (2-57) | 114 | G154 | Const. 35S prom. | P1223 | 4070 | Altered C/N sensing: greater tol. to low nitrogen conditions in C/N sensing assay |
| G154 | MADS (2-57) | 114 | G154 | Const. 35S prom. | — | — | Early flowering |
| G154 | MADS (2-57) | 114 | G154 | SUC2 | — | — | Early flowering |
| G1011 | MADS (2-57) | | G154 | Const. 35S prom. | — | — | Reduced petal abscission, early flowering, decreased biomass |
| G627 | MADS (2-57) | | G154 | Const. 35S prom. | — | — | Early flowering |
| G1797 | MADS (2-57) | | G154 | Const. 35S prom. | — | — | Reduced petal abscission |
| G1797 | MADS (2-57) | | G154 | RBCS3 | — | — | Increased Brix, increased lycopene |
| G1798 | MADS (2-57) | | G154 | Const. 35S prom. | — | — | Multiple inflorescence defects; increasd trichome density, darker leaf color, early flowering |
| G201 | MYB-(R1)R2R3 (14-114) | 172 | | Const. 35S prom. | P3 | 3793 | Higher seed protein content |
| G201 | MYB-(R1)R2R3 (14-114) | 172 | | Const. 35S prom. | P3 | 3793 | Decreased seed oil content |
| G202 | MYB-(R1)R2R3 (13-116) | 174 | | Const. 35S prom. | P4 | 3794 | Decreased seed oil content |
| G671 | MYB-(R1)R2R3 (15-115) | 538 | | Const. 35S prom. | P995 | 4025 | Altered inflorescence stem structure; bolts terminated in flowers or aborted flowers, secondary bolts replaced by leaf-like structures, bolts of small plants oddly shaped, changing direction slightly at each node |
| G671 | MYB-(R1)R2R3 (15-115) | 538 | | Const. 35S prom. | P995 | 4025 | Reduced petal abscission |
| G671 | MYB-(R1)R2R3 (15-115) | 538 | | Const. 35S prom. | P995 | 4025 | Altered leaf shape; true leaves curled under, petioles were upright, some plants had curled cotyledons |
| G671 | MYB-(R1)R2R3 (15-115) | 538 | | Const. 35S prom. | P995 | 4025 | Small plant |
| G671 | MYB-(R1)R2R3 (15-115) | 538 | | Const. 35S prom. | P995 | 4025 | Reduced fertility |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G201 | MYB-(R1)R2R3 (14-114) | 172 | | Const. 35S prom. | | | Increased Seed protein content; Decreased Seed oil content; |
| G243 | MYB-(R1)R2R3 | 18057 | | AP1 prom. | | | Increased Brix |
| G189 | WRKY (240-297) | 156 | | Const. 35S prom. | P970 | 4013 | Greater leaf size |
| G189 | WRKY (240-297) | 156 | | Const. 35S prom. | P970 | 4013 | Altered C/N sensing: greater tol. to low nitrogen conditions in C/N sensing assay |
| G287 | MISC (293-354) | 256 | | Const. 35S prom. | P13371 | 4614 | Inc. biomass; inc. rosette biomass at later stages of development |
| G748 | Z-Dof (112-140) | 580 | | Const. 35S prom. | P346 | 3902 | Altered seed prenyl lipids; more lutein content |
| G748 | Z-Dof (112-140) | 580 | | Const. 35S prom. | P346 | 3902 | Altered stem morphology; more vascular bundles in stem |
| G748 | Z-Dof (112-140) | 580 | | Const. 35S prom. | P346 | 3902 | Late flowering |
| G878 | WRKY (250-305, 415-475) | 656 | | Const. 35S prom. | P1345 | 4111 | Delayed senescence |
| G878 | WRKY (250-305, 415-475) | 656 | | Const. 35S prom. | P1345 | 4111 | Late flowering |
| G878 | WRKY (250-305, 415-475) | 656 | | Const. 35S prom. | P1345 | 4111 | Darker green |
| G878 | WRKY (250-305, 415-475) | 656 | | Const. 35S prom. | P1345 | 4111 | Shorter stems |
| G1730 | RING/C3H2C3 (103-144) | 1128 | | Const. 35S prom. | P15024 | 4660 | Inc. tol. to hyperosmotic stress; seedlings more tol. to 300 mM mannitol |
| G1730 | RING/C3H2C3 (103-144) | 1128 | | Const. 35S prom. | P15024 | 4660 | Altered sugar sensing; seedlings larger, greener and had higher germination efficiency in 5% glucose |
| G1730 | RING/C3H2C3 (103-144) | 1128 | | Const. 35S prom. | P15024 | 4660 | More tol. to drought* |
| G2142 | HLH/MYC (42-100) | 1406 | | Const. 35S prom. | P2444 | 4393 | More tolerant to phosphate deprivation in a root growth assay |
| G2142 | HLH/MYC (42-100) | 1406 | | Const. 35S prom. | P2444 | 4393 | Early flowering |
| G2379 | TH (19-110, 173-232) | 1492 | | Const. 35S prom. | P1951 | 4289 | Altered sugar sensing; greater tol. to sucrose (determined in 9.4% sucrose) |
| G2552 | HLH/MYC (124-181) | 1568 | | Const. 35S prom. | P2068 | 4338 | Increase leaf glucosinolate M39480 |
| G2724 | MYB-(R1)R2R3 (7-113) | 1660 | | Const. 35S prom. | P2014 | 4311 | Darker green leaves |
| G2933 | HLH/MYC (68-128) | 1754 | | Const. 35S prom. | P2392 | 4371 | Larger seeds |
| G2933 | HLH/MYC (68-128) | 1754 | | Const. 35S prom. | P2392 | 4371 | More tol. to cold (8 C.) |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G2936 | HLH/MYC (82-142) | | | RSI1 prom. | — | | Increased Lycopene |
| G2936 | HLH/MYC (82-142) | | | STM prom. | — | | Increased fruit weight |
| G2936 | HLH/MYC (82-142) | | | RBCS3 prom. | — | | Increased fruit weight |
| G1073 and G1274 | AT-hook (63-71, 71-216) and WRKY (110-166) | 18 and 20 | G1073 and G1274 | Double transcription factor overexpression; const. 35S prom. | P448, P15038 | 3936 and 4665 | Greater biomass, additive effect relative to either parent overexpressor line |
| G1073 and G3086 | AT-hook (63-71, 71-216) and HLH/MYC (307-365) | 18 and 1836 | G1073 and G3086 | Double transcription factor overexpression; const. 35S prom. | P448 and P15046 | 3936 and 4668 | Early flowering; G3086 OE overcomes delayed flowering associated with G1073 OE |
| G481 and G3086 | CAAT (20-109) and HLH/MYC (307-365) | 10 and 1836 | G481 and G3086 | Double transcription factor overexpression; const. 35S prom. | P46 and P15046 | 3811 and 4668 | Early flowering; G3086 OE overcomes delayed flowering associated with G481 OE |
| G481 and G1274 | CAAT (20-109) and WRKY (110-166) | 10 and 20 | G481 and G1274 | Double transcription factor overexpression; const. 35S prom. | P46 and P15038 | 3811 and 4665 | Greater seedling vigor; novel phenotype not typically seen in either single parental overexpressor line |
| G481 and, G1073 | CAAT (20-109) and AT-hook (63-71, 71-216) | 10 and 18 | G481 and, G1073 | Double transcription factor overexpression; const. 35S prom. | P46 and P448 | 3811 and 3936 | Late flowering was enhanced compared to either parental line |
| G481 and G1073 | CAAT (20-109) and AT-hook (63-71, 71-216) | 10 and 18 | G481 and G1073 | Double transcription factor overexpression; const. 35S prom. | P46 and P448 | 3811 and 3936 | Darker green leaves, additive phenotype compared to either parental overexpressor line |
| G481 and G867 | CAAT (20-109) and AP2 (59-124, 184-276) | 10 and 16 | G481 and G867 | Double transcription factor overexpression; const. 35S prom. | P46 and P26372 | 3811 and 4966 | Darker green leaves, additive phenotype compared to either parental overexpressor line |
| G28 and G1266 | AP2 (145-208) and AP2 (79-147) | 2 and 884 | G28 and G1266 | Double transcription factor overexpression; const. 35S prom. | P174 and P26385 | 3854 and 4969 | More res. to *Botrytis*; additive phenotype relative to either parental overexpressor line |
| G28 and G1266 | AP2 (145-208) and AP2 (79-147) | 2 and 884 | G28 and G1266 | Double transcription factor overexpression; const. 35S prom. | P174 and P26385 | 3854 and 4969 | Greater res. to *Fusarium*; new phenotype not previously observed in either parental overexpressor line |
| G28 and G1266 | AP2 (145-208) and AP2 (79-147) | 2 and 884 | G28 and G1266 | Double transcription factor overexpression; const. 35S prom. | P174 and P26385 | 3854 and 4969 | Greater res. to *Sclerotinia*; additive phenotype relative to either parental overexpressor line |
| G28 and G1919 | AP2 (145-208) and RING/C3HC4 (214-287) | 2 and 1268 | G28 and G1919 | Double transcription factor overexpression; const. 35S prom. | P174 and P26383 | 3854 and 4968 | Greater res. to *Fusarium*; new phenotype not previously observed in either parental overexpressor line |

TABLE 21-continued

Phenotypic traits conferred by transcription factors in morphological, physiological or disease assays

| GID | TF family (amino acid coordinates of characteristic conserved domain) | SEQ ID NO: of GID | Phylogenetic relationship; closely related to: | Expression system | Construct containing TF | SEQ ID NO: of Construct | Experimental observation (trait compared to controls) |
|---|---|---|---|---|---|---|---|
| G1073 and G1274 | AT-hook (63-71, 71-216) and WRKY (110-166) | 18 and 20 | G1073 and G1274 | Double transcription factor overexpression; const. 35S prom. | P448 and P15038 | 3936 and 4665 | Reduced apical dominance characteristic of G1274 OE lines, indicating that G1274 OE can overcome increased branching effects of G1073 OE |
| G47, G481 and, G1073 | AP2 (10-75), CAAT (20-109) and AT-hook (63-71, 71-216) | 6, 10, and 18 | G47, G481 and, G1073 | Double and triple transcription factor overexpression; const. 35S prom. | P26388, P46, and P448 | 4970, 3811, and 3936 | Water deficit (determined in a drought assay*) tol. was more marked than was typically obtained with any of the parental overexpressor lines |
| G481, G1073 and G3086 | CAAT (20-109), AT-hook (63-71, 71-216) and HLH/MYC (307-365) | 10, 18, and 1836 | G481, G1073 and G3086 | Triple transcription factor overexpression; const. 35S prom. | P46, P448, and P15046 | 3811, 3936, and 4668 | Greater tol. to water deficit (determined in a drought assay*); flowered at the same time as wild-type in contrast to late flowering in double G1073-G481 OEs; thus, G3086 OE mitigates delayed flowering or maturation associated with G481 and G1073 OE |

Abbreviations for Table 20

At: *Arabidopsis thaliana*; Bo: *Brassica oleracea*; Cs: Br: *Brassica rapa*; *Citrus sinensis*; Dc: *Daucus carota*; Gm: *Glycine max*; Os: *Oryza sativa*; Ga: *Gossypium arboreum*; Gh: *Gossypium hirsutum*; Gr: *Gossypium raimondii*; Mt: *Medicago truncatula*; Nb: *Nicotiana benthamiana*; Nt: *Nicotiana tabacum*; Pt: *Populus trichocarpa*; Sc: *Saccharomyces cerevisiae*; Sl: *Solanum lycopersicum*; So: *Saccharum officinarum*; St: *Solanum tuberosum*; Ta: *Triticum aestivum*; Vv: *Vitis vinifera*; Ze: *Zinnia elegans*; Zm: *Zea mays* ABA=abscisic acid; ACC=1-aminocyclopropane 1-carboxylic acid; OE=overexpress(ed), overexpression or overexpressor(s); inc.=increase(d); tol.=tolerance; res.=resistance; sens.=sensitive; const.=constitutive; prom.=promoter; 35S=cauliflower mosaic virus 35S promoter; PEG=polyethylene glycol

* drought tolerance determined in soil-based assays as opposed to plate-based drought or dehydration assays Note: * the sequence was introduced into in tomato. In this Example, unless otherwise indicted, morphological and physiological traits are disclosed in comparison to wild-type control plants. That is, a transformed plant that is described as large and/or drought tolerant is large and more tolerant to drought with respect to a wild-type control plant. When a plant is said to have a better performance than controls, it generally showed less stress symptoms than control plants. The better performing lines may, for example, produce less anthocyanin, or be larger, greener, or more vigorous in response to a particular stress, as noted below. Better performance generally implies greater tolerance to a particular biotic or abiotic stress, less sensitivity to ABA, or better recovery from a stress (as in the case of a drought treatment) than controls.

Example XIII. Transformation of Eudicots for Greater Biomass, Disease Resistance or Abiotic Stress Tolerance Crop species including tomato and soybean plants that overexpress any of a considerable number of the transcription factor polypeptides of the invention have been shown experimentally to produce plants with increased drought tolerance and/or biomass in field trials. For example, tomato plants overexpressing the G2153 polypeptide have been found to be larger than wild-type control tomato plants. For example, soy plants overexpressing a number of G481, G682, G867 and G1073, their orthologs or putative orthologs, and other sequences listed above have been shown to be more water deficit-tolerant than control plants. These observations indicate that these genes, when overexpressed, will result in larger yields than non-transformed plants in both stressed and non-stressed conditions.

Thus, transcription factor polynucleotide sequences listed in the Sequence Listing recombined into, for example, one of the expression vectors of the invention, or another suitable expression vector, may be transformed into a plant for the purpose of modifying plant traits for the purpose of improving yield and/or quality. The expression vector may contain a constitutive, tissue-specific or inducible promoter operably linked to the transcription factor polynucleotide. The cloning vector may be introduced into a variety of plants by means well known in the art such as, for example, direct DNA transfer or *Agrobacterium tumefaciens*-mediated transformation. It is now routine to produce transgenic plants using most eudicot plants (see Weissbach and Weissbach, (1989); Gelvin et al. (1990); Herrera-Estrella et al. (1983); Bevan (1984); and Klee (1985)). Methods for analysis of traits are routine in the art and examples are disclosed above.

Numerous protocols for the transformation of tomato and soy plants have been previously described, and are well known in the art. Gruber et al. (1993), and Glick and Thompson (1993) describe several expression vectors and culture methods that may be used for cell or tissue transformation and subsequent regeneration. For soybean transformation, methods are described by Miki et al. (1993); and U.S. Pat. No. 5,563,055, (Townsend and Thomas), issued Oct. 8, 1996.

There are a substantial number of alternatives to *Agrobacterium*-mediated transformation protocols, other methods for the purpose of transferring exogenous genes into soybeans or tomatoes. One such method is microprojectile-mediated transformation, in which DNA on the surface of microprojectile particles is driven into plant tissues with a biolistic device (see, for example, Sanford et al. (1987); Christou et al. (1992); Sanford (1993); Klein et al. (1987); U.S. Pat. No. 5,015,580 (Christou et al), issued May 14, 1991; and U.S. Pat. No. 5,322,783 (Tomes et al.), issued Jun. 21, 1994).

Alternatively, sonication methods (see, for example, Zhang et al. (1991)); direct uptake of DNA into protoplasts using $CaCl_2$ precipitation, polyvinyl alcohol or poly-L-ornithine (Hain et al. (1985); Draper et al. (1982)); liposome or spheroplast fusion (see, for example, Deshayes et al. (1985); Christou et al. (1987)); and electroporation of protoplasts and whole cells and tissues (see, for example, Donn et al. (1990); D'Halluin et al. (1992); and Spencer et al. (1994)) have been used to introduce foreign DNA and expression vectors into plants.

After a plant or plant cell is transformed (and the latter regenerated into a plant), the transformed plant may be crossed with itself or a plant from the same line, a non-transformed or wild-type plant, or another transformed plant from a different transgenic line of plants. Crossing provides the advantages of producing new and often stable transgenic varieties. Genes and the traits they confer that have been introduced into a tomato or soybean line may be moved into distinct line of plants using traditional backcrossing techniques well known in the art. Transformation of tomato plants may be conducted using the protocols of Koornneef et al (1986), and in U.S. Pat. No. 6,613,962, the latter method described in brief here. Eight day old cotyledon explants are precultured for 24 hours in Petri dishes containing a feeder layer of *Petunia hybrida* suspension cells plated on MS medium with 2% (w/v) sucrose and 0.8% agar supplemented with 10 µM □-naphthalene acetic acid and 4.4 µM 6-benzylaminopurine. The explants are then infected with a diluted overnight culture of *Agrobacterium tumefaciens* containing an expression vector comprising a polynucleotide of the invention for 5-10 minutes, blotted dry on sterile filter paper and cocultured for 48 hours on the original feeder layer plates. Culture conditions are as described above. Overnight cultures of *Agrobacterium tumefaciens* are diluted in liquid MS medium with 2% (w/v/) sucrose, pH 5.7) to an $OD_{600}$ of 0.8.

Following cocultivation, the cotyledon explants are transferred to Petri dishes with selective medium comprising MS medium with 4.56 µM zeatin, 67.3 µM vancomycin, 418.9 µM cefotaxime and 171.6 µM kanamycin sulfate, and cultured under the culture conditions described above. The explants are subcultured every three weeks onto fresh medium. Emerging shoots are dissected from the underlying callus and transferred to glass jars with selective medium without zeatin to form roots. The formation of roots in a kanamycin sulfate-containing medium is a positive indication of a successful transformation.

Transformation of soybean plants may be conducted using the methods found in, for example, U.S. Pat. No. 5,563,055 (Townsend et al., issued Oct. 8, 1996), described in brief here. In this method soybean seed is surface sterilized by exposure to chlorine gas evolved in a glass bell jar. Seeds are germinated by plating on ¹/₁₀ strength agar solidified medium without plant growth regulators and culturing at 28° C. with a 16 hour day length. After three or four days, seed may be prepared for cocultivation. The seedcoat is removed and the elongating radicle removed 3-4 mm below the cotyledons.

Overnight cultures of *Agrobacterium tumefaciens* harboring the expression vector comprising a polynucleotide of the invention are grown to log phase, pooled, and concentrated by centrifugation. Inoculations are conducted in batches such that each plate of seed is treated with a newly resuspended pellet of *Agrobacterium*. The pellets are resuspended in 20 ml inoculation medium. The inoculum is poured into a Petri dish containing prepared seed and the cotyledonary nodes are macerated with a surgical blade. After 30 minutes the explants are transferred to plates of the same medium that has been solidified. Explants are embedded with the adaxial side up and level with the surface of the medium and cultured at 22° C. for three days under white fluorescent light. These plants may then be regenerated according to methods well established in the art, such as by moving the explants after three days to a liquid counter-selection medium (see U.S. Pat. No. 5,563,055).

The explants may then be picked, embedded and cultured in solidified selection medium. After one month on selective media transformed tissue becomes visible as green sectors of regenerating tissue against a background of bleached, less healthy tissue. Explants with green sectors are transferred to an elongation medium. Culture is continued on this medium with transfers to fresh plates every two weeks. When shoots are 0.5 cm in length they may be excised at the base and placed in a rooting medium.

Example XIV: Transformation of Monocots for Greater Biomass, Disease Resistance or Abiotic Stress Tolerance Cereal plants such as, but not limited to, corn, wheat, rice, sorghum, barley, switchgrass or *Miscanthus* may be transformed with the present polynucleotide sequences, including monocot or eudicot-derived sequences such as those presented in the present Tables, cloned into a vector such as pGA643 and containing a kanamycin-resistance marker, and expressed constitutively under, for example, the CaMV 35S or COR15 promoters, or with tissue-specific or inducible promoters. The expression vectors may be one found in the Sequence Listing, or any other suitable expression vector may be similarly used. For example, pMEN020 may be modified to replace the NptII coding region with the BAR gene of *Streptomyces hygroscopicus* that confers resistance to phosphinothricin. The KpnI and BglII sites of the Bar gene are removed by site-directed mutagenesis with silent codon changes.

The cloning vector may be introduced into a variety of cereal plants by means well known in the art including direct DNA transfer or *Agrobacterium tumefaciens*-mediated transformation. The latter approach may be accomplished by a variety of means, including, for example, that of U.S. Pat. No. 5,591,616, in which monocotyledon callus is transformed by contacting dedifferentiating tissue with the *Agrobacterium* containing the cloning vector.

The sample tissues are immersed in a suspension of $3 \times 10^9$ cells of *Agrobacterium* containing the cloning vector for 3-10 minutes. The callus material is cultured on solid medium at 25° C. in the dark for several days. The calli grown on this medium are transferred to Regeneration medium. Transfers are continued every 2-3 weeks (2 or 3 times) until shoots develop. Shoots are then transferred to Shoot-Elongation medium every 2-3 weeks. Healthy looking shoots are transferred to rooting medium and after roots have developed, the plants are placed into moist potting soil.

The transformed plants are then analyzed for the presence of the NPTII gene/kanamycin resistance by ELISA, using the ELISA NPTII kit from SPrime-3Prime Inc. (Boulder, Colo.).

It is also routine to use other methods to produce transgenic plants of most cereal crops (Vasil (1994)) such as corn, wheat, rice, sorghum (Cassas et al. (1993)), and barley (Wan and Lemeaux (1994)). DNA transfer methods such as the microprojectile method can be used for corn (Fromm et al. (1990); Gordon-Kamm et al. (1990); Ishida (1990)), wheat (Vasil et al. (1992); Vasil et al. (1993); Weeks et al. (1993)), and rice (Christou (1991); Hiei et al. (1994); Aldemita and Hodges (1996); and Hiei et al. (1997)). For most cereal plants, embryogenic cells derived from immature scutellum tissues are the preferred cellular targets for transformation (Hiei et al. (1997); Vasil (1994)). For transforming corn embryogenic cells derived from immature scutellar tissue using microprojectile bombardment, the A 188XB73 genotype is the preferred genotype (Fromm et al. (1990); Gordon-Kamm et al. (1990)). After microprojectile bombardment the tissues are selected on phosphinothricin to identify the transgenic embryogenic cells (Gordon-Kamm et al. (1990)). Transgenic plants are regenerated by standard corn regeneration techniques (Fromm et al. (1990); Gordon-Kamm et al. (1990)).

Example XV: Transcription Factor Expression and Analysis of Disease Resistance or Abiotic Stress Tolerance Northern blot analysis, RT-PCR or microarray analysis of the regenerated, transformed plants may be used to show expression of a transcription factor polypeptide or the invention and related genes that are capable of inducing disease resistance, abiotic stress tolerance, and/or larger size.

To verify the ability to confer stress resistance, mature plants overexpressing a transcription factor of the invention, or alternatively, seedling progeny of these plants, may be challenged by a stress such as a disease pathogen, drought, heat, cold, high salt, or desiccation. Alternatively, these plants may challenged in a hyperosmotic stress condition that may also measure altered sugar sensing, such as a high sugar condition. By comparing control plants (for example, wild type) and transgenic plants similarly treated, the transgenic plants may be shown to have greater tolerance to the particular stress.

After a eudicot plant, monocot plant or plant cell has been transformed (and the latter regenerated into a plant) and shown to have greater size or tolerance to abiotic stress, or produce greater yield relative to a control plant under the stress conditions, the transformed monocot plant may be crossed with itself or a plant from the same line, a non-transformed or wild-type monocot plant, or another transformed monocot plant from a different transgenic line of plants.

These experiments would demonstrate that transcription factor polypeptides of the invention can be identified and shown to confer larger size, greater yield, greater disease resistance and/or abiotic stress tolerance in eudicots or monocots, including tolerance or resistance to multiple stresses.

Example XVI: Sequences that Confer Significant Improvements to Non-*Arabidopsis* Species The function of specific transcription factors of the invention, including closely-related orthologs, have been analyzed and may be further characterized and incorporated into crop plants. The ectopic overexpression of these sequences may be regulated using constitutive, inducible, or tissue specific regulatory elements. Genes that have been examined and have been shown to modify plant traits (including increasing biomass, disease resistance and/or abiotic stress tolerance) encode transcription factor polypeptides found in the Sequence Listing. In addition to these sequences, it is expected that newly discovered polynucleotide and polypeptide sequences closely related to polynucleotide and polypeptide sequences found in the Sequence Listing can also confer alteration of traits in a similar manner to the sequences found in the Sequence Listing, when transformed into a any of a considerable variety of plants of different species, and including eudicots and monocots. The polynucleotide and polypeptide sequences derived from monocots (e.g., the rice sequences) may be used to transform both monocot and eudicot plants, and those derived from eudicots (e.g., the *Arabidopsis* and soy genes) may be used to transform either group, although it is expected that some of these sequences will function best if the gene is transformed into a plant from the same group as that from which the sequence is derived.

As an example of a first step to determine drought-related tolerance, seeds of these transgenic plants are subjected to germination assays to measure sucrose sensing. Sterile monocot seeds, including, but not limited to, corn, rice, wheat, rye and sorghum, as well as eudicots including, but not limited to soybean and alfalfa, are sown on 80% MS medium plus vitamins with 9.4% sucrose; control media lack sucrose. All assay plates are then incubated at 22° C. under 24-hour light, 120-130 µEin/m$^2$/s, in a growth chamber. Evaluation of germination and seedling vigor is then conducted three days after planting. Plants overexpressing sequences of the invention may be found to be more tolerant to high sucrose by having better germination, longer radicles, and more cotyledon expansion. These methods have been used to show that overexpressors of numerous sequences of the invention are involved in sucrose-specific sugar sensing. It is expected that structurally similar orthologs of these sequences, including those found in the Sequence Listing, are also involved in sugar sensing, an indication of altered osmotic stress tolerance.

Plants overexpressing the transcription factor sequences of the invention may also be subjected to soil-based drought assays to identify those lines that are more tolerant to water deprivation than wild-type control plants. A number of the lines of plants overexpressing transcription factor polypeptides of the invention, including newly discovered closely-related species, will be significantly larger and greener, with less wilting or desiccation, than wild-type control plants, particularly after a period of water deprivation is followed by rewatering and a subsequent incubation period. The sequence of the transcription factor may be overexpressed under the regulatory control of constitutive, tissue specific or inducible promoters, or may comprise a GAL4 transactivation domain fused to either the N- or the C terminus of the polypeptide. The results presented in Examples above indicate that these transcription factors may confer disease resistance or abiotic stress tolerance when they are overexpressed under the regulatory control of non-constitutive promoters or a transactivation domain fused to the clade member, without having a significant adverse impact on plant morphology and/or development. The lines that display useful traits may be selected for further study or commercial development.

Monocotyledonous plants, including rice, corn, wheat, rye, sorghum, barley and others, may be transformed with a plasmid containing a transcription factor polynucleotide. The transcription factor gene sequence may include eudicot or monocot-derived sequences such as those presented herein. These transcription factor genes may be cloned into an expression vector containing a kanamycin-resistance marker, and then expressed constitutively or in a tissue-specific or inducible manner.

The cloning vector may be introduced into monocots by, for example, means described in the previous Example, including direct DNA transfer or *Agrobacterium tumefaciens*-mediated transformation. The latter approach may be accomplished by a variety of means, including, for example, that of U.S. Pat. No. 5,591,616, in which monocotyledon callus is transformed by contacting dedifferentiating tissue with the *Agrobacterium* containing the cloning vector.

The sample tissues are immersed in a suspension of $3 \times 10^{-9}$ cells of *Agrobacterium* containing the cloning vector for 3-10 minutes. The callus material is cultured on solid medium at 25° C. in the dark for several days. The calli grown on this medium are transferred to Regeneration medium. Transfers are continued every 2-3 weeks (2 or 3 times) until shoots develop. Shoots are then transferred to Shoot-Elongation medium every 2-3 weeks. Healthy looking shoots are transferred to rooting medium and after roots have developed, the plants are placed into moist potting soil.

The transformed plants are then analyzed for the presence of the NPTII gene/kanamycin resistance by ELISA, using the ELISA NPTII kit from SPrime-3Prime Inc. (Boulder, Colo.).

Northern blot analysis, RT-PCR or microarray analysis of the regenerated, transformed plants may be used to show expression of a transcription factor polypeptide of the invention that is capable of conferring abiotic stress tolerance, disease resistance, or increased size or yield, in the transformed plants.

To verify the ability to confer abiotic stress tolerance, mature plants or seedling progeny of these plants expressing a monocot-derived equivalog gene may be challenged using methods described in the above Examples. By comparing wild type plants and the transgenic plants, the latter are shown be more tolerant to abiotic stress, more resistant to disease, and/or have greater biomass, as compared to wild type control plants similarly treated.

It is expected that the same methods may be applied to identify other useful and valuable sequences of the present transcription factor clades, and the sequences may be derived from a diverse range of species.

REFERENCES CITED

Abe et al. (1997) *Plant Cell* 9: 1859-1868
Abe et al. (2003) *Plant Cell* 15: 63-78
Affolter et al. (1990) *Curr. Opin. Cell. Biol.* 2: 485-495
Agrios, G. N. (1997) *Plant Pathology.* 4$^{th}$ edition. (Academic Press, San Diego, New York)
Aldemita and Hodges (1996) *Planta* 199: 612-617
Alia et al. (1998) *Plant J.* 16: 155-161
Allen (1998) *EMBO J.* 17: 5484-5496.
Altschul (1990) *J Mol. Biol.* 215: 403-410
Altschul (1993) *J. Mol. Evol.* 36: 290-300
Altschul et al. (1997) *Nucleic Acids Res.* 25: 3389-3402
Anderson and Young (1985) "Quantitative Filter Hybridisation", In: Hames and Higgins, ed., *Nucleic Acid Hybridisation, A Practical Approach*. Oxford, IRL Press, 73-111
Anderson et al. (2004) Plant Cell 16: 3460-3479.
Aravind and Landsman (1998) *Nucleic Acids Res.* 26: 4413-4421
Arents and Moudrianakis (1995) *Proc. Natl. Acad. Sci. USA* 92: 11170-11174
Atchley and Fitch (1997) *Proc. Natl. Acad. Sci. USA* 94: 5172-5176
Atchley et al. (1999) *J. Mol. Evol.* 48: 501-516
Ausubel et al. (1997) *Short Protocols in Molecular Biology*, John Wiley & Sons, New York, N.Y., unit 7.7
Bailey et al. (2003) *Plant Cell* 15: 2497-2502
Bairoch et al. (1997) *Nucleic Acids Res.* 25: 217-221
Bänzinger et al. (2000) Breeding for drought and nitrogen stress tolerance in maize. From theory to practice. (Mexico: CIMMYT (The International Maize and Wheat Improvement Center))
Barthelemy et al. (1996) *Biochem. Biophys. Res. Commun.* 224: 870-876
Bates et al. (1973) *Plant Soil* 39: 205-207
Baudino and Cleveland (2001) *Mol. Cell. Biol.* 21: 691-702
Bechtold and Pelletier (1998) *Methods Mol. Biol.* 82: 259-266
Berger and Kimmel (1987) "Guide to Molecular Cloning Techniques", in Methods in Enzymology, vol. 152, Academic Press, Inc., San Diego, Calif.
Berger et al. (1998) *Curr. Biol.* 8: 421-430
Berrocal-Lobo et al. (2002) *Plant J.* 29: 23-32
Berrocal-Lobo and Molina (2004) *Mol. Plant Microbe Interact.* 17: 763-770
Bevan (1984) *Nucleic Acids Res.* 12: 8711-8721
Bezhani et al. (2001) *J. Biol. Chem.* 276: 23785-23789
Bhattacharjee et al. (2001) *Proc. Natl. Acad. Sci. USA* 98: 13790-13795
Bi et al. (1997) *J. Biol. Chem.* 272: 26562-26572
Birnbaum et al. (2003) *Science* 302: 1956-1960
Boter (2004) *Genes Dev.* 18: 1577-1591
Borevitz et al. (2000) *Plant Cell* 12: 2383-2393
Boss and Thomas (2002) *Nature* 416: 847-850
Boyer (1995) *Annu. Rev. Phytopathol.* 33: 251-274.
Brady et al. (2007) *Science* 318: 801-806
Breen and Crouch (1992) *Plant Mol. Biol.* 19:1049-1055
Brown et al. (2003) *Plant Physiol.* 132: 1020-1032
Brownlie et al. (1997) *Structure* 5: 509-520
Bruce et al. (2000) *Plant Cell* 12: 65-79
Bucher and Trifonov (1988) *J. Biomol. Struct. Dyn.* 5: 1231-1236
Bucher (1990) *J. Mol. Biol.* 212: 563-578

Buck and Atchley (2003) *J. Mol. Evol.* 56: 742-750
Burglin (1997) *Nucleic Acids Res.* 25: 4173-4180
Burglin (1998) *Dev. Genes Evol.* 208: 113-116
Byrne (2000) *Nature* 408: 967-971
Caretti et al. (2003) *J. Biol. Chem.* 278: 30435-30440
Cane and Kay (1995) *Plant Cell* 7: 2039-2051
Carroll (2000) *Cell* 101: 577-580
Carson et al. (1997) *Plant J.* 12: 1231-1240
Cassas et al. (1993) *Proc. Natl. Acad. Sci. USA* 90: 11212-11216
Chae et al. (2004) *Oncogene* 23: 4084-4088
Chakravarthy et al. (2003) *Plant Cell* 15: 3033-3050
Chang and Liu (1994) *J. Biol. Chem.* 269: 17893-17898
Chase et al. (1993) *Ann. Missouri Bot. Gard.* 80: 528-580
Chen et al. (2002a) *Plant Cell* 14: 559-574.
Chen and Chen (2002) *Plant Physiol.* 129: 706-716
Cheong et al. (2002) *Plant Physiol.* 129: 661-677
Cheong et al. (2003) *Plant Physiol.* 132: 1961-1972
Chini et al. (2004) *Plant J.* 38: 810-822.
Chinnusamy et al. (2003) *Genes Dev.* 17: 1043-1054
Chinthapalli et al. (2002) in *Reviews in Plant Biochemistry and Biotechnology*, Goyal, A. et al (eds.) pp. 143-159
Christou et al. (1987) *Proc. Natl. Acad. Sci. USA* 84: 3962-3966
Christou (1991) *Bio/Technol.* 9:957-962
Christou et al. (1992) *Plant. J.* 2: 275-281
Ciarapica et al. (2003) *J. Biol. Chem.* 278: 12182-12190
Corona et al. (1996) *Plant J.* 9: 505-512
Costa and Dolan (2003) *Development* 130: 2893-2901
Coupland (1995) *Nature* 377: 482-483
Coustry et al. (1995) *J. Biol. Chem.* 270: 468-475
Coustry et al. (1996) *J. Biol. Chem.* 271: 14485-14491
Coustry et al. (1998) *Biochem J.* 331(Pt 1): 291-297
Coustry et al. (2001) *J. Biol. Chem.* 276: 40621-40630.
Crawford et al. (2004) *Plant Physiol.* 135: 244-253
Crozatier et al. (1996) *Curr. Biol.* 6: 707-718
Currie (1997) *J. Biol. Chem.* 272: 30880-30888
Daly et al. (2001) *Plant Physiol.* 127: 1328-1333
Dang et al. (1992) *Proc. Natl. Acad. Sci. USA* 89: 599-602
Dang et al. (1996) *J. Bacteriol.* 178: 1842-1849
Dayhoff et al. (1978) "A model of evolutionary change in proteins," in "Atlas of Protein Sequence and Structure," Vol. 5, Suppl. 3 (ed. M. O. Dayhoff), pp. 345-352. Natl. Biomed. Res. Found., Washington, D.C.
de Pater et al. (1996) *Nucleic Acids Res.* 24: 4624-4631
Dellagi et al. (2000) *Mol. Plant Microbe Interact.* 13: 1092-110
Deshayes et al. (1985) *EMBO J.:* 4: 2731-2737
D'Halluin et al. (1992) *Plant Cell* 4: 1495-1505
Di Cristina et al. (1996) *Plant J.* 10: 393-402
Doebley and Lukens (1998) *Plant Cell* 10: 1075-1082
Donn et al. (1990) in *Abstracts of VIIth International Congress on Plant Cell and Tissue Culture IAPTC*, A2-38: 53
Doolittle, ed. (1996) Methods in Enzymology, vol. 266: "Computer Methods for Macromolecular Sequence Analysis" Academic Press, Inc., San Diego, Calif., USA
Draper et al. (1982) *Plant Cell Physiol.* 23: 451-458
Du and Chen (2000) *Plant J.* 24: 837-847
Duboule (1994), (ed.) *Guidebook to the homeobox genes* Oxford University Press, Oxford
Duckett et al. (1994) *Development* 120: 3247-3255
Eddy (1996) *Curr. Opin. Str. Biol.* 6: 361-365
Edwards et al. (1998) *Plant Physiol.* 117: 1015-1022.
Eimert et al. (1995) *Plant Cell* 7: 1703-1712
Ellenberger et al. (1994) *Genes Dev.* 8: 970-980
Eulgem et al. (1999) *EMBO J.* 18: 4689-4699
Eulgem (2000) *Trends Plant Sci.* 5: 199-206.
Ezcurra et al. (2000) *Plant J.* 24: 57-66
Fairchild et al. (2000) *Genes Dev.* 14: 2377-2391
Fairman et al. (1993) *Proc. Natl. Acad. Sci. USA* 90: 10429-10433
Falvo et al. (1995) *Cell* 83: 1101-1111
Feng and Doolittle (1987) *J. Mol. Evol.* 25: 351-360
Ferre-D'Amare et al. (1994) *EMBO J.* 13: 180-189
Finkelstein et al. (1998) *Plant Cell* 10: 1043-1054
Fischer and Droge-Laser (2004) *Mol. Plant Microbe Interact.* 17: 1162-1171
Fisher and Goding (1992) *EMBO J.* 11: 4103-4109
Fisher and Caudy (1998) *Bioessays* 20: 298-306
Forsburg and Guarente (1988) *Genes Dev.* 3: 1166-117
Forzani et al. (2001) *J. Biol. Chem.* 276: 16731-16738
Fowler et al. (2002) *Plant Cell* 14: 1675-1679
Fowler and Thomashow (2002) *Plant Cell* 14: 1675-1690
Frampton et al. (1991) *Protein Eng.* 4: 891-901
Frank et al. (2000) *Plant Cell* 12: 111-124.
Freeling and Hake (1985) *Genetics* 111: 617-634
Friedrichsen et al. (2002) *Genetics* 162: 1445-1456
Fromm et al. (1990) *Bio/Technol.* 8: 833-839
Fu et al. (2001) *Plant Cell* 13: 1791-1802
Fuji et al. (2000) *Nat. Struct. Biol.* 7: 889-893
Fujimoto et al. (2000) *Plant Cell* 12: 393-404
Fujimoto et al. (2004) *Plant Mol. Biol.* 56: 225-239
Galigniana et al. (1998) *Mol. Endocrinol.* 12:1903-1913
Galway et al. (1994) *Dev. Biol.* 166: 740-754
Gampala et al. (2004). International Conference on *Arabidopsis* Research. Berlin. Abstract # T04-085
Gancedo (1998) *Microbiol. Mol. Biol. Rev.* 62: 334-361.
Gaxiola et al. (2001) *Proc. Natl. Acad. Sci. USA* 98: 11444-11449.
Gelinas et al. (1985) *Prog. Clin. Biol. Res.* 191: 125-139
Gelvin et al. (1990) *Plant Molecular Biology Manual*, Kluwer Academic Publishers
Gilmour et al. (1998) *Plant J.* 16: 433-442
Giraudat et al. (1992) *Plant Cell* 4: 1251-1261
Glick and Thompson, eds. (1993) *Methods in Plant Molecular Biology and Biotechnology.* CRC Press., Boca Raton, Fla.
Goff et al. (1992) *Genes Dev.* 6: 864-875
Good and Chen (1996) *Biol Signals* 5: 163-169
Goodrich et al. (1993) *Cell* 75: 519-530
Gordon-Kamm et al. (1990) *Plant Cell* 2: 603-618
Graf (1992) *Curr. Opin. Genet. Dev.* 2: 249-255.
Grandori et al. (2000) *Ann. Rev. Cell. Dev. Biol.* 16: 653-699
Grant et al. (2003) *Mol. Plant Microbe Interact.* 16: 669-680.
Grasser (1995) *Plant J.* 7: 185-192
Grasser (2003) *Plant Mol. Biol.* 53: 281-295
Gruber et al. ((1993) in *Methods in Plant Molecular Biology and Biotechnology*, p. 89-119
Gu et al. (2000) *Plant Cell* 12: 771-786
Gu et al. (2002) *Plant Cell* 14: 817-831
Guiltinan et al. (1990) *Science* 250: 267-271
Guo et al. (2004) *Plant Mol. Biol.* 55: 607-618.
Gupta et al (1997a) *Plant Mol. Biol.* 35: 987-992
Gupta et al. (1997b) *Plant Mol. Biol.* 34: 529-536
Gusmaroli et al. (2001) *Gene* 264: 173-185
Gusmaroli et al. (2002) *Gene* 283: 41-48
Haake et al. (2002) *Plant Physiol.* 130: 639-648
Hain et al. (1985) *Mol. Gen. Genet.* 199: 161-168
Hall et al. (2000) *Plant Physiol.* 123: 1449-1458.
Halliday et al. (1999) *Proc. Natl. Acad. Sci. USA* 96: 5832-5837

Haymes et al. "Nucleic Acid Hybridization: A Practical Approach", IRL Press, Washington, D.C. (1985)
Hanes and Brent (1989) Cell 57: 1275-1283
Hanes and Brent (1991) Science 251: 426-430
Hao et al. (1998) J. Biol. Chem. 273: 26857-26861
Hao (2002) Biochemistry 41: 4202-4208
Harper (2002) WO0216655
Hasegawa et al. (2000) Annu. Rev. Plant Mol. Plant Physiol. 51: 463-499.
Hatch (1987) Biochim. Biophys. Acta 895: 81-106
Hattori et al. (1992) Genes Dev. 6: 609-618
Hayashi and Scott (1990) Cell 63: 883-894
He et al. (2000) Transgenic Res. 9: 223-227
He et al. (2001) Mol. Plant Microbe Interact. 14: 1453-1457
Heim et al. (2003) Mol. Biol. Evol. 20: 735-747
Hein (1990) Methods Enzymol. 183: 626-645
Heisler et al. (2001) Development 128: 1089-1098
Hempel (1997) Development 124: 3845-3853
Henikoff and Henikoff (1991) Nucleic Acids Res. 19: 6565-6572
Henikoff and Henikoff (1992) Proc. Natl. Acad. Sci. USA 89:10915)
Herrera-Estrella et al. (1983) Nature 303: 209
Hiei et al. (1994) Plant J. 6:271-282
Hiei et al. (1997) Plant Mol. Biol. 35:205-218
Higgins and Sharp (1988) Gene 73: 237-244
Higgins et al. (1996) Methods Enzymol. 266: 383-402
Hirano et al. (2002) Gene 290: 107-114
Hobo et al. (1999) Proc. Natl. Acad. Sci. USA 96: 15348-15353
Hoecker et al. (1995) Genes Dev. 9: 2459-2469
Hsieh et al. (1998) Proc. Natl. Acad. Sci. USA 95: 13965-13970
Hu et al. (2004) Cell Res. 14: 8-15
Hung et al. (1998) Plant Physiol. 117: 73-84
Huq and Quail (2002) EMBO J. 21: 2441-2450
Huth et al. (1997) Nat. Struct. Biol. 4: 657-665
Hwang and Goodman (1995) Plant J. 8: 37-43
Ishida (1990) Nature Biotechnol. 14:745-750
Ishiguro and Nakamura (1994) Mol. Gen. Genet. 244: 563-571
Ito et al. (1995) Plant Cell Physiol. 36: 1281-1289
Jaglo et al. (2001) Plant Physiol. 127: 910-917
Jaglo-Ottosen et al. (1998) Science. 280:104-106
Jakoby et al. (2002) Trends Plant Sci. 7: 106-111
Jaglo et al. (2001) Plant Physiol. 127: 910-917
Jang et al. (1997) Plant Cell 9: 5-19
Jofuku et al. (1994) Plant Cell 6: 1211-1225
Johnson and McKnight (1989) Ann. Rev. Biochem. 58: 799-839
Johnson et al. (2002) Plant Cell 14: 1359-1375
Kagaya et al. (1999) Nucleic Acids Res. 27: 470-478
Kaiser et al. (1998) Science 281: 1202-1206
Kashima et al. (1985) Nature 313: 402-404
Kasuga et al. (1999) Nature Biotechnol. 17: 287-291
Kehoe et al. (1994) Plant Cell 6: 1123-1134
Keith et al. (1994) Plant Cell 6: 589-600
Kerstetter et al. (1994) Plant Cell 6: 1877-1887
Kerstetter et al. (1997) Development 124: 3045-3054
Kim and Sheffrey (1990) J. Biol. Chem. 265: 13362-13369
Kim et al. (1996) Mol. Cell. Biol. 16: 4003-4013
Kim et al. (2001) Plant J. 25: 247-259
Kim (2004) Plant Mol. Biol. 55: 883-904
Kimmel (1987) Methods Enzymol. 152: 507-511
Kirik et al. (2004a) Dev. Biol. 268: 506-513
Kirik et al. (2004b) Plant Mol. Biol. 55: 389-398
Kissinger et al. (1990) Cell 63: 579-590
Klee (1985) Bio/Technology 3: 637-642
Klein et al. (1987) Nature 327: 70-73
Knight (2000a) Int. Rev. Cytol. 195: 269-324.
Koornneef et al (1986) In Tomato Biotechnology: Alan R. Liss, Inc., 169-178
Ku et al. (2000) Proc. Natl. Acad. Sci. USA 97: 9121-9126
Kunst et al. (2000) Biochem Soc. Trans. 28: 651-654.
Kusnetsov et al. (1999) J. Biol. Chem. 274: 36009-36014
Kwak et al. (2005) Science 307: 1111-1113
Kwong (2003) Plant Cell 15: 5-18
Kyozuka and Shimamoto (2002) Plant Cell Physiol. 43: 130-135
Lapik and Kaufman (2003) Plant Cell 15: 1578-1590
Larkin et al. (2003) Ann. Rev. Plant Biol. 54: 403-430
Lebel et al. (1998) Plant J. 16: 223-233
Ledent and Vervoort (2001) Genome Res. 11: 754-770
Lee and Schiefelbein (1999) Cell 99: 473-483
Lee et al. (2002) Genome Res. 12: 493-502
Lee and Schiefelbein (2002) Plant Cell 14: 611-618
Lee et al. (2003) Proc. Natl. Acad. Sci. USA 100: 2152-2156.
Lee et al. (2004) Plant Mol. Biol. 55: 61-81.
Lefstin and Yamamoto (1998) Nature 392: 885-888
Leon-Kloosterziel et al. (1996) Plant Physiol. 110: 233-240
Levens (2003) Genes Dev. 17: 1071-1077
Li et al. (1992) Nucleic Acids Res. 20: 1087-1091
Li et al. (1998) EMBO J. 17: 6300-6315
Lin et al. (1991) Nature 353: 569-571
Lincoln et al. (1990) Plant Cell 2: 1071-1080
Liscum and Reed (2002) Plant Mol. Biol. 49: 387-400
Littlewood and Evan (1998) Helix-Loop-Helix Transcription Factors (New York: Oxford University Press)
Liu and Zhu (1997) Proc. Natl. Acad. Sci. USA 94: 14960-14964
Liu et al. (1999) Eur. J. Biochem. 262: 247-257
Livingston et al. (2004) Economic and policy implications of wind-borne entry of Asian soybean rust into the United States. www.ers.usda.gov/Features/SoyBeanRust/Long
Long et al. (1996) Nature 379: 66-69
Long and Barton (2000) Dev. Biol. 218: 341-353
Lorenzo et al. (2003) Plant Cell 15: 165-178
Lorenzo et al. (2004) Plant Cell 16: 1938-1950
Lotan et al. (1998) Cell 93: 1195-1205.
Loulergue et al. (1998) Gene 225: 47-57
Ludwig et al. (1989) Proc. Natl. Acad. Sci. USA 86: 7092-7096
Ludwig et al. (1990) Cell 62: 849-851
Luerssen et al. (1998) Plant J. 15: 755-764
Luger et al. (1997) Nature 389: 251-260
Lynch et al. (2002) Phytopathol. 92: S33.
Ma et al. (1994) Cell 77: 451-459
Mackay and Crossley (1998) Trends Biochem. Sci. 23: 1-4
Maity and de Crombrugghe (1998) Trends Biochem. Sci. 23: 174-178
Maleck (2000) Nat. Genet. 26: 403-410
Mandel (1992) Nature 360: 273-277
Mandel et al. (1992) Cell 71-133-143
Mantovani (1998) Nucleic Acids Res. 26: 1135-1143
Mantovani (1999) Gene 239: 15-27.
Mare et al. (2004) Plant Mol. Biol. 55: 399-416
Martin and Paz-Ares (1997) Trends Genet. 13: 67-73
Martinez-Garcia and Quail (1999) Plant J. 18: 173-183
Martinez-Garcia et al. (2000) Science 288: 859-863
Masiero et al. (2002) J. Biol. Chem. 277: 26429-26435
Massari and Murre (2000) Mol. Cell. Biol. 20: 429-440
Masucci J. et al. (1996) Development 122: 1253-1260
Mazon et al. (1982) Eur. J. Biochem. 127: 605-608
McCarty et al. (1989) Plant Cell 1: 523-532

McCarty et al. (1991) *Cell* 66: 895-905
McCue and Hanson (1990) *Trends Biotechnol.* 8: 358-362
McNabb et al. (1995) *Genes Dev.* 9: 47-58
McNabb et al. (1997) *Mol. Cell. Biol.* 17: 7008-7018
Meijer et al. (1996) *Plant Mol. Biol.* 31: 607-618
Meinke (1992) *Science* 258: 1647-1650
Meinke et al. (1994) *Plant Cell* 6: 1049-1064
Merlot et al. (2001) *Plant J.* 25: 295-303.
Mewes et al. (2002) *Nucleic Acids Res.* 30: 31-34
Meyers (1995) *Molecular Biology and Biotechnology*, Wiley VCH, New York, N.Y., p 856-853
Mild et al. (1993) in *Methods in Plant Molecular Biology and Biotechnology*, p. 67-88, Glick and Thompson, eds., CRC Press, Inc., Boca Raton
Miles et al. (2003) Soybean rust: is the U.S. soybean crop at risk? www.apsnet.org/online/feature/rust/Miyoshi et al. (2003) *Plant J.* 36: 532-540
Mizukami (2001) *Curr Opinion Plant Biol.* 4: 533-539
Mohr and Cahill (2003) *Functional Plant Biology* 30: 461-469
Montgomery et al. (1993) *Plant Cell* 5: 1049-1062
Mount (2001), in Bioinformatics: Sequence and Genome Analysis, Cold Spring Harbor Laboratory Press, Cold Spring Harbor, N.Y., page 543
Müller et al. (2001) *Plant J.* 28: 169-179
Munkvold (2003) *Annu. Rev. Phytopathol.* 41: 99-116.
Murre et al. (1989) *Cell* 56: 777-783
Myers et al. (1986) *Science* 232: 613-618
Nair and Burley (2000) *Nature* 404: 715: 717-718
Nakshatri (1996) *J. Biol. Chem.* 271: 28784-28791.
Nambara et al. (1995) *Development* 121: 629-636
Nandi et al. (2000) *Curr. Biol.* 10: 215-218
Nesi et al. (2000) *Plant Cell* 12: 1863-1878
Ni et al. (1998) *Cell* 95: 657-667
Nicholass et al. (1995) *Plant Mol. Biol.* 28: 423-435
Nieto-Sotelo and Quail (1994) *Biochem. Soc. Symp.* 60: 265-275
Nieto-Sotelo, Ichida and Quail (1994) *Plant Cell* 6: 287-301
North Dakota State University Extension Service. (2002). Managing Row Crop Diseases in Drought Years. www.ag.ndsu.nodak.edu/drought/ds-10-97.htm
North Dakota State University Extension Service. (2004). Small Grain Diseases: Management of Those More Common and Severe in Dry Years. www.ag.ndsu.nodak.edu/drought/ds-01-02.htm
Novillo et al. (2004) *Proc. Natl. Acad. Sci. USA* 101: 3985-3990
Odell (1985) *Nature* 313: 810-812
Ohme-Takagi and Shinshi (1995) *Plant Cell* 7: 173-182
Ohta et al. (2001) *Plant Cell* 13: 1959-1968
Okamuro et al. (1997) *Proc. Natl. Acad. Sci. USA* 94: 7076-7081
Olesen and Guarente (1990) *Genes Dev.* 4: 1714-1729
Onate et al. (1994) *Mol. Cell. Biol.* 14: 3376-3391
Onate-Sanchez and Singh (2002) *Plant Physiol.* 128: 1313-1322
Ooms et al. (1993) *Plant Physiol.* 102: 1185-1191
Parcy and Giraudat (1997) *Plant J.* 11: 693-702
Parcy et al. (1997) *Plant Cell* 9: 1265-1277
Park (2001) *Plant Cell* 13: 1035-1046.
Payne et al. (2000) *Genetics* 156: 1349-1362
Peng et al. (1997) *Genes Development* 11: 3194-3205)
Peng et al. (1999) *Nature:* 400: 256-261
Pinkham and Guarente (1985) *Mol. Cell Biol.* 5: 3410-3416.
Pnueli et al. (2002) *Plant J.* 31: 319-330
Porra et al. (1989) *Biochim. Biophys. Acta* 975: 384-394
Pourtau et al. (2004) *Planta* 219: 765-772
Putterill et al (1995) *Cell* 80: 847-857
Rajani and Sundaresan (2001) *Curr. Biol.* 11: 1914-1922
Ratcliffe et al. (2001) *Plant Physiol.* 126: 122-132
Reeves and Nissen (1990) *J. Biol. Chem.* 265: 8573-8582
Reeves (2001) *Gene* 277: 63-81.
Reeves and Beckerbauer (2001) *Biochim Biophys Acta* 1519: 13-29.
Reidt et al. (2000) *Plant J.* 21: 401-408
Remm et al. (2001) *J. Mol. Biol.* 314: 1041-1052
Reuber (1998) *Plant J.* 16: 473-485.
Riechmann and Meyerowitz (1998) *Biol. Chem.* 379: 633-646
Riechmann et al. (2000a) *Science* 290: 2105-2110
Riechmann and Ratcliffe (2000b) *Curr. Opin. Plant Biol.* 3: 423-434
Rieger et al. (1976) *Glossary of Genetics and Cytogenetics: Classical and Molecular*, 4th ed., Springer Verlag, Berlin
Rieping and Schoffl (1992) *Mol. Gen. Genet.* 231: 226-232
Rigaut et al. (1999) *Nat. Biotechnol.* 17: 1030-1032
Robatzek and Somssich (2002) *Genes Dev.* 16: 1139-1149
Robinson et al. (2000) *Nucleic Acids Res.* 28: 4460-4466
Robson et al. (2001) *Plant J.* 28: 619-631
Rohila et al. (2004) *Plant J.* 38: 172-181
Romier et al. (2003) *J. Biol. Chem.* 278: 1336-1345
Rushton et al. (1995) *Plant Mol. Biol.* 29: 691-702
Rushton et al. (1996) *EMBO J.* 15: 5690-5700
Sadowski et al. (1988) *Nature* 335: 563-564
Saijo et al. (2000) *Plant J.* 23: 319-327.
Sakuma et al. (2002) *Biochem. Biophys. Res. Comm.* 290: 998-1009
Saleki et al. (1993) *Plant Physiol.* 101: 839-845
Salsi et al. (2003) *J. Biol. Chem.* 278: 6642-6650
Sambrook et al. (1989) *Molecular Cloning: A Laboratory Manual*, 2nd Ed., Cold Spring Harbor Laboratory, Cold Spring Harbor, N.Y.
Sanchez and Cejudo (2003) *Plant Physiol.* 132: 949-957
Sanders et al. (1999) *Plant Cell* 11: 691-706
Sanford et al. (1987) *Part. Sci. Technol.* 5:27-37
Sanford (1993) *Methods Enzymol.* 217: 483-509
Schaffer et al. (1998) *Cell* 93: 1219-1229
Schellmann et al. (2002) *EMBO J.* 21: 5036-5046
Schindler et al. (1993) *Plant J.* 4: 137-150
Schnittger et al. (1998) *Development* 125: 2283-2289
Schnittger et al. (1999) *Plant Cell* 11: 1105-1116
Schoof et al. (2000) *Cell* 100: 635-644
Sessa et al. (1994) *Molecular genetic analysis of plant development and metabolism.* (Berlin: Springer Verlag).
Sharp and LeNoble (2002) *J. Exp. Bot.* 53: 33-37.
Sheen (1999) *Ann. Rev. Plant Physiol. Plant Mol. Biol.* 50: 187-217
Shimizu et al. (1997) *EMBO J.* 16: 4689-4697
Shin et al. (2002) *Mol Plant Microbe Interact* 15: 983-989.
Shirakata et al. (1993) *Genes Dev.* 7: 2456-2470
Shpaer (1997) *Methods Mol. Biol.* 70: 173-187
Silver et al. (2003) *Mol. Cell. Biol.* 23: 5989-5999
Sinha et al. (1996) *Mol. Cell. Biol.* 16: 328-337
Sivamani et al. (2000) *Plant Science* 155: 1-9
Sjodahl et al. (1995) *Planta* 197: 264-271
Smalle et al (1998) *Proc. Natl. Acad. Sci. USA.* 95:3318-3322
Smeekens (1998) *Curr. Opin. Plant Biol.* 1: 230-234
Smith et al. (1992) *Protein Engineering* 5: 35-51
Smolen et al. (2002) *Genetics* 161: 1235-1246
Soltis et al. (1997) *Ann. Missouri Bot. Gard.* 84: 1-49
Solano et al. (1998) *Genes Dev.* 12: 3703-3714
Sonnhammer et al. (1997) *Proteins* 28: 405-420
Sorensen et al. (2003) *Plant J.* 33: 413-423

Spencer et al. (1994) *Plant Mol. Biol.* 24: 51-61
Spollen et al. (2000) *Plant Physiol.* 122: 967-976.
Stockinger et al. (1997) *Proc. Natl. Acad. Sci. USA* 94: 1035-1040
Stone et al. (2001) *Proc. Natl. Acad. Sci. USA* 98: 11806-11811
Surpin et al. (2002) *Plant Cell* 14 Suppl: S327-S338
Suzuki et al. (1997) *Plant Cell* 9: 799-807
Suzuki et al. (2001) *Plant J.* 28: 409-418
Suzuki et al. (2003) *Plant Physiol.* 132: 1664-1677
Svensson et al. (2003) *Arch. Biochem. Biophys.* 414: 180-188
Tahtiharju and Palva (2001) Plant J 26: 461-470.
Tamminen et al. (2001) *Plant J.* 25: 1-8
Tanimoto et al. (1995) *Plant J.* 8: 943-948
Tasanen et al. (1992) *J. Biol. Chem.* 267: 11513-11519
Taylor and Scheuring (1994) *Mol. Gen. Genet.* 243: 148-157
Tepperman et al. (2001) *Proc. Natl. Acad. Sci. USA* 98: 9437-9442
Thaler and Bostock (2003) *Ecology* 85: 48-58.
Thoma (1994) *Plant Physiol.* 105: 35-45
Thompson et al. (1994) *Nucleic Acids Res.* 22: 4673-4680
Tiwari et al. (2001) *Plant Cell* 13: 2809-2822
Tiwari et al. (2003) *Plant Cell* 15: 533-543
Toledo-Ortiz et al. (2003) *Plant Cell* 15: 1749-1770
Tournier et al. (2003) *FEBS Lett.* 550: 149-154
Toyama et al. (1999) *Plant Cell Physiol.* 40: 1087-1092
Truernit and Sauer (1995) *Planta* 196: 564-570
Tudge (2000) in *The Variety of Life*, Oxford University Press, New York, N.Y. pp. 547-606
Ulmasov et al. (1997) *Science* 276: 1865-1868
Vasil et al. (1992) *Bio/Technol.* 10:667-674
Vasil et al. (1993) *Bio/Technol.* 11:1553-1558
Vasil (1994) *Plant Mol. Biol.* 25: 925-937
Verslues and Sharp (1999) *Plant Physiol.* 119: 1349-1360
Vicient et al. (2000) *J. Exp. Bot.* 51: 995-1003
Vollbrecht et al. (1991) *Nature* 350: 241-243
Wada et al. (1997) *Science* 277: 1113-1116
Wada et. al. (2002) *Development* 129: 5409-5419
Wahl and Berger (1987) *Methods Enzymol.* 152: 399-407
Wan and Lemeaux (1994) *Plant Physiol.* 104: 37-48
Wang et al. (1997) *Plant Cell* 9: 491-507
Wang (1998) *Plant J.* 16: 515-522
Wanner and Gruissem (1991) *Plant Cell* 3: 1289-1303
Waterhouse et al. (2001) *Trends Plant Sci.* 6: 297-301
Waterston et al. (2002) *Nature* 420: 520-562
Weeks et al. (1993) *Plant Physiol.* 102:1077-1084
Weigel et al. (1992) *Cell* 69: 843-859
Weigel (1995) *Plant Cell* 7: 388-389
Weigel et al. (2000) *Plant Physiol.* 122: 1003-1013
Weigel and Nilsson (1995) *Nature* 377: 482-500
Weissbach and Weissbach (1989) *Methods for Plant Molecular Biology*, Academic Press
Wendler et al. (1997) *J. Biol. Chem.* 272: 8482-8489
Wesley et al. (2001) *Plant J.* 27: 581-590
West et al. (1994) *Plant Cell* 6: 1731-1745
Westhoff and Gowik (2004) *Ann. Bot.* (London) 93: 13-23
Windhovel (2001) *Plant Mol. Biol.* 45: 201-214.
Wobus and Weber (1999) *Curr. Opin. Plant Biol.* 2: 33-38
Wolberger et al. (1991) *Cell* 67: 517-528
Wrather and Sweets (2004) Aflatoxin in Corn. website: aes.missouri.edu/delta/croppest/aflacorn.stm
Wu et al. (1996) *Plant Cell* 8: 617-627
Xin and Browse (1998) *Proc. Natl. Acad. Sci. USA* 95: 7799-7804
Xing et al. (1993) *EMBO J.* 12: 4647-4655
Xiong et al. (2001a) *Genes Dev.* 15: 1971-1984.
Xiong and Zhu (2002) *Plant Cell Environ.* 25: 131-139.
Xiong and Yang (2003) *Plant Cell* 15: 745-759.
Xu et al. (1996) *Plant Physiol.* 110: 249-257
Xu et al. (2001) *Proc. Natl. Acad. Sci USA* 98: 15089-15094
Yamada et al. (1999a) *FEBS Lett.* 460: 41-45
Yamada et al. (1999b) *Biochem. Biophys. Res. Commun.* 261: 614-621
Yamada et al. (2003) *Biochem J.* 373: 167-178
Yamaguchi-Shinozaki and Shinozaki (1993) *Mol. Gen. Genet.* 236: 331-340
Yamasaki et al. (2005) *Plant Cell* 17: 944-956
Yang et al. (1999) *Plant J.* 18: 141-149
Yi et al. (2004) *Plant Physiol.* 136: 2862-2874
Yu et al. (2001) *Plant Cell* 13: 1527-1540
Yun et al. (2003) *J. Biol. Chem.* 278: 36966-36972
Zhang et al. (1991) *Bio/Technology* 9: 996-997
Zhang et al. (2002) *Planta* 215: 191-194
Zhang et al. (2003) *Development* 130: 4859-4869
Zhang and Wang (2005) *BMC Evol. Biol.* 5: 1
Zhou et al. (1995a) *Nature* 376: 771-774
Zhou et al. (1995b) *Cell* 83: 925-935
Zhou et al. (1997) *EMBO J.* 16: 3207-3218
Zhou and Lee (1998) *J. Natl. Cancer Inst.* 90: 381-388
Zhu et al. (1998) *Plant Cell* 10: 1181-1191
Zou et al. (2004) *J. Biol. Chem.* 279: 55770-5577

All publications and patent applications mentioned in this specification are herein incorporated by reference to the same extent as if each individual publication or patent application was specifically and individually indicated to be incorporated by reference.

The present invention is not limited by the specific embodiments described herein. The invention now being fully described, it will be apparent to one of ordinary skill in the art that many changes and modifications can be made thereto without departing from the spirit or scope of the appended claims. Modifications that become apparent from the foregoing description and accompanying figures fall within the scope of the claims.

SEQUENCE LISTING (18065 sequences)

SEQ ID NO: 1 - DNA, 964 bp, Arabidopsis thaliana
  G28,family:AP2
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaaaaaaaaaaaaaaaaa

SEQ ID NO: 2 - protein, 268 aa, Arabidopsis thaliana
  G28,AP2 domain coordinates 145-208
MSMTADSQSDYAFLESIRRHLLGESEPILSESTASSVTQSCVTGQSIKPVYGRNPSFSKLYPCFTESWGDLPLKENDSEDMLVYGILNDAFHGGWEPSSSSSDEDRSSFPSVKIETPESFAAVDSVPVKKEKTSPVSAAVTAAKGKHYRGVRQRPWGKFAAEIRDPAKNGARVWLGTFETAEDAALAYDRAAFRMRGSRALLNFPLRVNSGEPDPVRIKSKRSSFSSSNENGAPKKRRTVAAGGGMDKGLTVKCEVVEVARGDRLLVL

SEQ ID NO: 3 - DNA, 959 bp, Oryza sativa
  G3430,family:AP2
ccaaattcacgggataattcaaagatgctgcttaatccggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggcgaggccgtggcggtggcgtcgagggggaagcactaccgcggggtgaggcagcggccgtggggcaagttcgcggcggagatcagggacccggccaagaacggcgcgcgcgtgtggctcggcacgttcgactccgccgaggaggccgccgtggcgtacgaccgcgccgcctaccgcatgcgcggctcccgcgcgctcctcaacttcccgctccgcatcggctccgagatcgccgccgcggccgccgccgccgccgcgggcaacaagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgccaccaccggcgcaggcaccggtgcagctcgccctcccggcccagccatggttcgccgccggtccgatccagcagctggtgagctaagtggcgatgtggtagtggtagtg

SEQ ID NO: 4 - protein, 303 aa, Oryza sativa
  G3430,AP2 domain coordinates 145-209
MLLNPASREVAALDSIRHHLLEEEEETPATAPAPTRRPVYCRSSSFGSLVADQWSESLPFRPNDAEDMVVYGALRDAFSSGWLPDGSFAAVKPESQDSYDGSSIGSFLASSSSEAGTPGEVTSTEATVTPGIREGEGEAVAVASRGKHYRGVRQRPWGKFAAEIRDPAKNGARVWLGTFDSAEEAAVAYDRAAYRMRGSRALLNFPLRIGSEIAAAAAAAAAGNKRPYPDPASSGSSSPSSSSSSSSSSSSGSPKRRKRGEAAAASMAMALVPPPPPPAQAPVQLALPAQPWFAAGPIQQLVS

SEQ ID NO: 5 - DNA, 785 bp, Arabidopsis thaliana
  G47,family:AP2
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttcttttgagtaagattttgtaccataatcaaaacaggtgtggtgctaaaatcttactcaaaacaagattaggtaccacagagaaacaatcaaatggttgtgaatatacattataaggttttgattaatgtttgtttcactgatttagtgaagtttggtccattgtatacaaatctattcaagaaacctagcgcgagatcatgtttcgtgattgaagattgagatttttaagtattcgtaatatttttgtaaaatacaaataaaaaaaaaaaaaaaaaaaaa

SEQ ID NO: 6 - protein, 144 aa, Arabidopsis thaliana
  G47,AP2 domain coordinates 10-75
MDYRESTGESQSKYKGIRRRKWGKWVSEIRVPGTRDRLWLGSFSTAEGAAVAHDVAFFCLHQPDSLESLNFPHLLNPSLVSRTSPRSIQQAASNAGMAIDAGIVHSTSVNSGCGDTTTYYENGADQVEPLNISVYDYLGGHDHV

SEQ ID NO: 7 - DNA, 485 bp, Arabidopsis thaliana
  G2133,family:AP2
atctcatcttcatccacccaaaaacatggattcaagagacaccggagaaactgaccagagcaagtacaaaggtatccgtcgtcggaaatggggaaaatgggtatcagagattcgtgtcccgggaactcgtcaacgtctctggttaggctctttctccaccgcagaaggcgctgccgtagcccacgacgtcgctttttactgcttgcaccgaccatcttccctcgacgacgaatcttttaacttccctcacttacttacaacctccctcgcctccaatatatctcctaagtccatccaaaaagctgcttccgacgccggcatggccgtggacgccggattccatggtgctgtgtctgggagtggtggttgtgaagagagatcttccatggcgaatatggaggaggaggacaaacttagtatctccgtgtatgattatcttgaagacgatctcgtttgatctatacgagtacgtttttagcagttaa

SEQ ID NO: 8 - protein, 143 aa, Arabidopsis thaliana
  G2133,AP2 domain coordinates 10-77
MDSRDTGETDQSKYKGIRRRKWGKWVSEIRVPGTRQRLWLGSFSTAEGAAVAHDVAFYCLHRPSSLDDESFNFPHLLTTSLASNISPKSIQKAASDAGMAVDAGFHGAVSGSGGCEERSSMANMEEEDKLSISVYDYLEDDLV

SEQ ID NO: 9 - DNA, 832 bp, Arabidopsis thaliana
  G481,family:CAAT
gagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 10 - protein, 141 aa, Arabidopsis thaliana
  G481,CAAT domain coordinates 20-109
MADTPSSPAGDGGESGGSVREQDRYLPIANISRIMKKALPPNGKIGKDAKDTVQECVSEFISFITSEASDKCQKEKRKTVNGDDLLWAMATLGFEDYLEPLKIYLARYRELEGDNKGSGKSGDGSNRDAGGGVSGEEMPSW

SEQ ID NO: 11 - DNA, 1065 bp, Arabidopsis thaliana
  G482,family:CAAT
tcgacccacgcgtccggacacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaaaaaaaaaaaaaaaa

SEQ ID NO: 12 - protein, 190 aa, Arabidopsis thaliana
  G482,CAAT domain coordinates 26-115
MGDSDRDSGGGQNGNNQNGQSSLSPREQDRFLPIANVSRIMKKALPANAKISKDAKETMQECVSEFISFVTGEASDKCQKEKRKTINGDDLLWAMTTLGFEDYVEPLKVYLQRFREIEGERTGLGRPQTGGEVGEHQRDAVGDGGGFYGGGGGMQYHQHHQFLHQQNHMYGATGGGSDSGGGAASGRTRT

SEQ ID NO: 13 - DNA, 321 bp, Oryza sativa
  G3392,family:MYB-related
gctctaaactaccataaaatcttaactcggcattttttttttcacgctaatggaaagtagcggtggaagccagctgggaaagaattccaaaacaagtgatggtcgtgaaacaaaagaagttaatagcactgcgcaaaattttgttcatttcacagaagaagaggaagatattgttttcagaatgcacaggcttgtcgggaacaggtgggaacttatagctggaagaataccgggaaggacagcagaagaagtagagaagttctgggcaattaaacatcaagccacatgatagcagaaagaggatgtttgccccaaaagtag

SEQ ID NO: 14 - protein, 79 aa, Oryza sativa
  G3392,MYB-related domain coordinates 32-76
MESSGGSQLGKNSKTSDGRETKEVNSTAQNFVHFTEEEEDIVFRMHRLVGNRWELIAGRIPGRTAEEVEKFWAIKHQAT

SEQ ID NO: 15 - DNA, 1281 bp, Arabidopsis thaliana
  G867,family:AP2
cacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 16 - protein, 344 aa, Arabidopsis thaliana
  G867,AP2 domain coordinates 59-124,184-276
MESSSVDESTTSTGSICETPAITPAKKSSVGNLYRMGSGSSVVLDSENGVEAESRKLPSSKYKGVVPQPNGRWGAQIYEKHQRVWLGTFNEEDEAARAYDVAVHRFRRRDAVTNFKDVKMDEDEVDFLNSHSKSEIVDMLRKHTYNEELEQSKRRRNGNGNMTRTLLTSGLSNDGVSTTGFRSAEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSRSNGQDQQLYIGWKSRSGSDLDAGRVLRLFGVNISPESSRNDVVGNKRVNDTEMLSLVCSKKQRIFHAS

SEQ ID NO: 17 - DNA, 1327 bp, Arabidopsis thaliana
  G1073,family:AT-hook
tcaccgacccagctctttcacatatgtagacctctctctctctaattattcagtaaggttttgttctctcttgtcgtcttcttgttttgtccgtagcattattaataatcaaactcagtctctgaaatactctcagtgacaaaccacttctgtcgacttttgtctttgtctctcactagctataaccaaaaaaatccaaaaacccaaaccacagtttcttgtttttgttatcaatgtctagttatatgcaccctcttctagggcaagaactgcatctacagagacctgaagattccagaaccccacctgatcaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggttttatttatttattttttgtttctcttaaaacttggtgtgtgaaaaaagaaaacgaacgcttaaatttcctttttctgtttgtttttatgaggcc

SEQ ID NO: 18 - protein, 299 aa, Arabidopsis thaliana
  G1073,At-hook amino acids 63-71,2nd cons. domain 71-216,DUF296 90-209
MSSYMHPLLGQELHLQRPEDSRTPPDQNNMELNRSEADEAKAETTPTGGATSSATASGSSSGRRPRGRPAGSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEEEETPPPRTTGVQQQQPEASQSSEVTGSGAQACESNLQGGNGGGGVAFYNLGMNMNNFQFSGGDIYGMSGGSGGGGGGATRPAF

SEQ ID NO: 19 - DNA, 585 bp, Arabidopsis thaliana
  G1274,family:WRKY
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 20 - protein, 194 aa, Arabidopsis thaliana
  G1274,WRKY domain coordinates 110-166
MNISQNPSPNFTYFSDENFINPFMDNNDFSNLMFFDIDEGGNNGLIEEEISSPTSIVSSETFTGESGGSGSATTLSKKESTNRGSKESDQTKETGHRVAFRTRSKIDVMDDGFKWRKYGKKSVKNNINKRNYYKCSSEGCSVKKRVERDGDDAAYVITTYEGVHNHESLSNVYYNEMVLSYDHDNWNQHSLLRS

SEQ ID NO: 21 - DNA, 1038 bp, Arabidopsis thaliana
  G1760,family:MADS
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatccaaaaaaaaaaaaaaaaaaaaaaaaaa

SEQ ID NO: 22 - protein, 228 aa, Arabidopsis thaliana
  G1760,MADS domain coordinates 2-57
MGRGKIVIQRIDDSTSRQVTFSKRRKGLIKKAKELAILCDAEVGLIIFSSTGKLYDFASSSMKSVIDRYNKSKIEQQQLLNPASEVKFWQREAAVLRQELHALQENHRQMMGEQLNGLSVNELNSLENQIEISLRGIRMRKEQLLTQEIQELSQKRNLIHQENLDLSRKVQRIHQENVELYKKAYMANTNGFTHREVAVADDESHTQIRLQLSQPEHSDYDTPPRANE

SEQ ID NO: 23 - DNA, 696 bp, Arabidopsis thaliana
  G1792,family:AP2
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtacaaaaaaaaaaaaaaaaaaaaaaa

SEQ ID NO: 24 - protein, 139 aa, Arabidopsis thaliana
  G1792,AP2 domain coordinates 16-80
MESSNRSSNNQSQDDKQARFRGVRRRPWGKFAAEIRDPSRNGARLWLGTFETAEEAARAYDRAAFNLRGHLAILNFPNEYYPRMDDYSLRPPYASSSSSSSSGSTSTNVSRQNQREVFEFEYLDDKVLEELLDSEERKR

SEQ ID NO: 25 - DNA, 450 bp, Arabidopsis thaliana
  G1795,family:AP2
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaa

SEQ ID NO: 26 - protein, 131 aa, Arabidopsis thaliana
  G1795,AP2 domain coordinates 11-75
MDQGGRGVGAEHGKYRGVRRRPWGKYAAEIRDSRKHGERVWLGTFDTAEEAARAYDQAAYSMRGQAAILNFPHEYNMGSGVSSSTAMAGSSSASASASSSSRQVFEFEYLDDSVLEELLEEGEKPNKGKKK

SEQ ID NO: 27 - DNA, 1130 bp, Arabidopsis thaliana
  G1945,family:AT-hook
atttcccaaagggatttacgaaaagtccctctcctctatcatctctttattcaccccataccaacaacctctacatcttcttcttcttcttcctcctcttttattttctttttaaatcatttacacaaaaatccaaagacaaatctgaaatctctaataaacaaatccataaaataagaaaaacaaagatgaaaggtgaatacagagagcaaaagagtaacgaaatgttttccaagcttcctcatcatcaacaacaacagcaacaacaacaacaacaacactctcttacctctcacttccacctctcctccaccgtaacccccaccgtcgatgactcctccatcgaagtggtccgacgtccacgtggcagaccaccaggttccaaaaacaaacctaaaccacccgtcttcgtcacacgtgacaccgaccctcctatgagtccttacatcctcgaagttccttcaggaaacgacgtcgtcgaagccatcaaccgtttctgccgccgtaaatccatcggagtctgcgtccttagtggctctggctctgtagctaacgtcactttacgtcagccatcaccggcagctcttggctctaccataactttccatggaaagtttgatctcctctccgtctccgcaacgtttctccctcctccgcctcgtacttccttgtctcctcccgtttctaacttcttcaccgtctctctcgctggacctcaaggacaaatcatcggagggttcgtcgctggtccacttatttcggcaggaacagtttacgtcatcgccgcaagtttcaacaacccttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaaatctctttctttctttttttgtttttttttgttttgggttaggatgaatcaagaaactagggttttttttttttttttttaaaaaaaaaaaaa

SEQ ID NO: 28 - protein, 276 aa, Arabidopsis thaliana
  G1945,At-hook amino acids 56-64,2nd cons. domain 64-214, DUF296 83-207
MKGEYREQKSNEMFSKLPHHQQQQQQQQQQHSLTSHFHLSSTVTPTVDDSSIEVVRRPRGRPPGSKNKPKPPVFVTRDTDPPMSPYILEVPSGNDVVEAINRFCRRKSIGVCVLSGSGSVANVTLRQPSPAALGSTITFHGKFDLLSVSATFLPPPPRTSLSPPVSNFFTVSLAGPQGQIIGGFVAGPLISAGTVYVIAASFNNPSYHRLPAEEEQKHSAGTGEREGQSPPVSGGGEESGQMAGSGGESCGVSMYSCHMGGSDVIWAPTARAPPPY

SEQ ID NO: 29 - DNA, 906 bp, Arabidopsis thaliana
  G1988,family:Z-CO-like
tgctactctcatcaaccatgaaccataaaaactccaccgctctttctctccctcaatcatttacatctcttccttaaatctctcttcccaccatcatcattccaaaccaattctctctcacttctttctggtgatcagagagatcgactcaatggtgagcttttgcgagctttgtggtgccgaagctgatctccattgtgccgcggactctgccttcctctgccgttcttgtgacgctaagttccatgcctcaaattttctcttcgctcgtcatttccggcgtgtcatctgcccaaattgcaaatctcttactcaaaatttcgtttctggtcctcttcttccttggcctccacgaacaacatgttgttcagaatcgtcgtcttcttcttgctgctcgtctcttgactgtgtctcaagctccgagctatcgtcaacgacgcgtgacgtaaacagagcgcgagggagggaaaacagagtgaatgccaaggccgttgcggttacggtggcggatggcatttttgtaaattggtgtggtaagttaggactaaacagggatttaacaaacgctgtcgtttcatatgcgtctttggctttggctgtggagacgaggccaagagcgacgaagagagtgttcttagcggcggcgttttggttcggcgttaagaacacgacgacgtggcagaatttaaagaaagtagaagatgtgactggagtttcagctgggatgattcgagcggttgaaagcaaattggcgcgtgcaatgacgcagcagcttagacggtggcgcgtggattcggaggaaggatgggctgaaaacgacaacgtttgagaaatattattgacatgggtcccgcattatgcaaattaggacatttagtgtttagtgcattaattatagtttgtgtc

SEQ ID NO: 30 - protein, 225 aa, Arabidopsis thaliana
  G1988,Z-CO-like domain coordinates 5-50
MVSFCELCGAEADLHCAADSAFLCRSCDAKFHASNFLFARHFRRVICPNCKSLTQNFVSGPLLPWPPRTTCCSESSSSSCCSSLDCVSSSELSSTTRDVNRARGRENRVNAKAVAVTVADGIFVNWCGKLGLNRDLTNAVVSYASLALAVETRPRATKRVFLAAAFWFGVKNTTTWQNLKKVEDVTGVSAGMIRAVESKLARAMTQQLRRWRVDSEEGWAENDNV

SEQ ID NO: 31 - DNA, 1680 bp, Arabidopsis thaliana
  G2,family:AP2
ctctctctctctctttagctctttttttttttttgttttcattaaagtttttattttattttctaccaaccaaaagcttttctctttggtttctcttatttagcttctaaccttgaggagaatataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgtatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatctgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 32 - protein, 432 aa, Arabidopsis thaliana
  G2,AP2 domain coordinates 129-195,221-288
MWDLNDAPHQTQREEESEEFCYSSPSKRVGSFSNSSSSAVVIEDGSDDDELNRVRPNNPLVTHQFFPEMDSNGGGVASGFPRAHWFGVKFCQSDLATGSSAGKATNVAAAVVEPAQPLKKSRRGPRSRSSQYRGVTFYRRTGRWESHIWDCGKQVYLGGFDTAHAAARAYDRAAIKFRGVEADINFNIDDYDDDLKQMTNLTKEEFVHVLRRQSTGFPRGSSKYRGVTLHKCGRWEARMGQFLGKKYVYLGLFDTEVEAARAYDKAAIKCNGKDAVTNFDPSIYDEELNAESSGNPTTPQDHNLDLSLGNSANSKHKSQDMRLRMNQQQQDSLHSNEVLGLGQTGMLNHTPNSNHQFPGSSNIGSGGGFSLFPAAENHRFDGRASTNQVLTNAAASSGFSPHHHNQIFNSTSTPHQNWLQTNGFQPPLMRPS

SEQ ID NO: 33 - DNA, 759 bp, Arabidopsis thaliana
  G3,family:AP2
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttgtttgattagaagattacatttacatacaagatacacatagatactggaaaatataggtatgtatacattcataaattatcttatgtatcaaagaattttatagattctgattagctttttgtttttgtttttgataagaactctgattagttgtccggagacaaaaccggctaagagcaatccatgagaagctagcgagtgttttttagttcaagttgtaatataaatgcatattaattctttagtaattttgt

SEQ ID NO: 34 - protein, 153 aa, Arabidopsis thaliana
  G3,AP2 domain coordinates 28-95
MEREQEESTMRKRRQPPQEEVPNHVATRKPYRGIRRRKWGKWVAEIREPNKRSRLWLGSYTTDIAAARAYDVAVFYLRGPSARLNFPDLLLQEEDHLSAATTADMPAALIREKAAEVGARVDALLASAAPSMAHSTPPVIKPDLNQIPESGDI

SEQ ID NO: 35 - DNA, 1577 bp, Arabidopsis thaliana
  G4,family:AP2
aaagaatcgaatatttattatttcgccccgaagattctatttctgatcatttacacccctaaaaagagtagagctttcgtgaagccaccatgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactgtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttgaagtgatcgatggttccttagtttgtaaataaagctgtgttggattttgctgttgggggatggtacaagtcacacctcaagctctatgcattggtatctcatgagccttctcttccatagagagtttctcttttaattttgtcgaaataaaaaaggtgtgatgaagtaaatagaggtataataatatctatctattaagtcttgttttgttctttcatttttgtatttcttttctatttaaaagacagtttattagtcttctgagctctctttttgatctttgttatagcgtatcatcaccctcgaaagtgtaatgttttgtacccccaaacttgtttagcattataataaagtctctttg

SEQ ID NO: 36 - protein, 375 aa, Arabidopsis thaliana
  G4,AP2 domain coordinates 121-183
MCGGAIISDFIPPPRSLRVTNEFIWPDLKNKVKASKKRSNKRSDFFDLDDDFEADFQGFKDDSAFDCEDDDDVFVNVKPFVFTATTKPVASAFVSTVGSAYAKKTVESAEQAEKSSKRKRKNQYRGIRQRPWGKWAAEIRDPRKGSREWLGTFDTAEEAARAYDAAARRIRGTKAKVNFPEEKNPSVVSQKRPSAKTNNLQKSVAKPNKSVTLVQQPTHLSQQYCNNSFDNSFGDMSFMEEKPQMYNNQFGLTNSFDAGGNNGYQYFSSDQGSNSFDCSEFGWSDHGPKTPEISSMLVNNNEASFVEETNAAKKLKPNSDESDDLMAYLDNALWDTPLEVEAMLGADAGAVTQEEENPVELWSLDEINFMLEGDF

SEQ ID NO: 37 - DNA, 1699 bp, Arabidopsis thaliana
  G5,family:AP2
ttttttttttgcaatctccccctaatctgttgtttctcgcttcttcttctgttaatcatctgtctttcaaaaagaaagaaaaaagaaaaattcgatttctgggtttgtttttgtcatacagaaaaaaatcaagcttatgaatttgtgtttaattttttgttttaatttgaaaggcaggttttttcagaacgagatcgttttttcaaatttcttctgattttacctctttttttcttcttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtgaaattgcatgactggcccaagagtaattaattaaatatggattagtgttaaatttcgtatgttaatatttgtattatggtttgtattagtctctctgtgtcggtccagcttgcggttttttgtcaggctcgaccatgccacagttttcattttatgtaatctttttttcttttgtcttatgtaatttgtagcttcagtttcttcatctataatgcaattttattatgattatgtg

SEQ ID NO: 38 - protein, 334 aa, Arabidopsis thaliana
  G5,AP2 domain coordinates 149-216
MAAAMNLYTCSRSFQDSGGELMDALVPFIKSVSDSPSSSSAASASAFLHPSAFSLPPLPGYYPDSTFLTQPFSYGSDLQQTGSLIGLNNLSSSQIHQIQSQIHHPLPPTHHNNNNSFSNLLSPKPLLMKQSGVAGSCFAYGSGVPSKPTKLYRGVRQRHWGKWVAEIRLPRNRTRLWLGTFDTAEEAALAYDKAAYKLRGDFARLNFPNLRHNGFHIGGDFGEYKPLHSSVDAKLEAICKSMAETQKQDKSTKSSKKREKKVSSPDLSEKVKAEENSVSIGGSPPVTEFEESTAGSSPLSDLTFADPEEPPQWNETFSLEKYPSYEIDWDSILA

SEQ ID NO: 39 - DNA, 859 bp, Arabidopsis thaliana
  G7,family:AP2
gtgactctaacgaagaaaccggcaatggccagtatcactacaatgccgaagaaataacaagaatcataaacgagccagaatattatcccccgggttacaacttgtctaccaccgcaatttcaaacatggtgtctatgctgactaatgttgtctctggtgagaccgaaccctcggcatctgcgacatggacgatgggtcataagagagaaagagaagagttttctttgcctcctcaaccattgattaccggttcagctgtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactcaatgcaaccttctctaacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatatcgtcaacgctttgtatttctacttattcgatctaccaattttttctctcccaatacaacttcagtctgattattgccttcttagatatgtcttcgaatgttatgactatacatgggtgtatataaaatttgtgatcaaagtcttgt

SEQ ID NO: 40 - protein, 192 aa, Arabidopsis thaliana
  G7,AP2 domain coordinates 58-125
MVSMLTNVVSGETEPSASATWTMGHKREREEFSLPPQPLITGSAVTKECESSMSLERPKKYRGVRQRPWGKWAAEIRDPHKATRVWLGTFETAEAAARAYDAAALRFRGSKAKLNFPENVGTQTIQRNSHFLQNSMQPSLTYIDQCPTLLSYSRCMEQQQPLVGMLQPTEEENHFFEKPWTEYDQYNYSSFG

SEQ ID NO: 41 - DNA, 1713 bp, Arabidopsis thaliana
  G8,family:AP2
aaaaaaaaatatccgtctcactctctcgccgccggtaacatttcccggcgacaaaacttctctactctcaccattcctccatcgtaatctctaaattcttctccattctcttcttcctcccgatcatctcgagctcttcgtgagagattatgtgattatgtaatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtttttttaccatctctctctctctcaacactctagtcccctttcaaaaatgtcatttgggttttagatttttcacatacaatgatcaatttttcc

SEQ ID NO: 42 - protein, 449 aa, Arabidopsis thaliana
  G8,AP2 domain coordinates 151-217,243-293
MLDLNLNADSPESTQYGGDSYLDRQTSDNSAGNRVEESGTSTSSVINADGDEDSCSTRAFTLSFDILKVGSSSGGDESPAASASVTKEFFPVSGDCGHLRDVEGSSSSRNWIDLSFDRIGDGETKLVTPVPTPAPVPAQVKKSRRGPRSRSSQYRGVTFYRRTGRWESHIWDCGKQVYLGGFDTAHAAARAYDRAAIKFRGVDADINFTLGDYEEDMKQVQNLSKEEFVHILRRQSTGFSRGSSKYRGVTLHKCGRWEARMGQFLGKKAYDKAAINTNGREAVTNFEMSSYQNEINSESNNSEIDLNLGISLSTGNAPKQNGRLFHFPSNTYETQRGVSLRIDNEYMGKPVNTPLPYGSSDHRLYWNGACPSYNNPAEGRATEKRSEAEGMMSNWGWQRPGQTSAVRPQPPGPQPPPLFSVAAASSGFSHFRPQPPNDNATRGYFYPHP

SEQ ID NO: 43 - DNA, 1246 bp, Arabidopsis thaliana
  G9,family:AP2
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgcgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 44 - protein, 352 aa, Arabidopsis thaliana
  G9,AP2 domain coordinates 62-127,184-277
MDSSCIDEISSSTSESFSATTAKKLSPPPAAALRLYRMGSGGSSVVLDPENGLETESRKLPSSKYKGVVPQPNGRWGAQIYEKHQRVWLGTFNEQEEAARSYDIAACRFRGRDAVVNFKNVLEDGDLAFLEAHSKAEIVDMLRKHTYADELEQNNKRQLFLSVDANGKRNGSSTTQNDKVLKTREVLFEKAVTPSDVGKLNRLVIPKQHAEKHFPLPSPSPAVTKGVLINFEDVNGKVWRFRYSYWNSSQSYVLTKGWSRFVKEKNLRAGDVVTFERSTGLERQLYIDWKVRSGPRENPVQVVVRLFGVDIFNVTTVKPNDVVAVCGGKRSRDVDDMFALRCSKKQAIINAL

SEQ ID NO: 45 - DNA, 831 bp, Arabidopsis thaliana
  G12,family:AP2
gtgtcggtgaattttttgaaacttcttctcttttgcggtttcgtgttccactcctctcttcttggcccacgtgttcatcaatctctccctccgcatgtaatcgcttcgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaaacaaaaaaaaaaaaaaaaaaaaa

SEQ ID NO: 46 - protein, 196 aa, Arabidopsis thaliana
  G12,AP2 domain coordinates 27-94
METATEVATVVSTPAVTVAAVATRKRDKPYKGIRMRKWGKWVAEIREPNKRSRIWLGSYSTPEAAARAYDTAVFYLRGPSARLNFPELLAGVTVTGGGGGGVNGGGDMSAAYIRRKAAEVGAQVDALEAAGAGGNRHHHHHQHQRGNHDYVDNHSDYRINDDLMECSSKEGFKRCNGSLERVDLNKLPDPETSDDD

SEQ ID NO: 47 - DNA, 1905 bp, Arabidopsis thaliana
  G15,family:AP2
atagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaagacatagatggactggtagatatgaagctcatctatgggacaatagtttcaagaaggaaggtcacagtagaaaaggaagacaagtttatctgggaggttatgatatggaggagaaagctgctcgagcatatgatcttgctgcactcaagtactggggtccctctactcacaccaatttctctgcggagaattatcagaaagagattgaagacatgaagaacatgactagacaagaatatgttgcacatttgagaaggaagagcagtggtttctctaggggtgcttccatctatagaggagtcacaagacatcaccagcatggaaggtggcaagcacggattggtagagtcgctggaaacaaagatctctaccttggaacttttggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcggtataaatagtatttgcttaggagcggtatatgtttcttttgagtagtattcatgtgaaacagaatgaatctctctataacatattattttaatgg

SEQ ID NO: 48 - protein, 555 aa, Arabidopsis thaliana
  G15,AP2 domain coordinates 281-357,383-451
MKSFCDNDDNNHSNTTNLLGFSLSSNMMKMGGRGGREAIYSSSTSSAATSSSSVPPQLVVGDNTSNFGVCYGSNPNGGIYSHMSVMPLRSDGSLCLMEALNRSSHSNHHQDSSPKVEDFFGTHHNNTSHKEAMDLSLDSLFYNTTHEPNTTTNFQEFFSFPQTRNHEEETRNYGNDPSLTHGGSFNVGVYGEFQQSLSLSMSPGSQSSCITGSHHHQQNQNQNHQSQNHQQISEALVETSVGFETTTMAAAKKKRGQEDVVVVGQKQIVHRKSIDTFGQRTSQYRGVTRHRWTGRYEAHLWDNSFKKEGHSRKGRQVYLGGYDMEEKAARAYDLAALKYWGPSTHTNFSAENYQKEIEDMKNMTRQEYVAHLRRKSSGFSRGASIYRGVTRHHQHGRWQARIGRVAGNKDLYLGTFGTQEEAAEAYDVAAIKFRGTNAVTNFDITRYDVDRIMSSNTLLSGELARRNNNSIVVRNTEDQTALNAVVEGGSNKEVSTPERLLSFPAIFALPQVNQKMFGSNMGGNMSPWTSNPNAELKTVALTLPQMPVFAAWADS

SEQ ID NO: 49 - DNA, 1055 bp, Arabidopsis thaliana
  G19,family:AP2
ataaaggcatttcagctccaccgtaggaaactttctcttgaaagaaacccacagcaacaaacagagaaaatgtgtggcggtgctattatttccgattatgcccctctcgtcaccaaggccaagggccgtaaactcacggctgaggaactctggtcagagctcgatgcttccgccgccgacgacttctggggtttctattccacctccaaactccatcccaccaaccaagttaacgtgaaagaggaggcagtgaagaaggagcaggcaacagagccggggaaacggaggaagaggaagaatgtttatagagggatacgtaagcgtccatggggaaaatgggcggctgagattcgagatccacgaaaaggtgttagagtttggcttggtacgttcaacacggcggaggaagctgccatggcttatgatgttgcggccaagcagatccgtggtgataaagccaagctcaacttcccagatctgcaccatcctcctcctcctaattatactcctccgccgtcatcgccacgatcaaccgatcagcctccggcgaagaaggtctgcgttgtctctcagagtgagagcgagttaagtcagccgagtttcccggtggagtgtataggatttggaaatggggacgagtttcagaacctgagttacggatttgagccggattatgatctgaaacagcagatatcgagcttggaatcgttccttgagctggacggtaacacggcggagcaaccgagtcagcttgatgagtccgtttccgaggtggatatgtggatgcttgatgatgtcattgcgtcgtatgagtaaaagaaaaaaaataagtttaaaaaaagttaaataaagtctgtaatatatatgtaaccgccgttacttttaaaaggtttttaccgtcgcattggactgctgatgatgtctgttgtgtaatgtgtagaatgtgaccaaatggacgttatattacggtttgtggtattattagtttcttagatggaaaaacttacatgtgtaaataagatttgtaatgtaagacgaagtacttataacttctt

SEQ ID NO: 50 - protein, 248 aa, Arabidopsis thaliana
  G19,AP2 domain coordinates 76-143
MCGGAIISDYAPLVTKAKGRKLTAEELWSELDASAADDFWGFYSTSKLHPTNQVNVKEEAVKKEQATEPGKRRKRKNVYRGIRKRPWGKWAAEIRDPRKGVRVWLGTFNTAEEAAMAYDVAAKQIRGDKAKLNFPDLHHPPPPNYTPPPSSPRSTDQPPAKKVCVVSQSESELSQPSFPVECIGFGNGDEFQNLSYGFEPDYDLKQQISSLESFLELDGNTAEQPSQLDESVSEVDMWMLDDVIASYE

SEQ ID NO: 51 - DNA, 1650 bp, Arabidopsis thaliana
  G20,family:AP2
ctctcactctctttttctctctctttacttctactgtatcaagaagctccgttttgcttagccatagtgcgtctagggtttggttggtgggaagaaggttccgatcatggcgtcggtgtcgtcgtcggatcaaggacctaagacagaagcaggatgtagcggcggaggaggaggagagagctcggagacagtggcggcgagtgatcagatgttgttgtatagaggttttaagaaggcgaagaaggagagaggttgtacagctaaggagcgtattagtaaaatgcctccgtgcactgctgggaaaaggagttccatataccggggagtcaccagacatagatggacaggtcgttatgaagctcacctttgggataagagtacctggaaccaaaaccagaacaagaagggaaaacaagtttatctaggagcatatgatgatgaagaggctgctgctagagcttacgaccttgctgccttaaaatattggggtcctgggacacttataaattttccggtgactgattataccagggatttagaagaaatgcaaaatctctcaagggaagaataccttgcatctttacgtagatatccctttggcagaaaaagcagcggtttctctaggggaatagcgaaatatcgtggacttcaaagccgatgggacgcatcagccagtcgtatgcctggacctgaatacttcagtaacattcattacggggcaggtgatgatcgtggaacagaaggtgactttctaggtagcttttgtctggaaagaaagattgatctaacaggatacataaagtggtggggagccaacaagaaccgtcaaccagaatcttcatcaaaagcatcagaggatgcaaacgtcgaagatgctggtactgagcttaaaacactggaacacacatcccatgcaacagaaccatacaaggcgccaaaccttggcgtcctttgtggaactcagagaaaagaaaaagaaatatcatcaccatcaagctcttctgctttaagcatcttgtctcagtcgcctgccttcaagagcctagaggagaaagtgttgaagatccaagaaagctgcaataatgaaaacgatgagaatgcaaaccgtaacatcatcaatatggagaagaataacggcaaggcaatagagaaaccagttgtgagtcatggagttgctttaggcggtgctgctgctttgtctcttcagaaaagcatgtacccacttacctctctcttaacggctccattgctcaccaactacaatacattggatcctcttgcagaccctattctctggacaccatttcttccttcaggatcctctcttacttcagaggtgacaaagacagagaccagctgttccacgtacagctacctcccacaagagaaatgagccgttccctttagactttatgtatgtcagattctccttttttgagatgaattcgtcgacttgacatctctttgtctcttttatggagaaaaagttgggaaaagtgtgacaatggtctgaagcaggaatgtacaggttttgttagtggttgtgtttttttttttccagtgtggaatatagaatcatgatattttgtgtaaaacagaaaaaagttatcattatagtatagaagtttgctcttaaaaaaaaaaaaaaaa

SEQ ID NO: 52 - protein, 428 aa, Arabidopsis thaliana
  G20,AP2 domain coordinates 68-144
MASVSSSDQGPKTEAGCSGGGGGESSETVAASDQMLLYRGFKKAKKERGCTAKERISKMPPCTAGKRSSIYRGVTRHRWTGRYEAHLWDKSTWNQNQNKKGKQVYLGAYDDEEAAARAYDLAALKYWGPGTLINFPVTDYTRDLEEMQNLSREEYLASLRRYPFGRKSSGFSRGIAKYRGLQSRWDASASRMPGPEYFSNIHYGAGDDRGTEGDFLGSFCLERKIDLTGYIKWWGANKNRQPESSSKASEDANVEDAGTELKTLEHTSHATEPYKAPNLGVLCGTQRKEKEISSPSSSSALSILSQSPAFKSLEEKVLKIQESCNNENDENANRNIINMEKNNGKAIEKPVVSHGVALGGAAALSLQKSMYPLTSLLTAPLLTNYNTLDPLADPILWTPFLPSGSSLTSEVTKTETSCSTYSYLPQEK

SEQ ID NO: 53 - DNA, 1003 bp, Arabidopsis thaliana
  G21,family:AP2
tgtggaggaatattaatacagcccacttcacatctatttttgtgcaaccatctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctctcactaacact

SEQ ID NO: 54 - protein, 295 aa, Arabidopsis thaliana
  G21,AP2 domain coordinates 97-164
MARQINIESSVSQVTFISSAIPAVSSSSSITASASLSSSPTTSSSSSSSTNSNFIEEDNSKRKASRRSLSSLVSVEDDDDQNGGGGKRRKTNGGDKHPTYRGVRMRSWGKWVSEIREPRKKSRIWLGTYPTAEMAARAHDVAALAIKGTTAYLNFPKLAGELPRPVTNSPKDIQAAASLAAVNWQDSVNDVSNSEVAEIVEAEPSRAVVAQLFSSDTSTTTTTQSQEYSEASCASTSACTDKDSEEEKLFDLPDLFTDENEMMIRNDAFCYYSSTWQLCGADAGFRLEEPFFLSE

SEQ ID NO: 55 - DNA, 913 bp, Arabidopsis thaliana
  G22,family:AP2
agaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatggaaattaaatattgacgtttgtttttttgttgtaaaaaaaaaaaaaaaaaa

SEQ ID NO: 56 - protein, 226 aa, Arabidopsis thaliana
  G22,AP2 domain coordinates 88-152
MSSSDSVNNGVNSRMYFRNPSFSNVILNDNWSDLPLSVDDSQDMAIYNTLRDAVSSGWTPSVPPVTSPAEENKPPATKASGSHAPRQKGMQYRGVRRRPWGKFAAEIRDPKKNGARVWLGTYETPEDAAVAYDRAAFQLRGSKAKLNFPHLIGSCKYEPVRIRPRRRSPEPSVSDQLTSEQKRESHVDDGESSLVVPELDFTVDQFYFDGSLLMDQSECSYSDNRI

SEQ ID NO: 57 - DNA, 957 bp, Arabidopsis thaliana
  G24,family:AP2
cggacgcgtgggcaaatattaaaataaaaagtgtcggtgaattctcaatctttgtcttctttcgtcgtctctttaaaactcctccgtccctccttattatgtaaccgtctcgccgtcaaattttcaaaatctctccctccgttcataaacccagatcgaaatttatggttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgtttgtctttaagatgcgctgttgccgctaacatgcgctttcgattttagtgttaaacatgcgcctccattgtttttgggttttgttttcgtcgtcgataatcaaagattttaaaacacaattctcaaatttttcacttgttacaaactagatttgcatgatctttgtattaacgaataacgattaagtcctaaa

SEQ ID NO: 58 - protein, 176 aa, Arabidopsis thaliana
  G24,AP2 domain coordinates 25-92
METEAAVTATVTAATMGIGTRKRDLKPYKGIRMRKWGKWVAEIREPNKRSRIWLGSYATPEAAARAYDTAVFYLRGPSARLNFPELLAGLTVSNGGGRGGDLSAAYIRRKAAEVGAQVDALGATVVVNTGGENRGDYEKIENCRKSGNGSLERVDLNKLPDPENSDGDDDECVKRR

SEQ ID NO: 59 - DNA, 751 bp, Arabidopsis thaliana
  G25,family:AP2
aggactcggttcaaaaacgaaaacgcaaatacgtcttgttctagtttggagttggaagcgtaaaaaacaaaaaacaaaaatgtgtgggggagctatcatttctgatttcatctggtcgaaatctgagtcagaaccgagtcaactcggctctgttagcagcaggaagaagcgtaaacccgtctcagtgagtgaagaaagagatgggaaacgagagaggaagaatctgtacagagggataaggcagaggccatggggcaaatgggcagcggagattcgtgacccgagcaaaggtgtacgtgtctggcttggcacattcaaaaccgccgacgaagctgctcgagcctacgacgttgctgccatcaaaatccgtggccggaaagccaaactgaatttcccaaacactcaagtagaagaagaagccgatactaaaccaggggggaatcaaaatgagctgatttcggaaaaccaagtagagagcttatcggaggacctgatggcattggaggattacatgagattctatcagattccggttgccgacgaccaatcggcgaccgatattggaaatttatggagctatcaagactccaattaaatctcttatttcccggccggtttgctcactcattaatatgctgctaatttacttgttttttacttaacaatcaagtctaatttgtttccatcaatatttcagataagagtaaagcttcaattgtctttaaaaaaaaaaaaaaaaaaaaaaaaaaaa

SEQ ID NO: 60 - protein, 171 aa, Arabidopsis thaliana
  G25,AP2 domain coordinates 47-114
MCGGAIISDFIWSKSESEPSQLGSVSSRKKRKPVSVSEERDGKRERKNLYRGIRQRPWGKWAAEIRDPSKGVRVWLGTFKTADEAARAYDVAAIKIRGRKAKLNFPNTQVEEEADTKPGGNQNELISENQVESLSEDLMALEDYMRFYQIPVADDQSATDIGNLWSYQDSN

SEQ ID NO: 61 - DNA, 1084 bp, Arabidopsis thaliana
  G26,family:AP2
ttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggctttgatcattttaggcgcttaatctctttacgacttcattttggtagtctttaaagagtctatggagtggatttagctaggaatcaggccttatggatgaaaaatatataaattttgaacatgactatgcaagaatgggatgaagactacttagcttggaaaacgtcctgataggtcatgacgactatatccacagaagatgaccgacggagacaacaacatgcctcacctgatcgaccgatcaaatgagataatgtgttgaccggaccggtcggatcaggttgggtcgagtatatca

SEQ ID NO: 62 - protein, 218 aa, Arabidopsis thaliana
  G26,AP2 domain coordinates 67-134
MHSGKRPLSPESMAGNREEKKELCCCSTLSESDVSDFVSELTGQPIPSSIDDQSSSLTLQEKSNSRQRNYRGVRQRPWGKWAAEIRDPNKAARVWLGTFDTAEEAALAYDKAAFEFRGHKAKLNFPEHIRVNPTQLYPSPATSHDRIIVTPPSPPPPIAPDILLDQYGHFQSRSSDSSANLSMNMLSSSSSSLNHQGLRPNLEDGENVKNISIHKRRK

SEQ ID NO: 63 - DNA, 881 bp, Arabidopsis thaliana
  G27,family:AP2
caaaataccaaaaacaaaacattttttttaatcttcccaccaatttttttctctttctctcgttacattaaattatctttagatgcaagactcttcctctcacgaatcgcaacgtaacctccggtcaccggtgccggagaaaaccggaaagagttctaagactaaaaatgagcaaaaaggtgtttctaaacaaccaaattttcgtggggtcagaatgagacaatggggaaaatgggtgtctgaaattagagaaccaagaaagaaatcaagaatatggctcggtactttctctacgccggagatggcggcgcgtgcacacgacgtggcggctttagccatcaaaggtggctctgcccaccttaatttcccggagctagcttaccatttgccgagaccggctagcgcggaccctaaagacattcaagaagccgccgccgcagcagctgccgttgactggaaagcaccggagtctccgtctagcaccgtgacgtcatctccagtcgccgacgacgctttctccgatcttcctgatcttttgcttgacgtgaatgatcacaacaaaaacgatggattctgggactcgtttccgtacgaagatcctttcttcttggaaaattactagaaggcaaattcttgccggcgaacggattttccggtggtttcccggtaaataagaagacgatgtcgttttgtaccttttttgtctacgatgggaaatttcttttttttttacgtgtgagtaaaagtttccgaatgtgtgatgtgtaagtaagtacaggttatttaatttcttttttttgtacaaatacgtacgtcattaccaaaaagttttcatttattgtgcttttatcttccaaattcattaaaaaaaaaaaaaaaaa

SEQ ID NO: 64 - protein, 179 aa, Arabidopsis thaliana
  G27,AP2 domain coordinates 37-104
MQDSSSHESQRNLRSPVPEKTGKSSKTKNEQKGVSKQPNFRGVRMRQWGKWVSEIREPRKKSRIWLGTFSTPEMAARAHDVAALAIKGGSAHLNFPELAYHLPRPASADPKDIQEAAAAAAAVDWKAPESPSSTVTSSPVADDAFSDLPDLLLDVNDHNKNDGFWDSFPYEDPFFLENY

SEQ ID NO: 65 - DNA, 553 bp, Arabidopsis thaliana
  G30,family:AP2
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttctaaaaaaaaaaaaaaaaa

SEQ ID NO: 66 - protein, 133 aa, Arabidopsis thaliana
  G30,AP2 domain coordinates 16-80
MDQGGRSSGSGGGGAEQGKYRGVRRRPWGKYAAEIRDSRKHGERVWLGTFDTAEDAARAYDRAAYSMRGKAAILNFPHEYNMGTGSSSTAANSSSSSQQVFEFEYLDDSVLDELLEYGENYNKTHNINMGKRQ

SEQ ID NO: 67 - DNA, 911 bp, Arabidopsis thaliana
  G32,family:AP2
aacacacattccctctcttccttcaactagaaaaaagatagatatatcggacatttattgatctgtgtatgcataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttgaaaaaaaaaaaaa

SEQ ID NO: 68 - protein, 211 aa, Arabidopsis thaliana
  G32,AP2 domain coordinates 17-84
MNTTSSKSKKKQDDQVGTRFLGVRRRPWGRYAAEIRDPTTKERHWLGTFDTAEEAALAYDRAARSMRGTRARTNFVYSDMPPSSSVTSIVSPDDPPPPPPPPAPPSNDPVDYMMMFNQYSSTDSPMLQPHCDQVDSYMFGGSQSSNSYCYSNDSSNELPPLPSDLSNSCYSQPQWTWTGDDYSSEYVHSPMFSRMPPVSDSFPQGFNYFGS

SEQ ID NO: 69 - DNA, 1440 bp, Arabidopsis thaliana
  G38,family:AP2
gaggaaaactcgaaaaagctacacacaagaagaagaagaaaagatacgagcaagaagactaaacacgaaagcgatttatcaactcgaaggaagagactttgattttcaaatttcgtcccctatagattgtgttgtttctgggaaggagatggcagtttatgatcagagtggagatagaaacagaacacaaattgatacatcgaggaaaaggaaatctagaagtagaggtgacggtactactgtggctgagagattaaagagatggaaagagtataacgagaccgtagaagaagtttctaccaagaagaggaaagtacctgcgaaagggtcgaagaagggttgtatgaaaggtaaaggaggaccagagaatagccgatgtagtttcagaggagttaggcaaaggatttggggtaaatgggttgctgagatcagagagcctaatcgaggtagcaggctttggcttggtactttccctactgctcaagaagctgcttctgcttatgatgaggctgctaaagctatgtatggtcctttggctcgtcttaatttccctcggtctgatgcgtctgaggttacgagtacctcaagtcagtctgaggtgtgtactgttgagactcctggttgtgttcatgtgaaaacagaggatccagattgtgaatctaaacccttctccggtggagtggagccgatgtattgtctggagaatggtgcggaagagatgaagagaggtgttaaagcggataagcattggctgagcgagtttgaacataactattggagtgatattctgaaagagaaagagaaacagaaggagcaagggattgtagaaacctgtcagcaacaacagcaggattcgctatctgttgcagactatggttggcccaatgatgtggatcagagtcacttggattcttcagacatgtttgatgtcgatgagcttctacgtgacctaaatggcgacgatgtgtttgcaggcttaaatcaggaccggtacccggggaacagtgttgccaacggttcatacaggcccgagagtcaacaaagtggttttgatccgctacaaagcctcaactacggaatacctccgtttcagctcgagggaaaggatggtaatggattcttcgacgacttgagttacttggatctggagaactaaacaaaacaatatgaagctttttggatttgatatttgccttaatcccacaacgactgttgattctctatccgagttttagtgatatagagaactacagaacacgttttttcttgttataaaggtgaactgtatatatcgaaacagtgatatgacaatagagaagacaactatagtttgttagtctgcttctcttaagttgttctttagatatgttttatgttttgtaacaacaggaatgaataatacacacttgtgaagcttttaaaaaaaaaaaaaaaaaaaaa

SEQ ID NO: 70 - protein, 335 aa, Arabidopsis thaliana
  G38,AP2 domain coordinates 76-143
MAVYDQSGDRNRTQIDTSRKRKSRSRGDGTTVAERLKRWKEYNETVEEVSTKKRKVPAKGSKKGCMKGKGGPENSRCSFRGVRQRIWGKWVAEIREPNRGSRLWLGTFPTAQEAASAYDEAAKAMYGPLARLNFPRSDASEVTSTSSQSEVCTVETPGCVHVKTEDPDCESKPFSGGVEPMYCLENGAEEMKRGVKADKHWLSEFEHNYWSDILKEKEKQKEQGIVETCQQQQQDSLSVADYGWPNDVDQSHLDSSDMFDVDELLRDLNGDDVFAGLNQDRYPGNSVANGSYRPESQQSGFDPLQSLNYGIPPFQLEGKDGNGFFDDLSYLDLEN

SEQ ID NO: 71 - DNA, 909 bp, Arabidopsis thaliana
  G43,family:AP2
ctcctgtcttgtctaaagaaaaaagagagaggaagaaatggagacttttgaggaaagctctgatttggatgttatacagaaacatctatttgaagacttgatgatccctgatggtttcattgaagattttgtctttgatgatactgcttttgtctccggactctggtctctagaaccctttaacccagttccgaaactggaacctagttcacctgttcttgatccagattcctatgtccaagagattctgcaaatggaagcagaatcatcatcatcatcatcaacaacaacgtcacctgaggttgagactgtctcaaaccggaaaaaaacaaagaggtttgaagaaacgagacattacagaggcgtgagaaggaggccatgggggaaatttgcagcagagattcgagatccggcaaagaaaggatccaggatttggttaggcacttttgagagtgatattgatgctgcaagggcttacgactatgcagcttttaagctcaggggaagaaaagctgttctcaactttcctttggatgccggaaagtatgatgctccggtcaattcatgccgaaaaaggaggagaaccgatgtaccacagcctcaaggaacaacaacaagtacttcatcatcgtcatcaaactaatgggggaatagtgatgtttaattagtatatataggttaatatcttaagtatgtgaagcatcatgtatagagccaagaacctgttagactagtgtactgaaaagaactcttgcaaaatatgtactaaagagttcctgtaacaatggaacttctgcgttttctcttgtcttaaagagcttaaggttctagaaacaaagttcttgtcctttcggtttaaaaaaaaaaaaaaaaaaaaaaaaaaaaaaaaaaaaaaaaaaaaaaaaaaaa

SEQ ID NO: 72 - protein, 201 aa, Arabidopsis thaliana
  G43,AP2 domain coordinates 104-172
METFEESSDLDVIQKHLFEDLMIPDGFIEDFVFDDTAFVSGLWSLEPFNPVPKLEPSSPVLDPDSYVQEILQMEAESSSSSSTTTSPEVETVSNRKKTKRFEETRHYRGVRRRPWGKFAAEIRDPAKKGSRIWLGTFESDIDAARAYDYAAFKLRGRKAVLNFPLDAGKYDAPVNSCRKRRRTDVPQPQGTTTSTSSSSSN

SEQ ID NO: 73 - DNA, 997 bp, Arabidopsis thaliana
  G44,family:AP2
cacatacacatatacaacagagcaagagagtcaatcaagtagagtgaagatggcaactaaacaagaagctttagccatcgatttcataagccaacaccttctcacagactttgtttccatggaaactgatcacccatctctttttaccaaccaacttcacaactttcactcagaaacaggccctagaaccatcaccaaccaatcccctaaaccgaattcgactcttaaccagcgtaaaccgcccttaccgaatctatccgtctcgagaacggtttcaacaaagacagagaaagaggaagaagagaggcactacaggggagtgagacgaagaccgtggggaaaatacgcggcggagattagggatccgaacaaaaagggttgtaggatctggcttgggacttacgacactgccgtggaagctggaagagcttatgaccaagcggcgtttcaattacgtggaagaaaagcaatcttgaatttccctctcgatgttagggttacgtcagaaacttgttctggggaaggagttatcggattagggaaacgaaagcgagataagggttctccgccggaagaggagaaggcggctagggttaaagtggaggaagaagagagtaatacgtcggagacgacggaggctgaggttgagccggtggtaccattgacgccgtcaagttggatggggttttgggatgtgggagcaggagatggtattttcagtattcctccgttatctccgacgtctcccaacttttccgttatctccgtcacttaaaacttcggaaaagtcaacgtacgatgacgttttcacttgcgtcactctcatgatttcatttattcttgtataatataaaggtagcggtagtgtgcaaatatcaaataagtagtttaattagtaccaatcattttattcattattttttttagtagaatatttggatgttgaaaatataaatttaattttgtatttgttgatgttataaaaaaaaaaaaaaaa

SEQ ID NO: 74 - protein, 241 aa, Arabidopsis thaliana
  G44,AP2 domain coordinates 85-154
MATKQEALAIDFISQHLLTDFVSMETDHPSLFTNQLHNFHSETGPRTITNQSPKPNSTLNQRKPPLPNLSVSRTVSTKTEKEEEERHYRGVRRRPWGKYAAEIRDPNKKGCRIWLGTYDTAVEAGRAYDQAAFQLRGRKAILNFPLDVRVTSETCSGEGVIGLGKRKRDKGSPPEEEKAARVKVEEEESNTSETTEAEVEPVVPLTPSSWMGFWDVGAGDGIFSIPPLSPTSPNFSVISVT

SEQ ID NO: 75 - DNA, 1262 bp, Arabidopsis thaliana
  G45,family:AP2
attaatactctgcatctagtccttttcaagagtacacaatctgcacttttttaatgaaaatagtacacaatctttatacttcaaactgaggtaacattattaaattaatttattgaagttgacttaagatgatctattcacataatggtacgtgtgtgtgtgtatacacagaaaacccctgattttatgtggaacctaaaaccctccatgaaatgcggtcagtaccttagaacacaagtttcaccaactgtacttcccaattatcctgccgcagattcaacaatggcttttggcaatatccaagaactagacggcgagatcctaaagaacgtttgggcgaattacatcggaacaccacaaaccgatacaagatcaattcaagttccagaagtttctagaacttgggaagcgttgcctacccttgatgacataccagaaggttctagagaaatgcttcaaagcctagatatgtcgacggaggaccaggaatggacagagattctcgatgctattgcttctttcccaaacaaaaccaatcatgatccattaaccaaccctaccattgattcatgttctttgtcttctcgggtttcttgcaaaacaagaaaatacaggggagtacggaagcgtccgtgggggaaatttgcagccgaaatcagggattcgacgagaaacggtgttagggtttggctcggaacgttccaaactgcagaggaagcagctatggcttacgataaagccgcggttagaattagaggtactcaaaaagctcacacaaattttcagctcgaaacagttataaaagctatggaaatggattgcaacccaaactactaccggatgaacaactcaaatacgtccgatccattaagaagcagccgcaaaatcggattgagaacaggaaaagaggcggttaaggcttatgatgaagtcgttgatgggatggttgaaaaccattgtgcccttagctattgttcaactaaggagcactcggagactcgtggtttgcgtgggagtgaagaaacttggttcgatttaagaaagagacgaaggagtaatgaagattctatgtgtcaagaagttgaaatgcagaagacggttactggagaagagacagtatgtgatgtgtttggtttgtttgagtttgaggatttgggaagtgattatttggagacgttattatcttctttttgacagaaatacattgaaaactaccgttgctaatttgataggtatacatatatagacatgtatatattgta

SEQ ID NO: 76 - protein, 349 aa, Arabidopsis thaliana
  G45,AP2 domain coordinates 152-217
MVRVCVYTQKTPDFMWNLKPSMKCGQYLRTQVSPTVLPNYPAADSTMAFGNIQELDGEILKNVWANYIGTPQTDTRSIQVPEVSRTWEALPTLDDIPEGSREMLQSLDMSTEDQEWTEILDAIASFPNKTNHDPLTNPTIDSCSLSSRVSCKTRKYRGVRKRPWGKFAAEIRDSTRNGVRVWLGTFQTAEEAAMAYDKAAVRIRGTQKAHTNFQLETVIKAMEMDCNPNYYRMNNSNTSDPLRSSRKIGLRTGKEAVKAYDEVVDGMVENHCALSYCSTKEHSETRGLRGSEETWFDLRKRRRSNEDSMCQEVEMQKTVTGEETVCDVFGLFEFEDLGSDYLETLLSSF

SEQ ID NO: 77 - DNA, 818 bp, Arabidopsis thaliana
  G46,family:AP2
ttctctctttcgtaaaaatggcgagttttgaggaaagctctgatttggaagctatacagagccatctcttagaagacttgttggtttgtgatggtttcatgggagattttgacttcgatgcttcttttgtctcaggactttggtgtatagaaccacacgttcctaaacaagaacctgattctccagttcttgatccggattctttcgtcaacgagttcttgcaagtggaaggggaatcatcatcatcatcatcaccagagctgaattcatcgtcatcaacatatgagactgatcagagtgtgaaaaaggcagagaggttcgaagaagaagtagatgctagacattaccgaggagtgaggcgaaggccgtgggggaaatttgcagcagagattcgagatccagcaaagaaaggatcaagaatctggctaggaacatttgagagtgatgttgatgctgcaagagcctatgactgtgcagctttcaagctccggggaagaaaagccgtgctcaacttccctcttgacgccgggaaatatgaagctccagcgaattcaggaaggaaaaggaagagaagtgatgtgcatgaagagcttcaaagaactcagagcaattcatcttcatcttcctgtgatgcattttagcatattaagagtgtgagcagtttccttaagttgtataaagtaattgtacagaggaaacgaattgtgtaggtttagtgtgcttgcaagttgcaacaaatgtgtatggatgttctgtttcttcatgtccctaagatttagaaacatcttcttatttccaagaaaaaaaaaaaaaaaaaa

SEQ ID NO: 78 - protein, 207 aa, Arabidopsis thaliana
  G46,AP2 domain coordinates 107-175
MASFEESSDLEAIQSHLLEDLLVCDGFMGDFDFDASFVSGLWCIEPHVPKQEPDSPVLDPDSFVNEFLQVEGESSSSSSPELNSSSSTYETDQSVKKAERFEEEVDARHYRGVRRRPWGKFAAEIRDPAKKGSRIWLGTFESDVDAARAYDCAAFKLRGRKAVLNFPLDAGKYEAPANSGRKRKRSDVHEELQRTQSNSSSSSCDAF

SEQ ID NO: 79 - DNA, 1043 bp, Arabidopsis thaliana
  G129,family:MADS
cattttctgcaacttctccaaatctcatactttccagaaaatcattttcccaagaaaaataaaactttcccctttgttcttctccccccaacagcaatcacggcgtaccaatcggagctaggaggagattcctctcccttgaggaaatctgggagaggaaagatcgaaatcaaacggatcgagaacacaacgaatcgtcaagtcactttttgcaaacgtagaaatggtttgctcaagaaagcttacgagctctctgttctctgtgatgctgaagtcgcactcatcgttttctctagccgtggtcgtctctatgagtactctaacaacagtgtaaaaggtactattgagaggtacaagaaggcaatatcggacaattctaacaccggatcggtggcagaaattaatgcacagtattatcaacaagaatcagccaaattgcgtcaacaaattatcagcatacaaaactccaacaggcaattgatgggtgagacgatagggtcaatgtctcccaaagagctcaggaacttggaaggcagattagagagaagtattacccgaatccgatccaagaagaatgagctcttattttctgaaatcgactacatgcagaaaagagaagttgatttgcataacgataaccagattcttcgtgcaaagatagctgaaaatgagaggaacaatccgagtataagtctaatgccaggaggatctaactacgagcagcttatgccaccacctcaaacgcaatctcaaccgtttgattcacggaattatttccaagtcgcggcattgcaacctaacaatcaccattactcatccgccggtcgccaagaccaaaccgctctccagttagtgtaatattggctgaaggaaatggcctggagtgaataaaaaccagaattgggttgagcaagcaatataaagctaatgcatgttatatatatatttatcccatgaatgttgtatcagtgaattcttatgcttatgttgatgtgaaattaaatatcttaaagacatgtcattaatgtgcttaatttgcttca

SEQ ID NO: 80 - protein, 252 aa, Arabidopsis thaliana
  G129,MADS domain coordinates 18-73
TAYQSELGGDSSPLRKSGRGKIEIKRIENTTNRQVTFCKRRNGLLKKAYELSVLCDAEVALIVFSSRGRLYEYSNNSVKGTIERYKKAISDNSNTGSVAEINAQYYQQESAKLRQQIISIQNSNRQLMGETIGSMSPKELRNLEGRLERSITRIRSKKNELLFSEIDYMQKREVDLHNDNQILRAKIAENERNNPSISLMPGGSNYEQLMPPPQTQSQPFDSRNYFQVAALQPNNHHYSSAGRQDQTALQLV

SEQ ID NO: 81 - DNA, 1057 bp, Arabidopsis thaliana
  G131,family:MADS
ctttccaattggttcataccaaagtctgagctcttctttatatctctcttgtagtttcttattgggggtctttgttttgtttggttcttttagagtaagaagtttcttaaaaaaggatcaaaaatgggaaggggtagggttcaattgaagaggatagagaacaagatcaatagacaagtgacattctcgaaaagaagagctggtcttttgaagaaagctcatgagatctctgttctctgtgatgctgaagttgctcttgttgtcttctcccataaggggaaactcttcgaatactccactgattcttgtatggagaagatacttgaacgctatgagaggtactcttacgccgaaagacagcttattgcacctgagtccgacgtcaatacaaactggtcgatggagtataacaggcttaaggctaagattgagcttttggagagaaaccagaggcattatcttggggaagacttgcaagcaatgagccctaaagagcttcagaatctggagcagcagcttgacactgctcttaagcacatccgcactagaaaaaaccaacttatgtacgagtccatcaatgagctccaaaaaaaggagaaggccatacaggagcaaaacagcatgctttctaaacagatcaaggagagggaaaaaattcttagggctcaacaggagcagtgggatcagcagaaccaaggccacaatatgcctccccctctgccaccgcagcagcaccaaatccagcatccttacatgctctctcatcagccatctccttttctcaacatgggtggtctgtatcaagaagatgatcctatggcaatgaggaggaatgatctcgaactgactcttgaacccgtttacaactgcaaccttggctgcttcgccgcatgaagcatttccatatatatatttgtaatcgtcaacaataaaaacagtttgccacatacatataaatagtggctaggctcttttcatccaattaatatattttggcaaatgttcgatgttcttatatcatcatatataaattagcaggctcctttctttttttgta

SEQ ID NO: 82 - protein, 256 aa, Arabidopsis thaliana
  G131,MADS domain coordinates 1-57
MGRGRVQLKRIENKINRQVTFSKRRAGLLKKAHEISVLCDAEVALVVFSHKGKLFEYSTDSCMEKILERYERYSYAERQLIAPESDVNTNWSMEYNRLKAKIELLERNQRHYLGEDLQAMSPKELQNLEQQLDTALKHIRTRKNQLMYESINELQKKEKAIQEQNSMLSKQIKEREKILRAQQEQWDQQNQGHNMPPPLPPQQHQIQHPYMLSHQPSPFLNMGGLYQEDDPMAMRRNDLELTLEPVYNCNLGCFAA

SEQ ID NO: 83 - DNA, 988 bp, Arabidopsis thaliana
  G133,family:MADS
ctcttcaacaaaaagattaaacaaagagagaagaatatggcgagagggaagatccagatcaagaggatagagaaccagacaaacagacaagtgacgtattcaaagagaaggaatggtttattcaagaaagcacatgagctcacggttttgtgtgatgctagggtttcgattatcatgttctctagctccaacaagcttcatgagtatatcagccctaacaccacaacgaaggagatcgtagatctgtaccaaactatttctgatgtcgatgtttgggccactcaatatgagcgaatgcaagaaaccaagaggaaactgttggagacaaatagaaatctccggactcagatcaagcagaggctaggtgagtgtttggacgagcttgacattcaggagctgcgtcgtcttgaggatgaaatggaaaacactttcaaactcgttcgcgagcgcaagttcaaatctcttgggaatcagatcgagaccaccaagaaaaagaacaaaagtcaacaagacatacaaaagaatctcatacatgagctggaactaagagctgaagatcctcactatggactagtagacaatggaggagattacgactcagttcttggataccaaatcgaagggtcacgtgcttacgctcttcgtttccaccagaaccatcaccactattaccccaaccatggccttcatgcaccctctgcctctgacatcattaccttccatcttcttgaataattaaaggctaaaaggtttgctggtgccatcattgtctatctaattatttagtaactacttaaaacataaggcatggtgttgctaaaaccttaaactgtcatgtttcttagttatgtattttaaagcctaaagaaatatggattgtgtgatcagtagtgcttaggcttattgtgtgtggaatgttttcaagacttttatcatgtatcgtattattatattgaccactctacttaattatgctacaaatttactc

SEQ ID NO: 84 - protein, 232 aa, Arabidopsis thaliana
  G133,MADS domain coordinates 1-57
MARGKIQIKRIENQTNRQVTYSKRRNGLFKKAHELTVLCDARVSIIMFSSSNKLHEYISPNTTTKEIVDLYQTISDVDVWATQYERMQETKRKLLETNRNLRTQIKQRLGECLDELDIQELRRLEDEMENTFKLVRERKFKSLGNQIETTKKKNKSQQDIQKNLIHELELRAEDPHYGLVDNGGDYDSVLGYQIEGSRAYALRFHQNHHHYYPNHGLHAPSASDIITFHLLE

SEQ ID NO: 85 - DNA, 914 bp, Arabidopsis thaliana
  G134,family:MADS
ggcacgaggagagagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcaagaaactatgggatgctaagcatgagaaccttagcaatgagattgataggatcaagaaagagaatgatagcttacaactggagctcaggcatttgaagggagaagatatacagtctctcaacttgaaaaatctgatggctgtcgagcacgccattgaacatggcctcgacaaagtccgagaccaccagatggagatccttatatcaaagaggagaaatgagaagatgatggcggaggagcaacggcaactcactttccagctgcaacaacaggagatggctatagcaagcaacgcaagaggaatgatgatgagagatcatgatgggcagtttggatatagagtgcaaccgattcagccaaatcttcaggaaaagattatgtctttggtcatcgattgatcatcgagattttataatctcatcctgatcaactcctatctatactatcgtggtctttagtttgtctttatcaatctgtgtgtcttaatctcgagcaacatatatactcgctatcagactttttacttaagctatatgtgtgttgtttgcttatgacctctatgtattggttgtgttgtgtgcttaaacgtttcgaactaattgatctgtgtgaaacttattattctgtgataagctatttgtgataaaaaa

SEQ ID NO: 86 - protein, 208 aa, Arabidopsis thaliana
  G134,MADS domain coordinates 1-57
MGRGKIEIKRIENANNRVVTFSKRRNGLVKKAKEITVLCDAKVALIIFASNGKMIDYCCPSMDLGAMLDQYQKLSGKKLWDAKHENLSNEIDRIKKENDSLQLELRHLKGEDIQSLNLKNLMAVEHAIEHGLDKVRDHQMEILISKRRNEKMMAEEQRQLTFQLQQQEMAIASNARGMMMRDHDGQFGYRVQPIQPNLQEKIMSLVID

SEQ ID NO: 87 - DNA, 820 bp, Arabidopsis thaliana
  G135,family:MADS
cttcatataatttagttattttaagagaaatgggaaggggtagggttgaattgaagaggatagagaacaagatcaatagacaagtgacattctcgaaaagaagaactggtcttttgaagaaagctcaggagatctctgttctttgtgatgccgaggtttcccttattgtcttctcccataagggcaaattgttcgagtactcctctgaatcttgcatggagaaggtactagaacgctacgagaggtattcttacgccgagagacagctgattgcacctgactctcacgttaatgcacagacgaactggtcaatggagtatagcaggcttaaggccaagattgagcttttggagagaaaccaaaggcattatctgggagaagagttggaaccaatgagcctcaaggatctccaaaatctggagcagcagcttgagactgctcttaagcacattcgctccagaaaaaatcaactcatgaatgagtccctcaaccacctccaaagaaaggagaaggagatacaggaggaaaacagcatgcttaccaaacagataaaggagagggaaaacatcctaaggacaaaacaaacccaatgtgagcagctgaaccgcagcgtcgacgatgtaccacagccacaaccatttcaacacccccatctttacatgatcgctcatcagacttctcctttcctaaatatgggtggtttgtaccaagaagaagaccaaacggcgatgaggaggaacaatctggatctgactcttgaacccatttacaattaccttggctgttacgccgcttgaatagactacatcgatctatatca

SEQ ID NO: 88 - protein, 255 aa, Arabidopsis thaliana
  G135,MADS domain coordinates 1-57
MGRGRVELKRIENKINRQVTFSKRRTGLLKKAQEISVLCDAEVSLIVFSHKGKLFEYSSESCMEKVLERYERYSYAERQLIAPDSHVNAQTNWSMEYSRLKAKIELLERNQRHYLGEELEPMSLKDLQNLEQQLETALKHIRSRKNQLMNESLNHLQRKEKEIQEENSMLTKQIKERENILRTKQTQCEQLNRSVDDVPQPQPFQHPHLYMIAHQTSPFLNMGGLYQEEDQTAMRRNNLDLTLEPIYNYLGCYAA

SEQ ID NO: 89 - DNA, 895 bp, Arabidopsis thaliana
  G136,family:MADS
ggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttcccctcataacgattaagagagagacgagagagttcattttatatttataacgcgactgtgtattcatagtttaggttctaataatgataataacaaaactgttgtttctttgcttc

SEQ ID NO: 90 - protein, 248 aa, Arabidopsis thaliana
  G136,MADS domain coordinates 18-74
MEEGGSSHDAESSKKLGRGKIEIKRIENTTNRQVTFCKRRNGLLKKAYELSVLCDAEVALVIFSTRGRLYEYANNSVRGTIERYKKACSDAVNPPSVTEANTQYYQQEASKLRRQIRDIQNSNRHIVGESLGSLNFKELKNLEGRLEKGISRVRSKKNELLVAEIEYMQKREMELQHNNMYLRAKIAEGARLNPDQQESSVIQGTTVYESGVSSHDQSQHYNRNYIPVNLLEPNQQFSGQDQPPLQLV

SEQ ID NO: 91 - DNA, 1294 bp, Arabidopsis thaliana
  G137,family:MADS
ccctcacacatttcttatcttttgctctcaatagattccattgattcaaaacaaaattttcattaagatttcacaacctccacacacttccaaacacaattaaagagaggaaaaagaatcaataaccctataaataaaaaatcagacaaacagaagtttcctcttcttcttccttaagctagtaccttttgttcttgaaattagggttaatttcttttttccaaataccatcaattctccagaccataaaaactcaaaaagatcagatctttcctctgaaaaagagatacccaacttatgtttttgtgtgtctgtatatagataaacattacatacccatatttgtgtatagacataaaaagtggaaattaaggtaacaaaaagaaatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggatgggaaggcggtgaacagaatgttacctacgcgcatcatcaagctcagtctcagggactataccagcctcttgaatgcaatccaactctgcaaatggggtatgataatccagtatgctctgagcaaatcactgcgacaacacaagctcaggcgcagccgggaaacggttacattccaggatggatgctctgagaatcatgtactgtgatgaagctcacccacaaaagaccttatatatatataaagtatagatacaagacttggatttgtagacataagtggctaatataatggtcctgaggatcttctagacatttgtatcttttgggaatccttgcttatattaagaattc

SEQ ID NO: 92 - protein, 248 aa, Arabidopsis thaliana
  G137,MADS domain coordinates 1-57
MGRGRVELKRIENKINRQVTFAKRRNGLLKKAYELSVLCDAEVALIIFSNRGKLYEFCSSSNMLKTLDRYQKCSYGSIEVNNKPAKELENSYREYLKLKGRYENLQRQQRNLLGEDLGPLNSKELEQLERQLDGSLKQVRSIKTQYMLDQLSDLQNKEQMLLETNRALAMKLDDMIGVRSHHMGGWEGGEQNVTYAHHQAQSQGLYQPLECNPTLQMGYDNPVCSEQITATTQAQAQPGNGYIPGWML

SEQ ID NO: 93 - DNA, 1337 bp, Arabidopsis thaliana
  G138,family:MADS
agaatggcttagcatctctgcaaaaccaacacaaagctatattctcttaaaaatcagttcaacaaaagaagaacctgaacacagttggcccaccaccaccactaccacaatctcctcctccaccaccaccacctagtcaccggaaaccaattcatgccctagattaagaaccagaatccttttgagacaagatctatatatacactctacacatttacttatacactttatctagatatagatgtgtgtgtgtataaaggttctttttcattacttgttggtttagtgataaaaaggaggagagttttcagttgggttttggtttcttggtgagagaagagagaaaaagagaggatgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcagcacttactcaatcgttttggggaagttctgctgcagaacaacaacaacaacatcaacaacagcaacaaggcatgagctcttatcaatcaaaccctccaattcaggaagcaggtttcttcaagcctctacaaggcaatgtagcattgcaaatgagcagtcattacaatcacaatcctgcaaatgcaaccaactctgcaacaacatcacagaatgttaatggattcttccctggatggatggtctgaaaacaatacatatctatatatgtacacatatgtgtgttttatagatcaaagatcattgcttgtgtcatttgatttttgccagagaaacatagttcattattacaaaactttgttatataatcaaggctctaatgtcaaacaccagattattacttttttgttctttgttttttggctctcttgaaatataaaatattgttttggga

SEQ ID NO: 94 - protein, 258 aa, Arabidopsis thaliana
  G138,MADS domain coordinates 1-57
MGRGKVELKRIENKINRQVTFAKRRNGLLKKAYELSVLCDAEIALLIFSNRGKLYEFCSSPSGMARTVDKYRKHSYATMDPNQSAKDLQDKYQDYLKLKSRVEILQHSQRHLLGEELSEMDVNELEHLERQVDASLRQIRSTKARSMLDQLSDLKTKEEMLLETNRDLRRKLEDSDAALTQSFWGSSAAEQQQQHQQQQQGMSSYQSNPPIQEAGFFKPLQGNVALQMSSHYNHNPANATNSATTSQNVNGFFPGWMV

SEQ ID NO: 95 - DNA, 963 bp, Arabidopsis thaliana
  G140,family:MADS
gaattcatcttcccatcctcacttctctttctttctgatcataattaatcttgctaagccagctagggcttatagaaatggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcaagaggcgtctaaactccggagacagattcgggacattcagaatttgaacagacacattcttggtgaatctcttggttccttgaactttaaggaactcaagaaccttgaaagtaggcttgagaaaggaatcagtcgtgtccgatccaagaagcacgagatgttagttgcagagattgaatacatgcaaaaaagggaaatcgagctgcaaaacgataacatgtatctccgctccaagattactgaaagaacaggtctacagcaacaagaatcgagtgtgatacatcaagggacagtttacgagtcgggtgttacttcttctcaccagtcggggcagtataaccggaattatattgcggttaaccttcttgaaccgaatcagaattcctccaaccaagaccaaccacctctgcaacttgtttgattcagtctaacataagcttctttcctcagcctgagatcgatctatagtgtcacctaaatgcggccgcgtccctcaacatctagtcgcaagctgaggggaaccactagtgtcatacgaacctccaagagacggttacacaaacggg

SEQ ID NO: 96 - protein, 246 aa, Arabidopsis thaliana
  G140,MADS domain coordinates 16-72
MEGGASNEVAESSKKIGRGKIEIKRIENTTNRQVTFCKRRNGLLKKAYELSVLCDAEVALVIFSTRGRLYEYANNSVRGTIERYKKACSDAVNPPTITEANTQYYQQEASKLRRQIRDIQNLNRHILGESLGSLNFKELKNLESRLEKGISRVRSKKHEMLVAEIEYMQKREIELQNDNMYLRSKITERTGLQQQESSVIHQGTVYESGVTSSHQSGQYNRNYIAVNLLEPNQNSSNQDQPPLQLV

SEQ ID NO: 97 - DNA, 1093 bp, Arabidopsis thaliana
  G142,family:MADS
atttatcgtgtacgatactttattccttttatctattcttgaaaaaaagttaccaattcttgagaagaagaagaaatcagaatcaagagaaggagagagaaagatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttggaattgaaagcacaatcgaacggtataatcgttgttacaactgctctctaagcaataataagcctgaagagactacacagagttggtgtcaggaggtgacaaagcttaaatccaaatacgaatctcttgttcgtactaacaggaatttgcttggagaagatcttggagaaatgggtgtgaaggaactgcaagcgctcgagaggcagctcgaagccgctcttaccgcgactcgacagcgcaagacacaagttatgatggaagaaatggaagaccttaggaaaaaggagaggcaactaggagacataaacaaacaactcaagattaagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtttcaacaacattactacgtgcaaggtgaagggtcttcggtatcaaagagtaacgtggcaggtgagactaatttcgtccaaggttgggttctttgactctctgttgattagcccacgatgccacggtcaggccaatttcagctctctacagttgttcttttttcaaattagatttctggttttttttttcctataagaaaaacttttgcactagatgtttgtcatttaatttccagctcgtgtgaatctatattcgcatgtatgtgctttgaagaatttctcctcttactcctacttgatctaaaacattatttttcttttgggttt

SEQ ID NO: 98 - protein, 252 aa, Arabidopsis thaliana
  G142,MADS domain coordinates 2-57
MGRGRVEMKRIENKINRQVTFSKRRNGLLKKAYELSVLCDAEVALIIFSSRGKLYEFGSVGIESTIERYNRCYNCSLSNNKPEETTQSWCQEVTKLKSKYESLVRTNRNLLGEDLGEMGVKELQALERQLEAALTATRQRKTQVMMEEMEDLRKKERQLGDINKQLKIKFETEGHAFKTFQDLWANSAASVAGDPNNSEFPVEPSHPNVLDCNTEPFLQIGFQQHYYVQGEGSSVSKSNVAGETNFVQGWVL

SEQ ID NO: 99 - DNA, 906 bp, Arabidopsis thaliana
  G145,family:MADS
aagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagttgaacttagtagccagcaggagtatctcaagcttaaggagcgttatgacgccttacaaagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcagcaagatggaatgggagcaggaccaagtgtgaataattacatgttgggttggttaccttatgacaccaactctatttgaatctttctcacttaattaatctctcttttttttgacatttttaagatgatgtttctattttattacctctctcacgttttctgtcttgtgtgcatgtgtctgtgtaatgtttattgcccttctattattcaatgatttctcgac

SEQ ID NO: 100 - protein, 251 aa, Arabidopsis thaliana
  G145,MADS domain coordinates 1-57
MGRGRVELKRIENKINRQVTFAKRRNGLLKKAYELSVLCDAEVALIIFSNRGKLYEFCSSSSMLRTLERYQKCNYGAPEPNVPSREALAVELSSQQEYLKLKERYDALQRTQRNLLGEDLGPLSTKELESLERQLDSSLKQIRALRTQFMLDQLNDLQSKERMLTETNKTLRLRLADGYQMPLQLNPNQEEVDHYGRHHHQQQQHSQAFFQPLECEPILQIGYQGQQDGMGAGPSVNNYMLGWLPYDTNSI

SEQ ID NO: 101 - DNA, 905 bp, Arabidopsis thaliana
  G146,family:MADS
acgagagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgt

SEQ ID NO: 102 - protein, 230 aa, Arabidopsis thaliana
  G146,MADS domain coordinates 1-57
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 103 - DNA, 636 bp, Arabidopsis thaliana
  G147,family:MADS
atggctcgtggaaagattcagcttaagaggattgagaacccggttcacagacaagtgactttttgcaagaggagaactggtcttctcaagaaggctaaggagctctctgtgctctgtgatgccgagatcggtgttgtgatcttctctcctcagggcaagctctttgagctcgctactaaaggaacaatggagggaatgattgataagtacatgaagtgtactggtggtggtcgtggttcttcttctgctacttttactgctcaagaacaacttcaaccaccaaatcttgatccgaaagatgagatcaacgtgcttaagcaagagattgagatgcttcagaaagggataagctatatgtttggaggaggagatggggctatgaatcttgaagaacttcttttgcttgagaagcatcttgagtattggatttctcagattcgctctgctaagatggatgttatgcttcaagaaattcagtcattgaggaacaaggaaggagtcctcaaaaacaccaacaagtatctcctcgaaaagatagaggaaaacaacaatagcatattagatgctaacttcgcagtcatggagacaaactattcctatccgctaacaatgccaagtgaaatatttcagttctag

SEQ ID NO: 104 - protein, 211 aa, Arabidopsis thaliana
  G147,MADS domain coordinates 2-57
MARGKIQLKRIENPVHRQVTFCKRRTGLLKKAKELSVLCDAEIGVVIFSPQGKLFELATKGTMEGMIDKYMKCTGGGRGSSSATFTAQEQLQPPNLDPKDEINVLKQEIEMLQKGISYMFGGGDGAMNLEELLLLEKHLEYWISQIRSAKMDVMLQEIQSLRNKEGVLKNTNKYLLEKIEENNNSILDANFAVMETNYSYPLTMPSEIFQF

SEQ ID NO: 105 - DNA, 914 bp, Arabidopsis thaliana
  G148,family:MADS
aaagaagagagagagcgagtgagagatgggaagaggcaaagtggaagtgaagagaattgagaacaagatcactagacaagtaaccttctccaaaagaaaaagtggtttgctcaagaaagcctacgaactctctgttctttgtgatgcagaggtttctctcataatcttctccaccggtggcaagctctacgagttcagcaatgtcggagttggcagaaccattgagaggtactatcgctgtaaagacaatcttttggacaatgatacgcttgaagatactcagggcttgcgtcaagaggtgacaaagctcaaatgcaaatacgaatctcttcttcgcactcataggaatttggttggggaagatcttgaagggatgagtataaaggaattgcagacgctggagagacagcttgaaggagctctttccgcaacccgaaaacaaaagacgcaggttatgatggaacaaatggaagagcttcggagaaaggagagggagctcggagatataaacaataagctaaagcttgagacagaagatcatgattttaaaggctttcaagacctactgcttaacccggtgctcaccgccggttgttccactgatttttccttgcaatcaactcatcaaaattatatatcggattgcaaccttggatattttttacagattgggtttcaacaacactatgagcaaggtgaaggatcttcggtgacaaagagtaatgcaagaagtgatgctgagaccaactttgtccaatgatgggtttcgttgtcttggtttggactcattgagtcacgacgaagcgtttaggtcatttactatcgggacatactcttttttttttttttttctttttttttttcacaagacatactcttttctttaatttcaattatttgttagagttctcgtt

SEQ ID NO: 106 - protein, 244 aa, Arabidopsis thaliana
  G148,MADS domain coordinates 1-57
MGRGKVEVKRIENKITRQVTFSKRKSGLLKKAYELSVLCDAEVSLIIFSTGGKLYEFSNVGVGRTIERYYRCKDNLLDNDTLEDTQGLRQEVTKLKCKYESLLRTHRNLVGEDLEGMSIKELQTLERQLEGALSATRKQKTQVMMEQMEELRRKERELGDINNKLKLETEDHDFKGFQDLLLNPVLTAGCSTDFSLQSTHQNYISDCNLGYFLQIGFQQHYEQGEGSSVTKSNARSDAETNFVQ

SEQ ID NO: 107 - DNA, 921 bp, Arabidopsis thaliana
  G151,family:MADS
atgggtcgtggaaaaatcgagataaagaggatcgagaatgcgaatagcagacaagtcactttttccaagaggcgttctgggttacttaagaaagctcgtgagctctctgttctttgtgatgctgaagttgctgtcatcgtcttctctaagtctggcaagctcttcgagtactccagtactggaatgaagcaaacactttccagatacggtaatcaccagagttcttcagcttctaaagcagaggaggattgtgcagaggtggatattttaaaggatcaactttcaaagcttcaagagaaacatttacaactgcagggcaagggcttgaatcctctgacctttaaagagctgcaaagccttgagcagcaactatatcatgcattgattactgtcagagagcgaaaggaacgattgctgactaaccaacttgaagaatcacgcctcaaggaacaacgagcagagttggaaaacgagaccttgcgtagacaggttcaagaactgaggagctttctcccgtcgttcacccactatgttccatcctacatcaaatgctttgctatagatccaaagaacgctctcataaaccacgacagtaaatgcagcctccagaacaccgattcagacacaactttgcaattagggttgccgggagaggcacatgatagaaggacgaatgaaggagaaagagagagcccgtcaagcgattcagtgacaacaaacacgagcagcgaaactgcagaaagaggggatcagtctagtttagcaaattctccacctgaagccaaaagacaaaggttctctgtttagtcctagaaaagtatgggagaaggctactaatgtttcctctttagcaagtatccgattgttttaaaagtaattttagagggatacttgcaaaaagaagagaagattcagttatct

SEQ ID NO: 108 - protein, 268 aa, Arabidopsis thaliana
  G151,MADS domain coordinates 2-57
MGRGKIEIKRIENANSRQVTFSKRRSGLLKKARELSVLCDAEVAVIVFSKSGKLFEYSSTGMKQTLSRYGNHQSSSASKAEEDCAEVDILKDQLSKLQEKHLQLQGKGLNPLTFKELQSLEQQLYHALITVRERKERLLTNQLEESRLKEQRAELENETLRRQVQELRSFLPSFTHYVPSYIKCFAIDPKNALINHDSKCSLQNTDSDTTLQLGLPGEAHDRRTNEGERESPSSDSVTTNTSSETAERGDQSSLANSPPEAKRQRFSV

SEQ ID NO: 109 - DNA, 959 bp, Arabidopsis thaliana
  G152,family:MADS
cctagaacgcaccaagatctaaaggaagatcaaaatagggtttaaattaatggggagagggaagattgtgatccagaagatcgatgattccacgagtagacaagtcactttctccaaaagaagaaagggtctcatcaagaaagctaaagaacttgctattctctgcgacgccgaggtctgtctcatcattttctccaacactgacaagctctatgactttgccagctccagtgtgaaatctactattgaacgattcaatacggctaagatggaggagcaagaactaatgaaccctgcatcagaagttaagttttggcagagagaggctgaaactctaaggcaagaattgcactcattgcaagaaaattatcggcaactaacgggagtggaattaaatggtttgagcgttaaggagttacaaaacatagagagtcaacttgaaatgagtttacgtggaattcgtatgaaaagggaacaaattttgaccaatgaaattaaagagctaaccagaaagaggaatcttgttcatcatgaaaacctcgaattgtcgagaaaagtacaaaggattcatcaagaaaatgtcgaactatacaagaaggcttatggaacgtcgaacacaaatggattgggacatcatgagctagtagatgcagtttatgaatcccatgcacaggttaggctgcagctaagccagcctgagcagtcccattataagacatcttcaaacagctaagatcatataagagatatataacaaattgttcgttcttgattatctcaaaaccctttcaaatatatatacgtgcatattatatatgaagactcgtttgactatgtcaatatatatgttttcatgcaggagtaagtgtgagtgtaatcatgtcggagagcaaaccaaaggtttgatttgtacgatatatacttatatatggtctcaagtgaaagcaatggaacagctt

SEQ ID NO: 110 - protein, 227 aa, Arabidopsis thaliana
  G152,MADS domain coordinates 2-57
MGRGKIVIQKIDDSTSRQVTFSKRRKGLIKKAKELAILCDAEVCLIIFSNTDKLYDFASSSVKSTIERFNTAKMEEQELMNPASEVKFWQREAETLRQELHSLQENYRQLTGVELNGLSVKELQNIESQLEMSLRGIRMKREQILTNEIKELTRKRNLVHHENLELSRKVQRIHQENVELYKKAYGTSNTNGLGHHELVDAVYESHAQVRLQLSQPEQSHYKTSSNS

SEQ ID NO: 111 - DNA, 1098 bp, Arabidopsis thaliana
  G153,family:MADS
aaaaaaaagaagcttctcctcttcctctgccttcttctttccatttattgcaaaccctgatcaattggttttggtgttagtcttttggggagagagatggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcaaaaaggatcaacttatgacaaatgaaatcagagaacttaatcgtaagggacaaatcatccaaaaagagaatcacgagctacaaaatattgtagatataatgcgtaaggaaaatattaaattgcaaaagaaggttcatggaagaacaaatgcgattgaaggcaattcaagtgtagatccaataagcaatggaaccacaacatatgcaccaccgcaacttcaactcatacaactacaaccagctcctagagaaaaatcaatcagactagggctacaactttcctagcaaaacatgtgggacatcgaacaatatacgaaaagagtttgtatgtcatcttcagtaacaaccaagctggatcatttcattcttggttatgtaattctgtttactactttggagtttaatatgttatatgacaagtttctctttgtcaagttacttgtgtatgtacatcataaaataatgatgtgatgtgagtgccgaacatactagacatcattttaccgtgtgtttttttcgggtacattaaatgtacaaaatccagtctaattggcatttttatacaaaaaaaaaaaaaaaaaa

SEQ ID NO: 112 - protein, 234 aa, Arabidopsis thaliana
  G153,MADS domain coordinates 2-57
MGRGKIVIRRIDNSTSRQVTFSKRRSGLLKKAKELSILCDAEVGVIIFSSTGKLYDYASNSSMKTIIERYNRVKEEQHQLLNHASEIKFWQREVASLQQQLQYLQECHRKLVGEELSGMNANDLQNLEDQLVTSLKGVRLKKDQLMTNEIRELNRKGQIIQKENHELQNIVDIMRKENIKLQKKVHGRTNAIEGNSSVDPISNGTTTYAPPQLQLIQLQPAPREKSIRLGLQLS

SEQ ID NO: 113 - DNA, 985 bp, Arabidopsis thaliana
  G154,family:MADS
ctctacctatacatacacaaaccctttatcctcgaaagcttcctcctggttaggtttttatcaaacccttttagccaatcgggaaattaactaaagaagaagatatggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtgatctccactcaacaaaaaaaacaaaaaaacaaactaagtaaaaacaggtttagcagtactgagagtgtataaggacaagtaacaaaactctaaagctgcttctctcttgttgtcttatttctctctcactctctctctctcagtcacttctttaatgattctgaactgcttgtgttatgtatctatgttcttacacttgcctctctagaatgtaattttgattatgttttgttttca

SEQ ID NO: 114 - protein, 214 aa, Arabidopsis thaliana
  G154,MADS domain coordinates 2-57
MVRGKTQMKRIENATSRQVTFSKRRNGLLKKAFELSVLCDAEVSLIIFSPKGKLYEFASSNMQDTIDRYLRHTKDRVSTKPVSEENMQHLKYEAANMMKKIEQLEASKRKLLGEGIGTCSIEELQQIEQQLEKSVKCIRARKTQVFKEQIEQLKQKEKALAAENEKLSEKWGSHESEVWSNKNQESTGRGDEESSPSSEVETQLFIGLPCSSRK

SEQ ID NO: 115 - DNA, 1058 bp, Arabidopsis thaliana
  G155,family:MADS
cccagagagacataagaaagaaagagagagagagatactttggtcatttcagggttgtcgtttctctctcttgttcttgagattttgaagagagagagatatgggaagaggtagggttcagctgaagaggatagagaacaagatcaataggcaagttactttctcaaagagaaggtctggtttgctcaagaaagctcatgagatctctgttctctgcgatgctgaggttgctctcatcgtcttctcttccaaaggcaaactcttcgaatattccaccgactcttgcatggagaggatacttgaacgctatgatcgctatttatattcagacaaacaacttgttggccgagacgtttcacaaagtgaaaattgggttctagaacatgctaagctcaaggcaagagttgaggtacttgagaagaacaaaaggaattttatgggggaagatcttgattcgttgagcttgaaggagcttcaaagcttggagcatcagctcgatgcagctatcaagagcattaggtcaagaaagaaccaagctatgttcgaatccatatctgcgctccagaagaaggataaagccttgcaagatcacaacaattcgcttctcaaaaagattaaggagagggagaagaaaacgggtcagcaagaaggacaattagtccaatgctccaactcttcttcagttcttctgcctcaatactgcgtaacctcctccagagatggctttgtggagagagttgggggagagaacggtggtgcatcgtcgttgacggaaccaaactctctgcttccggcttggatgttacgtcctaccactacgaacgagtagaactatctcactctttataatataatgataatataattaatgtttaatattttcataacattcagcatttttttggtgacttatactcattattaataccgatatgttttagctagtcatattatatgtatgatggaactccgttgtcgagacgtatgtacgtaagctatcattagattcactgcgtcttaagaacaaagattcatatcttggtaatgatttctcatga

SEQ ID NO: 116 - protein, 242 aa, Arabidopsis thaliana
  G155,MADS domain coordinates 1-57
MGRGRVQLKRIENKINRQVTFSKRRSGLLKKAHEISVLCDAEVALIVFSSKGKLFEYSTDSCMERILERYDRYLYSDKQLVGRDVSQSENWVLEHAKLKARVEVLEKNKRNFMGEDLDSLSLKELQSLEHQLDAAIKSIRSRKNQAMFESISALQKKDKALQDHNNSLLKKIKEREKKTGQQEGQLVQCSNSSSVLLPQYCVTSSRDGFVERVGGENGGASSLTEPNSLLPAWMLRPTTTNE

SEQ ID NO: 117 - DNA, 947 bp, Arabidopsis thaliana
  misc_feature (924)..(925): n is a, c, g, or t
  misc_feature (929)..(929): n is a, c, g, or t
  misc_feature (932)..(933): n is a, c, g, or t
  G156,family:MADS
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactctttctttatggagacagattcatgaacttttattacctatattttgataagccagtgtcttcttttgtgtggctatggaaaccttgtttaaagcacaatgcacttgagttcttggttatataattaatcatcattattacatannaaanaannaaaaaaaaaaaaaa

SEQ ID NO: 118 - protein, 238 aa, Arabidopsis thaliana
  G156,MADS domain coordinates 2-57
MGRGKIEIKKIENQTARQVTFSKRRTGLIKKTRELSILCDAHIGLIVFSATGKLSEFCSEQNRMPQLIDRYLHTNGLRLPDHHDDQEQLHHEMELLRRETCNLELRLRPFHGHDLASIPPNELDGLERQLEHSVLKVRERKRRMLEEDNNNMYRWLHEHRAAMEFQQAGIDTKPGEYQQFIEQLQCYKPGEYQQFLEQQQQQPNSVLQLATLPSEIDPTYNLQLAQPNLQNDPTAQND

SEQ ID NO: 119 - DNA, 883 bp, Arabidopsis thaliana
  G157,family:MADS
gggcataacccttatcggagatttgaagccatgggaagaagaaaaatcgagatcaagcgaatcgagaacaaaagcagtcgacaagtcactttctccaaacgacgcaatggtctcatcgacaaagctcgacaactttcgattctctgtgaatcctccgtcgctgttgtcgtcgtatctgcctccggaaaactctatgactcttcctccggtgacgacatttccaagatcattgatcgttatgaaatacaacatgctgatgaacttagagccttagatcttgaagaaaaaattcagaattatcttccacacaaggagttactagaaacagtccaaagcaagcttgaagaaccaaatgtcgataatgtaagtgtagattctctaatttctctggaggaacaacttgagactgctctgtccgtaagtagagctaggaaggcagaactgatgatggagtatatcgagtcccttaaagaaaaggagaaattgctgagagaagagaaccaggttctggctagccagatgggaaagaatacgttgctggcaacagatgatgagagaggaatgtttccgggaagtagctccggcaacaaaataccggagactctcccgctgctcaattagccaccatcatcaacggctgagttttcaccttaaactcaaagcctgattcataattaagagaataaatttgtatattataaaaagctgtgtaatctcaaaccttttatcttcctctagtgtggaatttaaggtcaaaaagaaaacgagaaagtatggatcagtgttgtacctccttcggagacaagatcagagtttgtgtgtttgtgtctgaatgtacggattggatttttaaagttgtgctttctttcttcaaaaaaaaaaa

SEQ ID NO: 120 - protein, 196 aa, Arabidopsis thaliana
  G157,MADS domain coordinates 2-57
MGRRKIEIKRIENKSSRQVTFSKRRNGLIDKARQLSILCESSVAVVVVSASGKLYDSSSGDDISKIIDRYEIQHADELRALDLEEKIQNYLPHKELLETVQSKLEEPNVDNVSVDSLISLEEQLETALSVSRARKAELMMEYIESLKEKEKLLREENQVLASQMGKNTLLATDDERGMFPGSSSGNKIPETLPLLN

SEQ ID NO: 121 - DNA, 1414 bp, Arabidopsis thaliana
  G158,family:MADS
gatctgggtattatagattgcagattctggaaacgtattatgttaatgattcatttcaagttttgattttttgtgttggattgaagagaagaatagtttattgatgttttgtgaagaagaagaagaagagattttgattttggtttaatatatagttggggattaacaggatgggaagggtaaaattgaagataaagaagttagagaacacaaatggacgccaatctacatttgctaaaaggaaaaatgggatcttgaaaaaggctaatgagctatctattctttgtgacattgatattgttcttcttatgttctctcctactggcaaggctgcaatatgttgcggtacacgaagatgtttctctttcgaaagctcagaacttgaagaaaactttccaaaagttggatcacgatgtaaatatacgcgaatttatagcctcaaggacttgagtactcaagcaaggattctgcaggctcggatttctgagatacatggaagattaagttattggacggaaccagataagattaacaatgttgaacacttgggacagctcgaaatttcgattaggcaatcccttgatcaattgcgtgcacacaagatgcaagatgggattcagattcctttagaacaacagcttcaatctatgtcatggattcttaatagcaacaccaccaacattgtcaccgaggaacacaattcaatcccgcagagggaagtcgagtgctcagcgagttcttcattcgggagctatccaggctactttggaacagggaaatctcctgaaatgacaattccgggtcaagaaacaagctttcttgatgaactaaacaccggacagctgaaacaggacacaagctcgcagcagcagttcactaataataataatatcacagcatacaatcccaatcttcacaatgatatgaatcatcaccaaacgttgcctcctcctcctcttcctcttactcttccgcatgctcaggtgtatattccaatgaatcagagagagtatcatatgaatggattctttgaagcaccaccacctgattcttctgcttacaacgacaacaccaaccaaaccaggtttggttctagcagcagctccttgccttgctcaatctcaatgttcgacgaatacttgttttcccagatgcagcagccgaactgagagagatttgatgaatgatgataaaacatctcactgaagaaactcaaaccaatattttttttcagaaacagcaagaaagctaaaactctgccgatttctgaattggttccaagaagaaaaaaaccagtggtaatccctggtagattgtgcaaccaaaccacacacaatacgtgttcatttattttttctatatcttcaatagatgtcacttaattcttttctatacataatttctcagtcagaat

SEQ ID NO: 122 - protein, 332 aa, Arabidopsis thaliana
  G158,MADS domain coordinates 2-57
MGRVKLKIKKLENTNGRQSTFAKRKNGILKKANELSILCDIDIVLLMFSPTGKAAICCGTRRCFSFESSELEENFPKVGSRCKYTRIYSLKDLSTQARILQARISEIHGRLSYWTEPDKINNVEHLGQLEISIRQSLDQLRAHKMQDGIQIPLEQQLQSMSWILNSNTTNIVTEEHNSIPQREVECSASSSFGSYPGYFGTGKSPEMTIPGQETSFLDELNTGQLKQDTSSQQQFTNNNNITAYNPNLHNDMNHHQTLPPPPLPLTLPHAQVYIPMNQREYHMNGFFEAPPPDSSAYNDNTNQTRFGSSSSSLPCSISMFDEYLFSQMQQPN

SEQ ID NO: 123 - DNA, 1132 bp, Arabidopsis thaliana
  G159,family:MADS
tcataattttgtttcttataaatcactatagaaaaaaatattttctttcaatgctcaaaacatattttgtaaaatttagtctataaatacaaatacctattatctctaatataatcaactcgcttttctttttctgttcaaaacatctcgaaaatggcgagaaagaatcttggtcgtagaaaaatagagttggtaaaaatgaccaacgaatcaaaccttcaagttacgttttcaaaaagaagatctggtcttttcaaaaaaggcagtgaactttgcaccttatgtgacgcggaaattgcgataatcgtgttttcaccctcgggaaaagcatactcttttggtcatccaaatgttaacaagttacttgaccactctttagggcgtgttataagacacaacaacacaaactttgctgaaagccgcacaaagctccgtattcaaatgctcaatgagtctttaactgaggtgatggctgaaaaagaaaaagaacaagagaccaagcagtcaatagtccaaaatgaaagagagaacaaggacgctgagaagtggtggaggaactctccaacagaactcaacttagctcaatcaacttccatgaaatgtgatcttgaagctttgaagaaggaagttgatgaaaaagtcgctcaacttcatcatagaaacctaaacttctatgttggaagttctagcaatgttgctgctccagcagctgttagtggtggtaatatctccacaaaccatggtttctttgatcaaaacggaaactctacttctgctccaacactgccgtttggatttaatgttatgaatcgcacaccagctgggtacaacagttaccaactccaaaaccaggaggttaaacaagtccatcctcagtattgggctcgttactattagtctatctctctcgttgtgtgactttttaagtctccaatagtttgttctgctttttgttttgtttttgtttgttgttgttgttgttgtcgggcttttaattaagtctcgagtcaactagtttcttgtttcttttcgttatactttgtcttgtagctttatatcattttcttgtggaatatgagtaagctatatgaagtttcatattaaaaaaaaaaaaaaaaaaaaaaaaaaaaaa

SEQ ID NO: 124 - protein, 247 aa, Arabidopsis thaliana
  G159,MADS domain coordinates 7-61
MARKNLGRRKIELVKMTNESNLQVTFSKRRSGLFKKGSELCTLCDAEIAIIVFSPSGKAYSFGHPNVNKLLDHSLGRVIRHNNTNFAESRTKLRIQMLNESLTEVMAEKEKEQETKQSIVQNERENKDAEKWWRNSPTELNLAQSTSMKCDLEALKKEVDEKVAQLHHRNLNFYVGSSSNVAAPAAVSGGNISTNHGFFDQNGNSTSAPTLPFGFNVMNRTPAGYNSYQLQNQEVKQVHPQYWARYY

SEQ ID NO: 125 - DNA, 1133 bp, Arabidopsis thaliana
  misc_feature (1131)..(1131): n is a, c, g, or t
  G161,family:MADS
tatattttagcttctcaaatatcactaaaaatggtgaaaaaaagcaaaggtcgtcaaaaaatagagatggtcaaaatgaaaaatgaaagtaaccttcaagttactttttcaaaaagaagatctggacttttcaaaaaggctagtgagctttgcacactttgtggtgcagaagtggccatagttgtgttctcacctggtcgaaaagtcttttcttttggtcatccaaatgttgattctgtaattgatcgattcataaacaataaccctctacctcctcaccaacacaacaacatgcaacttagagaaactcgtcgaaattcgattgttcaggatctgaataatcatcttactcaggtgttgagtcaattagaaacagagaaaaagaagtacgacgagttaaagaaaataagagaaaagacaaaagcccttgggaattggtgggaagatcccgttgaggaacttgcgttatctcaactcgaggggttcaaaggtaatcttgaaaatttgaagaaagtagttacagtcgaagcttccagattttttcaggcaaatgttccaaacttctatgtgggaagttctagtaataatgctgcttttgggattgatgatggtagtcatatcaaccctgatatggatctctttagccaaagaagaatgatggacataaatgccttcaactacaaccagaaccaaattcaccctaatcatgcattaccaccctttggaaacaatgcttatggtattaatgaagggtttgttccagaatacaatgtgaacttcagaccagagtataacccaaaccaaaaccaaatccaaaaccaaaatcaagttcaaatccaaatccaaaaccagagttttaagagagaaaacatctctgaatatgaacatcatcatggttatcctccccagtctagatctgattactattaaccctttgttgtgtgatccaacttaagtctctagacaaaaagttgtgtgtttaggttatctttatttcttcttatttatgtttctacatgtgttgttgttgtttttcttgttcttgtttaagtattatgttgtattgtgttgtttcatttcaaaattatgttattgctatatataaattatatgtgtcggaaacaaaaaaanaa

SEQ ID NO: 126 - protein, 299 aa, Arabidopsis thaliana
  G161,MADS domain coordinates 6-62
MVKKSKGRQKIEMVKMKNESNLQVTFSKRRSGLFKKASELCTLCGAEVAIVVFSPGRKVFSFGHPNVDSVIDRFINNNPLPPHQHNNMQLRETRRNSIVQDLNNHLTQVLSQLETEKKKYDELKKIREKTKALGNWWEDPVEELALSQLEGFKGNLENLKKVVTVEASRFFQANVPNFYVGSSSNNAAFGIDDGSHINPDMDLFSQRRMMDINAFNYNQNQIHPNHALPPFGNNAYGINEGFVPEYNVNFRPEYNPNQNQIQNQNQVQIQIQNQSFKRENISEYEHHHGYPPQSRSDYY

SEQ ID NO: 127 - DNA, 826 bp, Arabidopsis thaliana
  G162,family:MADS
agacatacaacaccaaaatcttcttcttcaccaacatattcactttcacagcaaaaaaaaacgagaggttctctcttattcgtaccgttttagcaaacaaatgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatagctagaccgacttgttagagttacattctattttttgtatcagcctacagaacttaccaacacatgaaagttattgctggtgtagaattttctgtcatctatggggtgtgactttctatttgacatcaaatgaaaatgtacctggaaatttgtctgtattaatctcaagtgtacttgctaaacttgatcagctttttcgcaaaaaaaa

SEQ ID NO: 128 - protein, 172 aa, Arabidopsis thaliana
  G162,MADS domain coordinates 2-57
MGRRKIKMEMVQDMNTRQVTFSKRRTGLFKKASELATLCNAELGIVVFSPGGKPFSYGKPNLDSVAERFMREYDDSDSGDEEKSGNYRPKLKRLSERLDLLNQEVEAEKERGEKSQEKLESAGDERFKESIETLTLDELNEYKDRLQTVHGRIEGQVNHLQASSCLMLLSRK

SEQ ID NO: 129 - DNA, 993 bp, Arabidopsis thaliana
  G168,family:MADS
atggggatgaagaaggtaaagctatctttgatagctaatgaaatatcaagggaaacatccttcatgaagaggaaaaatgggataatgaagaaactctacgagttgtcaactctatgtggtgtccaagcttgtactctcatctacagtccattcattccggttccagagtttctggagatgtcgccgacagcccgaacaaggaagatgatgaatcaagaaacgtatctaatggagaggattaccaaagcaaaagagcaactacagaacctggttggtgcgaaccaagagttacagtatcgttatgatgcaaaagaccttcaagatttgttatcttgtataaatctatatctcgatcagcttaacggaaggatcgagatccttaaagaacacggtgactcgttgccttccgtctctccttttcctactagaattggtgttgaagaaactggtgatgagtcgtcttccgactctcctattcttgctacaactggggttgtagatactcctaatgctacaaatcctcgtgttcttgtggccgatacgactcattttcttgatgcgaatgcaactgcggtaactgctccctttggattttctaatcatattcaatataagaatatgaatatgagtcaagatctgcatcgaccgtttcaacaccttgttcctactaacttttgtgatttttttcaaaatcagaatatgaatcaggttcaataccaggctcctcctaatgatatgtttaatcagattcaacgagagttctacaacattaatttgaatcagaaatcaaatcagtatatgaatcaacaacaaccattcatgaatccgatggtggaacaacatatgagtcatgttggagggcgtgagagcattcctttcatggacggaaactactacaactacaatcaactaccagtcgttgatcatggttccacaagttacatgccttccaccaccggtgtttatgatccttacttcaacaataatctctaa

SEQ ID NO: 130 - protein, 330 aa, Arabidopsis thaliana
  G168,MADS domain coordinates 1-57
MGMKKVKLSLIANEISRETSFMKRKNGIMKKLYELSTLCGVQACTLIYSPFIPVPEFLEMSPTARTRKMMNQETYLMERITKAKEQLQNLVGANQELQYRYDAKDLQDLLSCINLYLDQLNGRIEILKEHGDSLPSVSPFPTRIGVEETGDESSSDSPILATTGVVDTPNATNPRVLVADTTHFLDANATAVTAPFGFSNHIQYKNMNMSQDLHRPFQHLVPTNFCDFFQNQNMNQVQYQAPPNDMFNQIQREFYNINLNQKSNQYMNQQQPFMNPMVEQHMSHVGGRESIPFMDGNYYNYNQLPVVDHGSTSYMPSTTGVYDPYFNNNL

SEQ ID NO: 131 - DNA, 946 bp, Arabidopsis thaliana
  G172,family:MADS
aacattatgccttcatctgattccacgatgatgaagaaaggaacaaagcgcaaaatcgaaataaagaaacgagaaaccaaagagcaacgagccgtgacttgctctaaacgccgtcaaactgttttttccaaagccgccgatctctgtcttatctccggtgctaacatcgccgtcttcgtaacctctccctccgatagttccgatgttgtctattccttctccggttactcctctgcctacgaaatcgctgattgttacctaaatcgcaagcctccacccaagattgttaacccggccggatccaaactaggattttggtgggaagaccctgatctctaccattcgtgtgatgatctctctgagttaagcattatcgaggatcgtttacagagaatgaagaagcatgtgatggcttgccttgagaaggaagaaaaatctcaacttgtttctagtttcgaccaaaaccctaatagtacttgttctctcgacgtcgaggattgtgatggatcttcttattcgcaaattgcttctacttttactccaaactctgtcaacgagtattgcagcgatcaaaccttttcttctttccatggcgatcaaaaccctaacctctcgtctccgtcttttgatcaggactgttactcctctctctatcagatctgtggagaatcatcttcacaagttgcttcttttgatcaaaaccctagctccgagatccaaggatttgaaacagaggaagagattaaccaaatcaatctactactacaagaaacacaaacagaggccaatgtcaatttggatgatgagatctgcttttggaatgatctatccaacgatgatgtgtttggtctaaacagctacttcggtctcgataacaccaatgcaatgatcaacttcggagattccgactttagacgtcatgtctgatatgatgtggttgtaatct

SEQ ID NO: 132 - protein, 306 aa, Arabidopsis thaliana
  G172,MADS domain coordinates 12-68
MPSSDSTMMKKGTKRKIEIKKRETKEQRAVTCSKRRQTVFSKAADLCLISGANIAVFVTSPSDSSDVVYSFSGYSSAYEIADCYLNRKPPPKIVNPAGSKLGFWWEDPDLYHSCDDLSELSIIEDRLQRMKKHVMACLEKEEKSQLVSSFDQNPNSTCSLDVEDCDGSSYSQIASTFTPNSVNEYCSDQTFSSFHGDQNPNLSSPSFDQDCYSSLYQICGESSSQVASFDQNPSSEIQGFETEEEINQINLLLQETQTEANVNLDDEICFWNDLSNDDVFGLNSYFGLDNTNAMINFGDSDFRRHV

SEQ ID NO: 133 - DNA, 443 bp, Arabidopsis thaliana
  G173,family:MADS
agaagaaaccaaacttgtctatgagagaagatacaatgtttaagaaagccctcgagctttcaactctgtgcgatatcgaagtctgtgtcatactttatagtcgtgacggagaactcatcaagacatggccggaggatcaatccaaggttcgagacatggcagagaggtttagcaaactacacgagagagagcgacgcaagaaaagaaccaacctttctctgtttctacgtaagaagatcctcgacaacagtaagctctcggagaaagtcttagagatgaaggattcattagaaagtggtctacgggtactacaagataagcttctgttactacaacccgagaaaaaccagaccgagttaggtcagatccccgtcatcaacaatggacagaaccattggtgaatatcggtgtgtcaaacacagagcaagacctatcgacgtcac

SEQ ID NO: 134 - protein, 126 aa, Arabidopsis thaliana
  G173,MADS domain coordinates 1-57
MREDTMFKKALELSTLCDIEVCVILYSRDGELIKTWPEDQSKVRDMAERFSKLHERERRKKRTNLSLFLRKKILDNSKLSEKVLEMKDSLESGLRVLQDKLLLLQPEKNQTELGQIPVINNGQNHW

SEQ ID NO: 135 - DNA, 2217 bp, Arabidopsis thaliana
  misc_feature (2192)..(2192): n is a, c, g, or t
  G175,family:WRKY
atttctaaaaatagttaaactgttggtgatttttgtggaactgattaattaacacaattggagaaaacaaattgaaacttttttgtttgttagagagttaaggagaaattttatctaaccaagctgtgtaaatctcttgtagtttttctgccgatatacattttcattgtgttgagggtaaacgataatcaagaacgagagagagagagagcaagagcaagagatttctactacagaagatttattatattgatcattttgtgtgatcaacccataaaaacagagagacatagacaagtccatgtttcgatgtttcgatctctcttactgtctaaacggcgaaataaaaagtctgatgggtgtcacttattgcatgtatattagtaaatcagcttgagcccaagttaaagctgaaacttgggtttgcaatggctggtattgataataaagctgctgtaatgggagaatggttcgactgtagtactactaaccacaggaagagatcgaaagcggaacttggtagagagttttctttaaattacatcaagaatgaggattctttgcaaaccacctttcaagaaagttcacgaggagctcttcgtgaaaggattgctgcgagatccgggtttaatgcaccgtggttaaacactgaggatattcttcagtcgaaatctttaaccatctcttctcctggtcttagtcctgcaactctgttagagtctcctgttttcctctcaaaccctttgctatctccaacaaccgggaagctctcatcagtaccttctgataaggctaaagctgagttatttgacgacattaccacatccttagccttccaaaccatttcaggaagtggccttgatcctactaacatcgctttagaacccgatgattcccaagactatgaagaaagacagctcggcggtttaggagactcgatggcttgttgtgcacctgcagatgatggatacaactggagaaaatatggacaaaagctagttaaaggaagtgagtatccgcggagctattacaagtgcacgcacccgaattgtgaggccaagaagaaggttgaacggtctcgggaaggtcatattatagagatcatatacacaggagatcatatacacagcaaacctccacctaaccgccggtcagggattggatcatccggtactggccaagacatgcaaatagatgcaaccgaatacgaaggttttgctggaaccaatgagaacatagaatggacatcacctgtatctgcagagctcgaatacggaagccattcaggatcaatgcaggttcaaaacgggactcatcagttcgggtatggtgatgcagcagctgatgccttatatagagatgaaaacgaagatgatcgcacgtcccacatgagtgtttccctgacttacgatggagaggtagaagagtccgaatcaaagagaaggaaactagaagcttatgcaacagaaacgagtggatcaaccagagccagccgtgagccaagagttgtggtgcagaccacaagtgacattgacatcctcgatgatggttatcgctggcgcaagtatgggcaaaaagtcgttaaaggaaacccgaatccaaggagctactataaatgcacagctaatggatgtaccgtaacgaagcatgtagagagagcctctgatgacttcaagagcgtactaacaacttatataggcaagcacacccacgttgtaccagcagcacgcaacagcagccacgtcggtgcaggcagttcagggactctccaaggcagtttagcgactcagacccacaaccacaatgtgcactatccaatgccacacagtagatctgagggactggccacagccaactcatctctatttgacttccagtcacacctgaggcatcctacaggtttctccgtttacataggccaatctgagctttctgatctttcaatgcctggtctaactattgggcaagagaagcttaccagcctgcaggcgcctgacattggggatccaactggcctaatgttgcagttagcagcacagccgaaggtggaaccagtgtcaccacaacagggacttgatttgtcagcgagctcattgatatgcagagagatgttgagtagattacgacagatatgaaacaaatctctttgttcactgattgctcaaatttttgaataaatgaaaaattgaganaaaaaaaaaaaaaaaaaaaaaaaaa

SEQ ID NO: 136 - protein, 568 aa, Arabidopsis thaliana
  G175,WRKY domain coordinates 178-234,372-428
MAGIDNKAAVMGEWFDCSTTNHRKRSKAELGREFSLNYIKNEDSLQTTFQESSRGALRERIAARSGFNAPWLNTEDILQSKSLTISSPGLSPATLLESPVFLSNPLLSPTTGKLSSVPSDKAKAELFDDITTSLAFQTISGSGLDPTNIALEPDDSQDYEERQLGGLGDSMACCAPADDGYNWRKYGQKLVKGSEYPRSYYKCTHPNCEAKKKVERSREGHIIEIIYTGDHIHSKPPPNRRSGIGSSGTGQDMQIDATEYEGFAGTNENIEWTSPVSAELEYGSHSGSMQVQNGTHQFGYGDAAADALYRDENEDDRTSHMSVSLTYDGEVEESESKRRKLEAYATETSGSTRASREPRVVVQTTSDIDILDDGYRWRKYGQKVVKGNPNPRSYYKCTANGCTVTKHVERASDDFKSVLTTYIGKHTHVVPAARNSSHVGAGSSGTLQGSLATQTHNHNVHYPMPHSRSEGLATANSSLFDFQSHLRHPTGFSVYIGQSELSDLSMPGLTIGQEKLTSLQAPDIGDPTGLMLQLAAQPKVEPVSPQQGLDLSASSLICREMLSRLRQI

SEQ ID NO: 137 - DNA, 724 bp, Arabidopsis thaliana
  G179,family:WRKY
gtctttctctccctcccctccttggcttttttcaagttcccaccataaacgcagagggagttaagaaatggaggataggaggtgtgatgtgttgtttccatgttcatcatcggttgatcctcgcttgacagagtttcatggggtcgacaactctgctcagccgacaacatcatccgaagagaagccaaggagtaagaagaagaagaaagagagagaagcgaggtacgcgttccagacaagaagccaggttgatatactggatgatggatacaggtggaggaagtacggccaaaaagcagtcaagaacaatccattccccaggagctattataagtgcacagaagaaggatgcagagtgaagaagcaagtgcagaggcaatggggagacgaaggagtggtggtgacgacataccaaggtgttcatacacatgccgttgataaaccctctgataatttccaccacatcttgacacaaatgcacatcttccctcccttttgcttgaaggaatgattagaggaattggattgtaatatttactttcccaaaaacgttgggctcacaccatcagacctttacttttaaactagcagcaactcacatatctcaaaaatactaatccttatctttgtctttatgggacctttgaatccatctgctttggtgtcttagtctcggctgccctgtaatcgaaagtatattcatcatcaaattaccaaacataaa

SEQ ID NO: 138 - protein, 147 aa, Arabidopsis thaliana
  G179,WRKY domain coordinates 65-121
MEDRRCDVLFPCSSSVDPRLTEFHGVDNSAQPTTSSEEKPRSKKKKKEREARYAFQTRSQVDILDDGYRWRKYGQKAVKNNPFPRSYYKCTEEGCRVKKQVQRQWGDEGVVVTTYQGVHTHAVDKPSDNFHHILTQMHIFPPFCLKE

SEQ ID NO: 139 - DNA, 837 bp, Arabidopsis thaliana
  G180,family:WRKY
gtaattacgatctacaacaagtgacatcgtcgtcgacgacgattcaagagaatatgaacttcctcgttccttttgaagaaaccaatgtcttaacctttttctcttcttcttcttcctcttctctttcttctccttctttccccattcacaactcttcctccactactactactcatgcacctctagggttttctaataatcttcagggtggaggacccttgggatcaaaggtggttaatgatgatcaggagaattttggaggtggaactaacaatgatgctcattctaattcttggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattgacattggtagttcatttctgttcaaacaaaaaaaaaaaaaaa

SEQ ID NO: 140 - protein, 191 aa, Arabidopsis thaliana
  G180,WRKY domain coordinates 118-174
MNFLVPFEETNVLTFFSSSSSSSLSSPSFPIHNSSSTTTTHAPLGFSNNLQGGGPLGSKVVNDDQENFGGGTNNDAHSNSWWRSNSGSGDMKNKVKIRRKLREPRFCFQTKSDVDVLDDGYKWRKYGQKVVKNSLHPRSYYRCTHNNCRVKKRVERLSEDCRMVITTYEGRHNHIPSDDSTSPDHDCLSSF

SEQ ID NO: 141 - DNA, 844 bp, Arabidopsis thaliana
  G181,family:WRKY
aacaatggacagagaagacataaatcctatgttaagccgcctagatgtcgaaaacaacaacaccttctcttcctttgtagacaaaaccctaatgatgatgcctccatcaacattttccggtgaagtggaaccttcatcttcttcttcttggtatccagaaagctttcatgtgcatgcgccgccattaccacctgagaatgatcaaataggtgagaaagggaaggagctgaaagagaagagatcgaggaaagttccaaggattgcgtttcatacgaggagcgatgatgatgttcttgatgatggttatcgttggcgaaaatatgggcagaaatctgtcaagcacaatgctcatcccaggagctattacagatgtacgtaccacacatgcaacgtgaagaaacaagtgcagagattggcaaaagatccaaacgtcgtcgtaacgacctacgaaggcgttcataaccatccttgtgagaagctcatggagactcttaatcctcttctcaggcaactccagttcctctccagtttctctaatctttgaatatataatggcttaattaatggtgtaattacttaaaggtgattaaggtgttaatcaccccactgaccgtttgacgacccacatctcccaagtgacaagtcacaagtgtgtagatcagattttaaaccaatgtaacagttacgactttttacaaatgtttctgaattttatcccctgatttctggttaatgatcggtttacgccgatgatttgacaaataccagacaaaacaagtttagttacatatgtaagtatgaaaaggtagtttcctctaacttcattaaaaaaaaaaaaaaaaaa

SEQ ID NO: 142 - protein, 179 aa, Arabidopsis thaliana
  G181,WRKY domain coordinates 98-154
MDREDINPMLSRLDVENNNTFSSFVDKTLMMMPPSTFSGEVEPSSSSSWYPESFHVHAPPLPPENDQIGEKGKELKEKRSRKVPRIAFHTRSDDDVLDDGYRWRKYGQKSVKHNAHPRSYYRCTYHTCNVKKQVQRLAKDPNVVVTTYEGVHNHPCEKLMETLNPLLRQLQFLSSFSNL

SEQ ID NO: 143 - DNA, 1458 bp, Arabidopsis thaliana
  G183,family:WRKY
atgagtgattttgatgaaaacttcatcgaaatgacgtcgtattgggctccaccatccagtcctagcccaagaacgatattggcaatgctggagcaaaccgacaatggtctgaatccaatcagtgagatcttccctcaagaaagcttgccaagagatcatactgatcaatctggacaaagatctggtcttcgtgagagactggctgcaagagtaggattcaatcttccaacactcaatacagaagaaaacatgagtcctttggatgcatttttcaggagctcgaatgttcctaattctcctgtcgttgcaatctctccaggattcagtccatcagcactattgcatactcccaatatggtcagtgattcttcccagattatccctccgtcttcagccaccaattacggacctctagagatggtggaaacttccggtgaagacaatgcagcgatgatgatgttcaacaacgatcttccttatcagccgtacaatgttgatctgccttctctagaagtctttgatgatattgcaacggaagagtccttttatatcccatcttatgaacctcatgttgacccaattggaactcctttagtcacatcctttgaatctgaactcgttgacgatgcccataccgacatcatctccattgaggacagtgagagcgaggatggaaacaaagatgatgacgacgaggacttccaatacgaagacgaagacgaagaccaatacgaccaagatcaagatgtagatgaagatgaagaggaagaaaaagatgaagacaatgttgcattagatgatcctcaacctccacctccaaagagaaggagatatgaggtatcaaacatgattggagccacaagaacaagcaagacacaaaggatcatacttcagatggaaagcgacgaagacaatcctaacgatggttatcgctggagaaaatacggtcagaaagtcgtcaaaggaaatcctaatccgaggagttacttcaagtgcacaaacatcgagtgcagagtgaaaaaacatgtggagagaggagcagacaatatcaagttggttgtgactacatacgatgggatacacaaccatccttcaccacctgcacgtagaagcaattccagttcaaggaaccggtctgcaggggcaacaatacctcaaaatcagaatgatcgaaccagtcggttaggtagggctcctcctactcctactcctcctactcctcctccttcgtcttacacacctgaggagatgaggcctttctcttcgttggctacagaaattgatctgacagaggtttatatgaccggaatctctatgctgccgaatataccggtttacgagaattcgggttttatgtaccagaatgatgaaccgacgatgaatgcgatgccggatggttcagatgtgtacgatgggatcatggaacgcctgtattttaagtttggtgtcgacatgtag

SEQ ID NO: 144 - protein, 485 aa, Arabidopsis thaliana
  G183,WRKY domain coordinates 307-368
MSDFDENFIEMTSYWAPPSSPSPRTILAMLEQTDNGLNPISEIFPQESLPRDHTDQSGQRSGLRERLAARVGFNLPTLNTEENMSPLDAFFRSSNVPNSPVVAISPGFSPSALLHTPNMVSDSSQIIPPSSATNYGPLEMVETSGEDNAAMMMFNNDLPYQPYNVDLPSLEVFDDIATEESFYIPSYEPHVDPIGTPLVTSFESELVDDAHTDIISIEDSESEDGNKDDDDEDFQYEDEDEDQYDQDQDVDEDEEEEKDEDNVALDDPQPPPPKRRRYEVSNMIGATRTSKTQRIILQMESDEDNPNDGYRWRKYGQKVVKGNPNPRSYFKCTNIECRVKKHVERGADNIKLVVTTYDGIHNHPSPPARRSNSSSRNRSAGATIPQNQNDRTSRLGRAPPTPTPPTPPPSSYTPEEMRPFSSLATEIDLTEVYMTGISMLPNIPVYENSGFMYQNDEPTMNAMPDGSDVYDGIMERLYFKFGVDM

SEQ ID NO: 145 - DNA, 1974 bp, Arabidopsis thaliana
  G184,family:WRKY
tgaattctagcctttttgtaggcgaatcatctggaccggtaagagactctctcatcgataataaccacataatttaatcaaactctttctctctctttctaagatcttttgctttgctcttttcctttttgatcttcctatatatggagaagcaccaaaacggtacttactatacgatactgtacggatccatcaaactggattaattatcaaaacgtacatttttatcttacctggcaagttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagttttcattttgatggtcgatttttttttttgggg

SEQ ID NO: 146 - protein, 536 aa, Arabidopsis thaliana
  G184,WRKY domain coordinates 295-352
MFRFPVSLGGSRDEDRHDQITPLDDHRVVVDEVDFFSEKRDRVSRENINDDDDEGNKVLIKMEGSRVEENDRSRDVNIGLNLLTANTGSDESTVDDGLSMDMEDKRAKIENAQLQEELKKMKIENQRLRDMLSQATTNFNALQMQLVAVMRQQEQRNSSQDHLLESKAEGRKRQELQIMVPRQFMDLGPSSGAAEHGAEVSSEERTTVRSGSPPSLLESSNPRENGKRLLGREESSEESESNAWGNPNKVPKHNPSSSNSNGNRNGNVIDQSAAEATMRKARVSVRARSEAAMISDGCQWRKYGQKMAKGNPCPRAYYRCTMAGGCPVRKQVQRCAEDRSILITTYEGNHNHPLPPAATAMASTTTAAASMLLSGSMSSQDGLMNPTNLLARAILPCSSSMATISASAPFPTITLDLTNSPNGNNPNMTTNNPLMQFAQRPGFNPAVLPQVVGQAMYNNQQQSKFSGLQLPAQPLQIAATSSVAESVSAASAAIASDPNFAAALAAAITSIMNGSSHQNNNTNNNNVATSNNDSRQ

SEQ ID NO: 147 - DNA, 1205 bp, Arabidopsis thaliana
  G185,family:WRKY
atgcaaaaataaacatagtaacaatactttaaactatttacaccactttaatcttattctccactctttgaacgtaatggagaagaaccatagtagtggagagtgggagaagatgaagaacgagatcaacgagctaatgatagaaggaagagactatgcacaccagtttggatcagcttcatctcaagaaacacgtgaacatttagccaaaaagattcttcaatcttaccacaagtctctcaccatcatgaactactccggcgaacttgaccaagtttctcagggtggaggaagccccaagagcgatgattccgatcaagaaccacttgtcatcaagagttcgaagaagtcaatgccaaggtggagttcaaaagtcagaattgcccctggagctggtgttgatagaacgctggacgatggattcagttggagaaagtacggccagaaggatattctcggagccaaatttccaagaggatactatagatgcacgtatagaaagtctcaaggatgtgaagccactaaacaagtccaaagatctgatgaaaatcagatgctccttgagatcagttaccgaggaatacattcttgctctcaagctgcaaatgtcggtacaacaatgccgatacaaaacctcgaaccgaaccagacccaagaacacggaaatcttgacatggtaaaggaaagtgtagacaactacaatcaccaagcacatttgcatcacaaccttcactatccattgtcatctaccccaaatctagagaataacaatgcctatatgcttcaaatgcgagatcaaaacatcgaatattttggatctacgagcttctctagtgatctaggaactagtatcaactacaattttccagcatctggctcggcttctcactcagcatcaaactctccgtccaccgtccctttggaatccccgtttgaaagctatgatccaaatcatccatatggaggatttggtgggttctattcttagttatctacttaagggagggacggaactttttacatgacctcttgattaaagagagagttttcataatagctaatcaatttcctattcaaatatccgagttttttttctaatcatgtttatcaattgtcttattacagaaggcttattttcaggtctatgttgaaataaatggatttgtactcgtaggtatgatccttgttatctaaaaaaaaaaaaa

SEQ ID NO: 148 - protein, 303 aa, Arabidopsis thaliana
  G185,WRKY domain coordinates 113-172
MEKNHSSGEWEKMKNEINELMIEGRDYAHQFGSASSQETREHLAKKILQSYHKSLTIMNYSGELDQVSQGGGSPKSDDSDQEPLVIKSSKKSMPRWSSKVRIAPGAGVDRTLDDGFSWRKYGQKDILGAKFPRGYYRCTYRKSQGCEATKQVQRSDENQMLLEISYRGIHSCSQAANVGTTMPIQNLEPNQTQEHGNLDMVKESVDNYNHQAHLHHNLHYPLSSTPNLENNNAYMLQMRDQNIEYFGSTSFSSDLGTSINYNFPASGSASHSASNSPSTVPLESPFESYDPNHPYGGFGGFYS

SEQ ID NO: 149 - DNA, 1931 bp, Arabidopsis thaliana
  G186,family:WRKY
ctttcaaccaaacccctaaacaaaaaaaaaatacattttctgatctctctaaaaatctttctccttcgttaatctcgtgatctctttctttttctatatatggacagaggatggtctggtctcactcttgattcatcttctcttgatcttttaaaccctaatcgtatttctcataagaatcaccgacgtttctcaaatcctttggcgatgtctagaattgacgaagaagatgatcagaagacgagaatatcaaccaacggtagtgaatttaggtttccggtgagtctctcaggtattcgtgatcgtgaagatgaagatttttcatctggcgttgctggagataatgaccgtgaagttcccggcgaagtggatttcttctccgacaagaaatctagggtttgtcgtgaagacgacgaaggatttcgtgtgaagaaggaagaacaagatgatcgaacggacgtaaataccggtttgaatcttcgaacaactggtaatacaaagagtgatgagtcaatgatcgatgatggagaatcttccgaaatggaagataagcgtgcgaaaaatgagttggtgaaattacaagatgagttgaagaaaatgacaatggataatcaaaagcttagagaattgcttacacaagttagcaacagttacacttcacttcagatgcatcttgtttcactaatgcagcaacagcaacaacagaacaataaggtaatagaagctgctgagaagcctgaggagacgatagtaccaaggcaatttattgatttaggccctacgagagcagtaggtgaggccgaggatgtgtcaaattcttcatccgaagatagaactcgttcggggggttcttctgcagccgagaggcgtagtaacgggaagagacttgggcgtgaagaaagccccgaaactgagtccaacaaaattcagaaggtgaattctactaccccgacgacatttgatcaaaccgctgaagctacgatgaggaaagcccgtgtctccgttcgtgcccgatcggaagctccgatgataagcgatggatgtcaatggagaaaatatggccagaagatggccaaagggaatccttgtccgcgggcatattaccgctgcacgatggccacgggctgtcccgttcgcaaacaagttcaacgttgcgcggaagacagatcaattctgattacaacctacgagggaaaccataaccatccgttgccgccagccgcggtagccatggcttctaccaccacggcggcggctaacatgttgctatccgggtcaatgtctagtcacgacgggatgatgaaccctacaaatttactagctagggctgttcttccttgctccacaagcatggcaacaatctcagcctccgcgccgtttccaaccgtcacattagacctcacccactcacctccgcctcctaatggttccaatccttcctcttccgcggctaccaacaacaaccacaactcactgatgcagcggccgcaacaacaacaacagcaaatgacgaacttacctccgggaatgctacctcatgtaataggccaggcattgtataaccaatccaagttctcggggctgcagttctctggtggctctccctcgacggcagcgttttctcagtcacacgcggtggctgatacaataacggcactcacagctgacccgaatttcacggcggctcttgcagccgttatttcttctatgatcaatggtacgaaccaccacgacggcgaaggaaacaacaaaaatcaatagaaaaatattacattttttttttgggtatctacattttttttccaactgggttataggaaacagagagtttatttcattgattcacatttgttctgtttcgtaccaaaatcccagtaaatatacaaaagcaaactatactcaagttcatattcgtaaacactataaatagt

SEQ ID NO: 150 - protein, 553 aa, Arabidopsis thaliana
  G186,WRKY domain coordinates 312-369
MDRGWSGLTLDSSSLDLLNPNRISHKNHRRFSNPLAMSRIDEEDDQKTRISTNGSEFRFPVSLSGIRDREDEDFSSGVAGDNDREVPGEVDFFSDKKSRVCREDDEGFRVKKEEQDDRTDVNTGLNLRTTGNTKSDESMIDDGESSEMEDKRAKNELVKLQDELKKMTMDNQKLRELLTQVSNSYTSLQMHLVSLMQQQQQQNNKVIEAAEKPEETIVPRQFIDLGPTRAVGEAEDVSNSSSEDRTRSGGSSAAERRSNGKRLGREESPETESNKIQKVNSTTPTTFDQTAEATMRKARVSVRARSEAPMISDGCQWRKYGQKMAKGNPCPRAYYRCTMATGCPVRKQVQRCAEDRSILITTYEGNHNHPLPPAAVAMASTTTAAANMLLSGSMSSHDGMMNPTNLLARAVLPCSTSMATISASAPFPTVTLDLTHSPPPPNGSNPSSSAATNNNHNSLMQRPQQQQQQMTNLPPGMLPHVIGQALYNQSKFSGLQFSGGSPSTAAFSQSHAVADTITALTADPNFTAALAAVISSMINGTNHHDGEGNNKNQ

SEQ ID NO: 151 - DNA, 1136 bp, Arabidopsis thaliana
  G187,family:WRKY
tagacctcttaggaaaaaaacctaaaaacctaatccccaaacctaaaaggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagagaaaaaaaaa

SEQ ID NO: 152 - protein, 318 aa, Arabidopsis thaliana
  G187,WRKY domain coordinates 172-228
MSNETRDLYNYQYPSSFSLHEMMNLPTSNPSSYGNLPSQNGFNPSTYSFTDCLQSSPAAYESLLQKTFGLSPSSSEVFNSSIDQEPNRDVTNDVINGGACNETETRVSPSNSSSSEADHPGEDSGKSRRKRELVGEEDQISKKVGKTKKTEVKKQREPRVSFMTKSEVDHLEDGYRWRKYGQKAVKNSPYPRSYYRCTTQKCNVKKRVERSFQDPTVVITTYEGQHNHPIPTNLRGSSAAAAMFSADLMTPRSFAHDMFRTAAYTNGGSVAAALDYGYGQSGYGSVNSNPSSHQVYHQGGEYELLREIFPSIFFKQEP

SEQ ID NO: 153 - DNA, 1191 bp, Arabidopsis thaliana
  G188,family:WRKY
ctctcaccaacataatcaaagaagctttcctcacgaattcaagatcgccatgtcctccgaggattgggatctcttcgccgtcgtcagaagctgcagctcttctgtttccaccaccaattcttgtgctggtcatgaagacgacataggaaactgtaaacaacaacaagatcctcctcctcctcctctgtttcaagcttcttcttcttgcaacgagttacaagattcttgcaaaccatttttacccgttactactactactactactacttggtctcctcctcctctacttcctcctcctaaagcctcatcaccatctcccaatatcttactaaaacaagaacaagtacttctcgaatcacaagatcaaaaacctcctcttagtgttagggttttcccaccatccacttcttcttctgtctttgtttttagaggtcaacgcgaccagcttcttcaacaacaatcccaacctccccttcgatctagaaaaagaaagaatcagcaaaaaagaaccatatgtcatgtaacgcaagagaatctttcttctgatttgtgggcttggcgtaaatacggtcaaaaacccatcaaaggctctccttatccaaggaattattacagatgtagtagctcaaaaggatgtttagcacgaaaacaagttgaaagaagtaatttagatcctaatatcttcatcgttacttacaccggagaacacactcatccacgtcctactcaccggaactctctcgccggaagtactcgtaacaaatctcagcccgttaacccggttcctaaaccggacacatctcctttatcggatacagtaaaagaagagattcatctttctccgacgacaccgttgaaaggaaacgatgacgttcaagaaacgaatggagatgaagatatggttggtcaagaagtcaacatggaagaggaagaggaggaagaagaagtggaagaagatgatgaagaagaagaagatgatgatgacgtggatgatcttttgataccaaatttagcggtgagagatcgagatgatttgttcttcgctggaagttttccatcttggtccgccggatccgccggtgacggtggtggatgatgaaaacgaataaaatctcaatttacaatttacaaaaagaaaaaagtcagtttttaattattatttttgtttgttaaaacttgacatttattgtg

SEQ ID NO: 154 - protein, 348 aa, Arabidopsis thaliana
  G188,WRKY domain coordinates 175-222
MSSEDWDLFAVVRSCSSSVSTTNSCAGHEDDIGNCKQQQDPPPPPLFQASSSCNELQDSCKPFLPVTTTTTTTWSPPPLLPPPKASSPSPNILLKQEQVLLESQDQKPPLSVRVFPPSTSSSVFVFRGQRDQLLQQQSQPPLRSRKRKNQQKRTICHVTQENLSSDLWAWRKYGQKPIKGSPYPRNYYRCSSSKGCLARKQVERSNLDPNIFIVTYTGEHTHPRPTHRNSLAGSTRNKSQPVNPVPKPDTSPLSDTVKEEIHLSPTTPLKGNDDVQETNGDEDMVGQEVNMEEEEEEEEVEEDDEEEEDDDDVDDLLIPNLAVRDRDDLFFAGSFPSWSAGSAGDGGG

SEQ ID NO: 155 - DNA, 1115 bp, Arabidopsis thaliana
  G189,family:WRKY
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagcttttgctaaaaaaaaaaaaaaaaa

SEQ ID NO: 156 - protein, 317 aa, Arabidopsis thaliana
  G189,WRKY domain coordinates 240-297
MAVELMTRNYISGVGADSFAVQEAAASGLKSIENFIGLMSRDSFNSDQPSSSSASASASAAADLESARNTTADAAVSKFKRVISLLDRTRTGHARFRRAPVHVISPVLLQEEPKTTPFQSPLPPPPQMIRKGSFSSSMKTIDFSSLSSVTTESDNQKKIHHHQRPSETAPFASQTQSLSTTVSSFSKSTKRKCNSENLLTGKCASASSSGRCHCSKKRKIKQRRIIRVPAISAKMSDVPPDDYSWRKYGQKPIKGSPHPRGYYKCSSVRGCPARKHVERAADDSSMLIVTYEGDHNHSLSAADLAGAAVADLILESS

SEQ ID NO: 157 - DNA, 1034 bp, Arabidopsis thaliana
  G190,family:WRKY
gaaaaagaaaacaaacaagaaacacatacacacacacacaagttcactatactctatggaaatgaactccccacacgaaaaggcggtgcaagctatccgttatggccatagctgcgccatgcggttgaagaggcggctcaaccatccaatggctgatggtggaccgctttcaagttatgatcttgctaaatcgatcgttgaaagtttttccaatgccatttcaatcttatctgctaaaccagaaaccgaagatgatcagttttctgatttatcttctagggattcttctcctcctccacaggggagcccctccaagaaaagaaagattgatagtacaaattcaagtgagaattggagggacgattcaccggatccgatttactacgacgggtatctttggaggaaatatggtcaaaagagtataaaaaaatctaatcaccaaaggagttactatagatgttcttacaacaaagatcataactgcgaagcaagaaagcatgaacaaaagatcaaagacaatcctccggtttaccgaaccacttactttggccaccacacttgcaaaaccgaacataatctagatgccatttttattgccggacaagatcccctagatgactttaaaagtacccaaatgatccgattcggaaaagatcaggatcaggagaaggaaagccgctcgaacggtttctccttatcggttaagcatgaagaagatatcatcaaagagcaagctatagatcagtaccgtgagataaccagtaatgaccaagattgtcaagatgttatagaagaatatctatcatcaccatcaggctcttatcctccttcatcgtcatctggcagtgaaagtgctgactttaattctgatttgttatttgacaacccagactcgtgggatcgttatgatcagttttacttttgattgcactagatttttcagctaaaactatttaataatgttttcctttttatgagattgtatatatttgagaattgtgactatttaagtatttatgttattgattagataa

SEQ ID NO: 158 - protein, 289 aa, Arabidopsis thaliana
  G190,WRKY domain coordinates 110-169
MEMNSPHEKAVQAIRYGHSCAMRLKRRLNHPMADGGPLSSYDLAKSIVESFSNAISILSAKPETEDDQFSDLSSRDSSPPPQGSPSKKRKIDSTNSSENWRDDSPDPIYYDGYLWRKYGQKSIKKSNHQRSYYRCSYNKDHNCEARKHEQKIKDNPPVYRTTYFGHHTCKTEHNLDAIFIAGQDPLDDFKSTQMIRFGKDQDQEKESRSNGFSLSVKHEEDIIKEQAIDQYREITSNDQDCQDVIEEYLSSPSGSYPPSSSSGSESADFNSDLLFDNPDSWDRYDQFYF

SEQ ID NO: 159 - DNA, 1171 bp, Arabidopsis thaliana
  G192,family:WRKY
cttttttctcttctctcctcagagattcgaagctttttgtctcccctgagtaaccaaattcaatggccgacgattgggatctccacgccgtagtcagaggctgctcagccgtaagctcatcagctactaccaccgtatattcccccggcgtttcatctcacacaaaccctatattcaccgtcggacgacaaagtaatgccgtctccttcggagagattcgagatctctacacaccgttcacacaagaatctgtcgtctcttcgttttcttgtataaactacccagaagaacctagaaagccacagaaccagaaacgtcctctttctctctctgcttcttccggtagcgtcactagcaaacccagtggctccaatacctctagatctaaaagaagaaagatacagcataagaaagtgtgccatgtagcagcagaagctttaaactccgatgtctgggcatggcgaaagtacggacagaaacccatcaaaggttcaccatatccaagaggatactacagatgtagtacatcaaaaggttgtttagcccgtaaacaagtggagcgaaatagatccgacccgaagatgtttatcgtcacttacacggcggagcataatcatccagctccgacacaccgtaattctctcgccggaagcacacgtcagaaaccatccgatcaacagacgagtaaatctccgacgaccactattgctacttattcatcgtctccggtgacttcagccgacgaatttgttttgcctgttgaggatcatctagcggtgggagatcttgacggagaagaagatctgttatctttgtcggatacggtggttagcgatgatttcttcgatgggttagaggaattcgcagccggagatagcttttccgggaactcggctccggcgagttttgatctctcttgggttgtgaacagtgccgccactaccaccggaggaatatgattagattacgacggcttagaatactcttattaggacagatttataggattaaggaattattctcggagcatatgtaaaaataggataaaagaaaatgttctttgttactttttttcgggttttcttcctattgtttctaaacatcttagaaaaaatttaattgtatattccttaagctcgatacatcttgttttaaaaaaaaaaaaaaaaaa

SEQ ID NO: 160 - protein, 298 aa, Arabidopsis thaliana
  G192,WRKY domain coordinates 128-185
MADDWDLHAVVRGCSAVSSSATTTVYSPGVSSHTNPIFTVGRQSNAVSFGEIRDLYTPFTQESVVSSFSCINYPEEPRKPQNQKRPLSLSASSGSVTSKPSGSNTSRSKRRKIQHKKVCHVAAEALNSDVWAWRKYGQKPIKGSPYPRGYYRCSTSKGCLARKQVERNRSDPKMFIVTYTAEHNHPAPTHRNSLAGSTRQKPSDQQTSKSPTTTIATYSSSPVTSADEFVLPVEDHLAVGDLDGEEDLLSLSDTVVSDDFFDGLEEFAAGDSFSGNSAPASFDLSWVVNSAATTTGGI

SEQ ID NO: 161 - DNA, 1418 bp, Arabidopsis thaliana
  G194,family:WRKY
tctttcttctctctctatctctcctctttgaaccctaaaaactctttctttacaaggattgatctttttgtatttttgattttgacatttgctttgtgttcgatctctgttttgatgcgatttctctgtttttaaagccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatctagtttttttttgtataattgtctaaaagaaacggatcttttgttctgatgaagaagatgttttcttatggttctgaaatcgtaaggtaatgatgattgtaccaagccgagaaagtacttgtgattttcaccattgaatcactataaatgtaatttttatttactgtgaaaaaaaaaaaaaaa

SEQ ID NO: 162 - protein, 337 aa, Arabidopsis thaliana
  G194,WRKY domain coordinates 174-230
MEFTDFSKTSFYYPSSQSVWDFGDLAAAERHSLGFMELLSSQQHQDFATVSPHSFLLQTSQPQTQTQPSAKLSSSIIQAPPSEQLVTSKVESLCSDHLLINPPATPNSSSISSASSEALNEEKPKTEDNEEEGGEDQQEKSHTKKQLKAKKNNQKRQREARVAFMTKSEVDHLEDGYRWRKYGQKAVKNSPFPRSYYRCTTASCNVKKRVERSFRDPSTVVTTYEGQHTHISPLTSRPISTGGFFGSSGAASSLGNGCFGFPIDGSTLISPQFQQLVQYHHQQQQQELMSCFGGVNEYLNSHANEYGDDNRVKKSRVLVKDNGLLQDVVPSHMLKEE

SEQ ID NO: 163 - DNA, 1501 bp, Arabidopsis thaliana
  G196,family:WRKY
tcgacatcagatttctctcacggattcctaatcatttttattatatttggatatttgctaattcttcccgtgtataaatctcatataaacacgcatcatacatatatattatgtgcagcgtctttgagtttcaagacatggacaacttccaaggagatctaacagacgtcgtacgaggaataggatcaggccacgtgtcaccatctcctggaccaccggaaggtccatctccgagcagcatgtctccgccgccaacatcagatctccacgtggaattcccctccgccgctacttctgccagctgtctcgcaaatcccttcggagacccgttcgtaagcatgaaggatcctctcatccacctcccggccagctacatctccggcgccggtgataataaaagcaacaaaagttttgcaatctttccaaagatttttgaggatgatcatattaagagtcaatgcagtgtcttcccaagaattaagatctcgcaaagtaacaatatccacgatgcctccacgtgtaattctccggccataaccgtctcctctgccgccgtagcagcttcgccgtggggcatgatcaacgttaataccactaacagtccaagaaactgtttacttgtcgataataataacaacacgtcatcatgctcacaggttcagatctcttcttcccctcggaatctcggaattaagagaaggaagagccaggcaaagaaagtggtgtgcataccggctccagccgctatgaacagccggtccagtggagaagttgttccgtctgatctatgggcttggcgaaagtacggtcaaaaacctatcaaaggttctccttatccaaggggttactacagatgtagcagctcaaaaggttgttcagctaggaaacaagtcgaacgtagccgcactgatccaaacatgttagtcattacttacacctctgagcataaccacccatggcctactcaacgcaacgctctcgcaggttccactcgttcctcttcctcctcctctttaaacccttcttccaaatcctcaaccgcagccgccactacttctccctcatccagagttttccaaaacaacagcagcaaagacgaacccaataactccaacttgccttcctcttccactcatcctccttttgacgccgccgcaattaaggaggagaacgtggaagagcgtcaggaaaagatggagttcgattataatgacgttgaaaatacctatagaccggagttgttgcaagagtttcaacatcagccggaggatttctttgccgatctcgacgagcttgagggagattctttgactatgttgctctctcacagtagcggcggaggcaacatggaaaacaaaacgacgattccagacgtttttagtgatttctttgacgacgacgagtcctcaaggtcgttataaatattgttgttaatgtatacatagaaatgaaattattcatgtaattcgttttgtgttaaatgacggtatttgcctttgca

SEQ ID NO: 164 - protein, 436 aa, Arabidopsis thaliana
  G196,WRKY domain coordinates 223-283
MCSVFEFQDMDNFQGDLTDVVRGIGSGHVSPSPGPPEGPSPSSMSPPPTSDLHVEFPSAATSASCLANPFGDPFVSMKDPLIHLPASYISGAGDNKSNKSFAIFPKIFEDDHIKSQCSVFPRIKISQSNNIHDASTCNSPAITVSSAAVAASPWGMINVNTTNSPRNCLLVDNNNNTSSCSQVQISSSPRNLGIKRRKSQAKKVVCIPAPAAMNSRSSGEVVPSDLWAWRKYGQKPIKGSPYPRGYYRCSSSKGCSARKQVERSRTDPNMLVITYTSEHNHPWPTQRNALAGSTRSSSSSSLNPSSKSSTAAATTSPSSRVFQNNSSKDEPNNSNLPSSSTHPPFDAAAIKEENVEERQEKMEFDYNDVENTYRPELLQEFQHQPEDFFADLDELEGDSLTMLLSHSSGGGNMENKTTIPDVFSDFFDDDESSRSL

SEQ ID NO: 165 - DNA, 825 bp, Arabidopsis thaliana
  G197,family:MYB-(R1)R2R3
atgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatga

SEQ ID NO: 166 - protein, 274 aa, Arabidopsis thaliana
  G197,MYB-(R1)R2R3 domain coordinates 14-116
MGRSPCCEKDHTNKGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKLLRKGIDPATHRPINETKTSQDSSDSSKTEDPLVKILSFGPQLEKIANFGDERIQKRVEYSVVEERCLDLNLELRISPPWQDKLHDERNLRFGRVKYRCSACRFGFGNGKECSCNNVKCQTEDSSSSSYSSTDISSSIGYDFLGLNNTRVLDFSTLEMK

SEQ ID NO: 167 - DNA, 1089 bp, Arabidopsis thaliana
  G198,family:MYB-(R1)R2R3
atggcaaggtcaccttgttgcgagaagaacggactcaagaaagggccatggacatctgaagaagaccagaagcttgttgactatatccagaaacatggttatggtaactggagaaccctccccaaaaatgccggtacgtgtttgcaaagatgtggcaaaagttgtaggttaaggtggactaattatctccgaccagatataaaacgaggaagattctcttttgaggaagaagaagccattattcagcttcatagcttcttaggaaacaagtggtctgcgattgcggcgcgtttgccaggaagaacagataatgagatcaagaacttttggaacactcatataagaaagaagctacttagaatggggattgatccagtgactcacagtccacgactcgatctcctcgatatctcatccatcttagcttcatctctatacaattcatcttcacatcacatgaacatgtcaagactcatgatggatactaatcgtcgtcatcagcaacaacatccattggttaaccccgagatactcaagcttgcgacctctatattctctcaaaaccaaaaccaaaaccacaaccaaaatcaaaaccaaaaccaaaacctcgtggtggatcatgagaagcaaacagtttatcatcatcatgatgttaaccaaaccggagtaaaccaataccaaaccgaccaatatttcgagaacgcgattactcaagaactccaatcttccatgccaccattccccaatgaagctcatcagtttaacgacatggatcatcacttcaatggttttggagaacaaaatcttgtttcaacttctactacgtcagtccaagattgctataatccgtcattcaacgattattcaagttcaaattttgtcttagatcattcttattcggatcagagcttcaacttcgcaaattcggtcttaaacacgccatcctcgagcccgagcccgactacgttaaactcgagttacatcaatagtagcagttgcagcactgaggatgaaatagaaagctattgcagtaatctcatgaagtttgatattcccgatttcttggacgttaatggttttattatataa

SEQ ID NO: 168 - protein, 362 aa, Arabidopsis thaliana
  G198,MYB-(R1)R2R3 domain coordinates 14-117
MARSPCCEKNGLKKGPWTSEEDQKLVDYIQKHGYGNWRTLPKNAGTCLQRCGKSCRLRWTNYLRPDIKRGRFSFEEEEAIIQLHSFLGNKWSAIAARLPGRTDNEIKNFWNTHIRKKLLRMGIDPVTHSPRLDLLDISSILASSLYNSSSHHMNMSRLMMDTNRRHQQQHPLVNPEILKLATSIFSQNQNQNHNQNQNQNQNLVVDHEKQTVYHHHDVNQTGVNQYQTDQYFENAITQELQSSMPPFPNEAHQFNDMDHHFNGFGEQNLVSTSTTSVQDCYNPSFNDYSSSNFVLDHSYSDQSFNFANSVLNTPSSSPSPTTLNSSYINSSSCSTEDEIESYCSNLMKFDIPDFLDVNGFII

SEQ ID NO: 169 - DNA, 949 bp, Arabidopsis thaliana
  G200,family:MYB-(R1)R2R3
gagagagaaagatgggtaggcctccatgctgtgacaagatagggatcaagaaaggaccatggactcctgaagaagatatcattcttgtttcttacattcaagaacatggtcctggaaactggagatcagttcccaccaacactgggttattgagatgcagcaaaagttgtagactgagatggacaaattatctgagacctggaattaaacgtggaaactttactcctcatgaagaaggaatgatcattcacttgcaagccttattgggtaacaaatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcacagaaaacatttcccgccttgtggagggttggatgagagcgtctccaaagagtagtacaagtactactttcttggaacacaaaatgcagaaccggacaaacaatttcatcgatcatcacagtgatcagtttccatacgagcagcttcaaggttctagggaagagggtcatagcaaaggaatcaacggggatgatgaccagggtataaagaattcagagaataacaacggtgatgatgttcatcatgaagatggtgatcatgaggatgatgatgatcataatgcaacaccaccattgacatttattgagaaatggcttttggaggaaacaagtactactgggggtcaaatggaagagatgagccacttgatggagctctctaatatgctttaattgtgacattttctcctttattttttctttatccttgtgaatcttataaatgagactactaattttatatacacaaataaagaaaccagaaagac

SEQ ID NO: 170 - protein, 280 aa, Arabidopsis thaliana
  G200,MYB-(R1)R2R3 domain coordinates 12-116
MGRPPCCDKIGIKKGPWTPEEDIILVSYIQEHGPGNWRSVPTNTGLLRCSKSCRLRWTNYLRPGIKRGNFTPHEEGMIIHLQALLGNKWASIASYLPQRTDNDIKNYWNTHLKKKLNKSDSDERSRSENIALQTSSTRNTINHRSTYASSTENISRLVEGWMRASPKSSTSTTFLEHKMQNRTNNFIDHHSDQFPYEQLQGSREEGHSKGINGDDDQGIKNSENNNGDDVHHEDGDHEDDDDHNATPPLTFIEKWLLEETSTTGGQMEEMSHLMELSNML

SEQ ID NO: 171 - DNA, 1292 bp, Arabidopsis thaliana
  G201,family:MYB-(R1)R2R3
atgtcaagaaagccatgttgtgtgggagaaggactgaagaaaggagcatggactgccgaagaagacaagaaactcatctcttacattcatgaacacggtggaggaggctggcgtgacattccccaaaaagctggactaaaacgatgtggaaagagttgtagattgcgatgggctaactatttgaaacctgacatcaagagaggagagtttagctatgaggaggaacagattatcatcatgctacacgcttctcgcggcaacaagtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacaatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattatgacgacaagaacttcatatgatccgttgattgcttaccggactagagttgaccggttaatgtcatatggttctcttagatatttgtcaagttatagtaaaggtccactatagggtcactatatattaatattcagtaatggattctcttagttagagaaccttgtgatgccgtggatcaattagtatttgatttgcgggagacacgagttttttttccttctattgttgtttgtggatttacgtactataaataataaataaaacacccatttgattgcaaaaaaaaaaaaaaaaaaaaaaa

SEQ ID NO: 172 - protein, 336 aa, Arabidopsis thaliana
  G201,MYB-(R1)R2R3 domain coordinates 14-114
MSRKPCCVGEGLKKGAWTAEEDKKLISYIHEHGGGGWRDIPQKAGLKRCGKSCRLRWANYLKPDIKRGEFSYEEEQIIIMLHASRGNKWSVIARHLPKRTDNEIKNYWNTHLKKLLIDKGIDPVTHKPLAYDSNPDEQSQSGSISPKSLPPSSSKNVPEITSSDETPKYDASLSSKKRCFKRSSSTSKLLNKVAARASSMGTILGASIEGTLISSTPLSSCLNDDFSETSQFQMEEFDPFYQSSEHIIDHMKEDISINNSEYNFSQFLEQFSNNEGEEADNTGGGYNQDLLMSDVSSTSVDEDEMMQNITGWSNYLLDHSDFNYDTSQDYDDKNFI

SEQ ID NO: 173 - DNA, 1101 bp, Arabidopsis thaliana
  G202,family:MYB-(R1)R2R3
atgtcaagaaagccatgttgcgtcggagaaggcttgaagaaaggagcatggaccaccgaggaggacaagaaactcatctcttacatccacgaccacggcgagggaggctggcgcgacattccccaaaaagctgggttgaaacggtgtggaaagagttgtagactgcgatggaccaactaccttaaacctgagatcaaaagaggcgagtttagttcagaggaagagcagattatcatcatgcttcatgcttctcgtggcaacaagtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatga

SEQ ID NO: 174 - protein, 366 aa, Arabidopsis thaliana
  G202,MYB-(R1)R2R3 domain coordinates 13-116
MSRKPCCVGEGLKKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRLMEQGIDPVTHKPLASSSNPTVDENLNSPNASSSDKQYSRSSSMPFLSRPPPSSCNMVSKVSELSSNDGTPIQGSSLSCKKRFKKSSSTSRLLNKVAAKATSIKDILSASMEGSLSATTISHASFFNGFTEQIRNEEDSSNTSLTNTLAEFDPFSPSSLYPEHEINATSDLNMDQDYDFSQFFEKFGGDNHNEENSMNDLLMSDVSQEVSSTSVDDQDNMVGNFEGWSNYLLDHTNFMYDTDSDSLEKHFI

SEQ ID NO: 175 - DNA, 741 bp, Arabidopsis thaliana
  G206,family:MYB-(R1)R2R3
atggggagaagaccatgctgtgagaagataggattgaagaaagggccatggagtgctgaagaagatcgaatcttgatcaattatattagtctccatggccatcccaattggagagctctccctaaactagccgggctacttcggtgcggaaaaagttgcaggcttcgttggattaattatttgagaccagacatcaaacgtggcaatttcactcctcatgaagaagatactatcatcagcttacatcaactcttaggcaacagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgacggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttga

SEQ ID NO: 176 - protein, 246 aa, Arabidopsis thaliana
  G206,MYB-(R1)R2R3 domain coordinates 13-116
MGRRPCCEKIGLKKGPWSAEEDRILINYISLHGHPNWRALPKLAGLLRCGKSCRLRWINYLRPDIKRGNFTPHEEDTIISLHQLLGNRWSAIAAKLPGRTDNEIKNVWHTHLKKRLHHSQDQNNKEDFVSTTAAEMPTSPQQQSSSSADISAITTLGNNNDISNSNKDSATSSEDVLAIIDESFWSEVVLTDCDISGNEKNEKKIENWEGSLDRNDKGYNHDMEFWFDHLTSSSCIIGEMSDISEF

SEQ ID NO: 177 - DNA, 1107 bp, Arabidopsis thaliana
  G207,family:MYB-(R1)R2R3
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgatcctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggaggaggaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggtttagggttaaaacttgaatcgattggggattttcaagagcattcatttttggggtttatggtaaaattaaaaacaaaaacaaaatgtacagaggaattaaaatttctatggaataatcttaaatctcaaatatttgttacttgttttggtgattcataaccaaaatcaaa

SEQ ID NO: 178 - protein, 304 aa, Arabidopsis thaliana
  G207,MYB-(R1)R2R3 domain coordinates 6-106
MADRVKGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRKCSGGVAVTTVTETEEDQDRPKKRRSVSFDPAFAPVDTGLYMSPESPNGIDVSDSSTIPSPSSPVAQLFKPMPISGGFTVVPQPLPVEMSSSSEDPPTSLSLSLPGAENTSSSHNNNNNALMFPRFESQMKINVEERGGGGEGRRGEFMTVVQEMIKAEVRSYMAEMQKTSGGFVVGGLYESGGNGGFRDCGVITPKVE

SEQ ID NO: 179 - DNA, 764 bp, Arabidopsis thaliana
  G208,family:MYB-(R1)R2R3
cttcttcattcaccatgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaaatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttgtaataatttgtcaaaaaaatcccaaaaaatgggtttgttaaa

SEQ ID NO: 180 - protein, 236 aa, Arabidopsis thaliana
  G208,MYB-(R1)R2R3 domain coordinates 14-116
MGRSPCCEKAHTNKGAWTKEEDQRLVDYIRNHGEGCWRSLPKSAGLLRCGKSCRLRWINYLRPDLKRGNFTDDEDQIIIKLHSLLGNKWSLIAGRLPGRTDNEIKNYWNTHIKRKLLSHGIDPQTHRQINESKTVSSQVVVPIQNDAVEYSFSNLAVKPKTENSSDNGASTSGTTTDEDLRQNGECYYSDNSGHIKLNLDLTLGFGSWSGRIVGVGSSADSKPWCDPVMEARLSLL

SEQ ID NO: 181 - DNA, 750 bp, Arabidopsis thaliana
  G211,family:MYB-(R1)R2R3
atgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactag

SEQ ID NO: 182 - protein, 249 aa, Arabidopsis thaliana
  G211,MYB-(R1)R2R3 domain coordinates 24-137
MMSCGGKKPVSKKTTPCCTKMGMKRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTHKPLDANNIHKPEEEVSGGQKYPLEPISSSHTDDTTVNGGDGDSKNSINVFGGEHGYEDFGFCYDDKFSSFLNSLINDVGDPFGNIIPISQPLQMDDCKDGIVGASSSSLGHD

SEQ ID NO: 183 - DNA, 687 bp, Arabidopsis thaliana
  G212,family:MYB-(R1)R2R3
atgagaataaggagaagagatgaaaaagagaatcaagaatacaagaaaggtttatggacagttgaagaagacaacatccttatggactatgttcttaatcatggcactggccaatggaaccgcatcgtcagaaaaactgggctaaagagatgtgggaaaagttgtagactgagatggatgaattatttgagccctaatgtgaacaaaggcaatttcactgaacaagaagaagacctcattattcgtctccacaagctcctcggcaatagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttag

SEQ ID NO: 184 - protein, 228 aa, Arabidopsis thaliana
  G212,MYB-(R1)R2R3 domain coordinates 15-116
MRIRRRDEKENQEYKKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSKKLVGDYSSAVKTTGEDDDSPPSLFITAATPSSCHHQQENIYENIAKSFNGVVSASYEDKPKQELAQKDVLMATTNDPSHYYGNNALWVHDDDFELSSLVMMNFASGDVEYCL

SEQ ID NO: 185 - DNA, 2240 bp, Arabidopsis thaliana
  G214,family:MYB-related
tgagatttctccatttccgtagcttctggtctcttttctttgtttcattgatcaaaagcaaatcacttcttcttcttcttcttctcgatttcttactgttttcttatccaacgaaatctggaattaaaaatggaatctttatcgaatccaagctgattttgtttctttcattgaatcatctctctaaagtggaattttgtaaagagaagatctgaagttgtgtagaggagcttagtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacatgagactctattttcatctgatctgttgtttgtactctgtttttaagttttcaagaccactgctacattttctttttcttttgaggcctttgtatttgtttccttgtccatagtcttcctgtaacatttgactctgtattattcaacaaatcataaactgtttaatctttttttttcca

SEQ ID NO: 186 - protein, 608 aa, Arabidopsis thaliana
  G214,MYB-related domain coordinates 25-71
METNSSGEDLVIKTRKPYTITKQRERWTEEEHNRFIEALRLYGRAWQKIEEHVATKTAVQIRSHAQKFFSKVEKEAEAKGVAMGQALDIAIPPPRPKRKPNNPYPRKTGSGTILMSKTGVNDGKESLGSEKVSHPEMANEDRQQSKPEEKTLQEDNCSDCFTHQYLSAASSMNKSCIETSNASTFREFLPSREEGSQNNRVRKESNSDLNAKSLENGNEQGPQTYPMHIPVLVPLGSSITSSLSHPPSEPDSHPHTVAGDYQSFPNHIMSTLLQTPALYTAATFASSFWPPDSSGGSPVPGNSPPNLAAMAAATVAAASAWWAANGLLPLCAPLSSGGFTSHPPSTFGPSCDVEYTKASTLQHGSVQSREQEHSEASKARSSLDSEDVENKSKPVCHEQPSATPESDAKGSDGAGDRKQVDRSSCGSNTPSSSDDVEADASERQEDGTNGEVKETNEDTNKPQTSESNARRSRISSNITDPWKSVSDEGRIAFQALFSREVLPQSFTYREEHREEEQQQQEQRYPMALDLNFTAQLTPVDDQEEKRNTGFLGIGLDASKLMSRGRTGFKPYKRCSMEAKESRILNNNPIIHVEQKDPKRMRLETQAST

SEQ ID NO: 187 - DNA, 2807 bp, Arabidopsis thaliana
  G217,family:MYB-related
cttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcagcaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttgtattggtaagtttttttaatatgagtcatgactttgtaaaaaggttatgatatattctctgtttgtatgctttgcaagagtcaagaaatttgaatgcttcaggatcaaaaaaaaaaaaaaaaaaaaaaaaaaaaaa

SEQ ID NO: 188 - protein, 844 aa, Arabidopsis thaliana
  G217,MYB-related domain coordinates 8-55
MRIMIKGGVWKNTEDEILKAAVMKYGKNQWARISSLLVRKSAKQCKARWYEWLDPSIKKTEWTREEDEKLLHLAKLLPTQWRTIAPIVGRTPSQCLERYEKLLDAACTKDENYDAADDPRKLRPGEIDPNPEAKPARPDPVDMDEDEKEMLSEARARLANTRGKKAKRKAREKQLEEARRLASLQKRRELKAAGIDGRHRKRKRKGIDYNAEIPFEKRAPAGFYDTADEDRPADQVKFPTTIEELEGKRRADVEAHLRKQDVARNKIAQRQDAPAAILQANKLNDPEVVRKRSKLMLPPPQISDHELEEIAKMGYASDLLAENEELTEGSAATRALLANYSQTPRQGMTPMRTPQRTPAGKGDAIMMEAENLARLRDSQTPLLGGENPELHPSDFTGVTPRKKEIQTPNPMLTPSMTPGGAGLTPRIGLTPSRDGSSFSMTPKGTPFRDELHINEDMDMQQSAKLERQRREEARRSLRSGLTGLPQPKNEYQIVAQPPPEESEEPEEKIEEDMSDRIAREKAEEEARQQALLKKRSKVLQRDLPRPPAASLAVIRNSLLSADGDKSSVVPPTPIEVADKMVREELLQLLEHDNAKYPLDDKAEKKKGAKNRTNRSASQVLAIDDFDENELQEADKMIKEEGKFLCVSMGHENKTLDDFVEAHNTCVNDLMYFPTRSAYELSSVAGNADKVAAFQEEMENVRKKMEEDEKKAEHMKAKYKTYTKGHERRAETVWTQIEATLKQAEIGGTEVECFKALKRQEEMAASFRKKNLQEEVIKQKETESKLQTRYGNMLAMVEKAEEIMVGFRAQALKKQEDVEDSHKLKEAKLATGEEEDIAIAMEASA

SEQ ID NO: 189 - DNA, 1364 bp, Arabidopsis thaliana
  G222,family:MYB-(R1)R2R3
ctcattttataataattttctccatcttcttccttcctcttcaagcttatagaacctccaagaaccataaaactctctctgcaacaatctatactttcttcattacttttataaaaaatgggaagacattcttgttgttttaagcagaagctaagaaaaggcctttggtctcctgaagaagatgagaaacttctcaattacatcactagacatggtcatggctgttggagttctgtccctaaactcgcaggtttgcaaagatgtggaaagagttgtagacttaggtggataaattatttgagaccagatttaaagagaggagctttctctcaagacgaagaaagcttgatcattgagctccatgctgcattaggcaacagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatcttcagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacacggtgtttgatcagagcctttagattattaacatgtgttatagagagtttcattttctattcatattcatagacctgagtttattgattgatccatacatttgttatgcttgtgtgtaaagtatgtatatggtttttgatttatgtaaattttctgctcgagtgaatttttttggtgctaagatgtagttctttattccaaaaaaaaaaaa

SEQ ID NO: 190 - protein, 352 aa, Arabidopsis thaliana
  G222,MYB-(R1)R2R3 domain coordinates 13-119
MGRHSCCFKQKLRKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRKGIDPTTHKPLITNELQSLNVIDQKLTSSEVVKSTGSINNLHDQSMVVSSQQGPWWFPANTTTTNQNSAFCFSSSNTTTVSDQIVSLISSMSTSSSPTPMTSNFSPAPNNWEQLNYCNTVPSQSNSIFSAFFGNQYTEASQTMNNNNPLVDQHHHHQDMKSWASEILHYTEHNQSSETVIEAEVKPDIANYYWRSASSSSSPNQEAATLLHDANVEVYGKNLQKLNNTVFDQSL

SEQ ID NO: 191 - DNA, 1164 bp, Arabidopsis thaliana
  G224,family:PMR
atgatttacgtagttcccgatctacttgaagaaattttccttggattgcctttaaaatcaatcctcagattcaaaaccgtctcaaaacaatggagatcaatcctggaatcgaagagtttcgcggagaggcgtttgaacgttgagaagaaggagaaaattctggctgttggagaccggactgagttgggattcgaaggtgaggaagagatccagatggtctatttacactgcgatattgacgccacacgaccctctctgacatgtgagggtttggtgtgtatcccagcaccaggttggatcaacgttttgaacccatcgaccagacaactccggagatttccttgtagccctaatcatcacgtgccctctgatcgtattcgttttcagttcagagacgaactatacctcacttcctttccggggaattgggagatgggatttggtagagacaaatttaatggtagctataaagtggtgaggatgtgttttagtcctgtggaaaaatgcgaggttcttgatgttgaaactggggaatggagtgaactgaatccacctcctaacgatattgacgtgggaaggaagtcacgtttcggaatcctagccttggatcttcacacactagagttccacaatgtttccgttccatctacgtgttgcaccatgagtgcccagatggtgaaccttgatgaccgtctagccataactaaaacaaacggtgcgccagaatgggagctagagatactgagcctgatggatgtagacaaagaaatatggagcaagacttactccataactttagccagtatcattattaaccacccatgggagtctagttggttcacggtgttgacggtttctaagctagggaatcttgtcttttgtgacaatcacaagcggttgtttaaatataataccgagacaaatgagatttgctgtctctcctcagatatttctgttatatctccttatctcgaggatttggtaccacttcgtttggactcaggacatgatcatcgggattacaaaatcaggacatctagttgcggattgttttcgaagcatccggaggcagggttattcaaggagatcatcacttttcggtttgtgtttgccactctagttctagttggttatcagtattatagatcattaaaattcaagtag

SEQ ID NO: 192 - protein, 387 aa, Arabidopsis thaliana
  G224,PMR domain coordinates 7-114
MIYVVPDLLEEIFLGLPLKSILRFKTVSKQWRSILESKSFAERRLNVEKKEKILAVGDRTELGFEGEEEIQMVYLHCDIDATRPSLTCEGLVCIPAPGWINVLNPSTRQLRRFPCSPNHHVPSDRIRFQFRDELYLTSFPGNWEMGFGRDKFNGSYKVVRMCFSPVEKCEVLDVETGEWSELNPPPNDIDVGRKSRFGILALDLHTLEFHNVSVPSTCCTMSAQMVNLDDRLAITKTNGAPEWELEILSLMDVDKEIWSKTYSITLASIIINHPWESSWFTVLTVSKLGNLVFCDNHKRLFKYNTETNEICCLSSDISVISPYLEDLVPLRLDSGHDHRDYKIRTSSCGLFSKHPEAGLFKEIITFRFVFATLVLVGYQYYRSLKFK

SEQ ID NO: 193 - DNA, 584 bp, Arabidopsis thaliana
  G225,family:MYB-related
ctctctctctcactcttttcttttccgagaacccaacaaaaaaaaagctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaagaggtgagtagtatcgaatgggaagctgtgaagatgtcagaagaagaagaagatctcatttctcggatgtataaactcgttggcgacaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattactattttggaatgtataattatctatatatataagaagaaaaaattgcttaggaattt

SEQ ID NO: 194 - protein, 94 aa, Arabidopsis thaliana
  G225,MYB-related domain coordinates 36-80
MFRSDKAEKMDKRRRRQSKAKASCSEEVSSIEWEAVKMSEEEEDLISRMYKLVGDRWELIAGRIPGRTPEEIERYWLMKHGVVFANRRRDFFRK

SEQ ID NO: 195 - DNA, 407 bp, Arabidopsis thaliana
  G226,family:MYB-related
ccagtagttatggataataccaaccgtcttcgtcttcgtcgcggtcccagtcttaggcaaactaagttcactcgatcccgatatgactctgaagaagtgagtagcatcgaatgggagtttatcagtatgaccgaacaagaagaagatctcatctctcgaatgtacagacttgtcggtaataggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctca

SEQ ID NO: 196 - protein, 112 aa, Arabidopsis thaliana
  G226,MYB-related domain coordinates 38-82
MDNTNRLRLRRGPSLRQTKFTRSRYDSEEVSSIEWEFISMTEQEEDLISRMYRLVGNRWDLIAGRVVGRKANEIERYWIMRNSDYFSHKRRRLNNSPFFSTSPLNLQENLKL

SEQ ID NO: 197 - DNA, 989 bp, Arabidopsis thaliana
  G227,family:MYB-(R1)R2R3
gtaccgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 198 - protein, 320 aa, Arabidopsis thaliana
  G227,MYB-(R1)R2R3 domain coordinates 13-113
MSNPTRKNMERIKGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRKCSVEGQSCDFGGNGGYDGNLGEEQPLKRTASGGGGVSTGLYMSPGSPSGSDVSEQSSGGAHVFKPTVRSEVTASSSGEDPPTYLSLSLPWTDETVRVNEPVQLNQNTVMDGGYTAELFPVRKEEQVEVEEEEAKGISGGFGGEFMTVVQEMIRTEVRSYMADLQRGNVGGSSSGGGGGGSCMPQSVNSRRVGFREFIVNQIGIGKME

SEQ ID NO: 199 - DNA, 1209 bp, Arabidopsis thaliana
  G229,family:MYB-(R1)R2R3
ttgtggtcagtggaataaacacatataaccgccggagaaaatgggaagagcgccatgttgcgagaaggtcggtatcaagagagggcggtggacggcggaggaggaccagattctctccaactacattcaatccaatggtgaaggttcttggagatctctccccaaaaatgccggattaaaaaggtgtggaaagagctgtagattgagatggataaactatctaagatcagacctcaagcgtggaaacataactccagaagaagaagaactcgttgttaaattgcattccactttgggaaacaggtggtcactaatcgcgggtcatctaccagggagaacagacaacgaaataaaaaattattggaactctcatctcagccgtaaactccacaacttcattaggaagccatccatctctcaagacgtctccgccgtaatcatggcgaacgcttcttcagcgccaccgccgccgcaggcaaaacgcagacttgggagaacgagtaggtccgctatgaaaccaaaaatccgcagaacaaaaactcgtaaaacgaagaaaacgtctgcaccaccggagcctaacgccgatgtagctggggctgataaagaagcattaatggtggagtcaagtggagccgaggctgagctaggacgaccatgtgactactatggagatgattgtaacaaaaatctcatgagcattaatggcgataatggagttttaacgtttgatgatgatatcatcgatcttttgttggacgagtcagatcctggccacttgtacacaaacacaacgtgcggtggtggtggggagttgcataacataagagactctgaaggagccagagggttctcggatacttggaaccaagggaatctcgactgtcttcttcagtcttgtccatctgtggagtcgtttctcaactacgaccaccaagttaacgacgcgtcgacggatgagtttatcgattgggattgtgtttggcaagaaggtagtgataataatctttggcatgagaaagagaatcccgactcaatggtctcgtggcttttagacggtgatgatgaggccacgatcgggaatagtaattgtgagaactttggagaaccgttagatcatgacgacgaaagcgctttggtcgcttggcttctgtcatgatgatattgattgatccgttatgtaatcttttttgtgcattcacagtttgaatc

SEQ ID NO: 200 - protein, 371 aa, Arabidopsis thaliana
  G229,MYB-(R1)R2R3 domain coordinates 14-120
MGRAPCCEKVGIKRGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFIRKPSISQDVSAVIMANASSAPPPPQAKRRLGRTSRSAMKPKIRRTKTRKTKKTSAPPEPNADVAGADKEALMVESSGAEAELGRPCDYYGDDCNKNLMSINGDNGVLTFDDDIIDLLLDESDPGHLYTNTTCGGGGELHNIRDSEGARGFSDTWNQGNLDCLLQSCPSVESFLNYDHQVNDASTDEFIDWDCVWQEGSDNNLWHEKENPDSMVSWLLDGDDEATIGNSNCENFGEPLDHDDESALVAWLLS

SEQ ID NO: 201 - DNA, 930 bp, Arabidopsis thaliana
  G230,family:MYB-(R1)R2R3
atgtctggttcgacccggaaagaaatggatcggatcaaaggaccatggagtcctgaagaagacgatctgttacaatcgttggttcagaagcacggaccaaggaactggtctctgataagcaaatcaatccctggacgttccggtaaatcttgccgtctccgttggtgtaatcagctttctccggaggtagagcaccgtggattcacggcggaggaagatgatacgattatactagcgcacgctcggtttggtaacaagtgggcgacgattgcacggcttctcaatggtcgcactgataacgcgattaagaatcactggaactcaacgctgaagcggaaatgtagcggcggaggcggcggaggagaggaagggcagagttgtgatttcggtggtaatggagggtatgatggtaatttaactgatgaaaaaccgttaaaacggagggcgagtggtggaggaggagttgttgtggtgacggcgttaagtccaacgggatctgacgtcagcgagcaatcgcaatctagtggatctgttttaccggtttcttcttcttgtcatgtttttaaaccgacggcgagagctggtggagtggtgattgagtcatcatcgccggaggaggaggagaaagatccgatgacttgtttgaggttgtctttgccttgggtcaatgagtcaacaactccaccggagttgtttccggtgaagagagaagaagaagaagagaaggaaagagagatttctggacttggtggagattttatgacggtggtgcaggagatgattaagacggaggttaggagttacatggcggatttacagctaggaaacggcggaggagctggaggaggagcaagttcgtgtatggtgcaaggaactaatggtcgtaatgtagggtttagagagtttattggattaggtaggatcgagtag

SEQ ID NO: 202 - protein, 309 aa, Arabidopsis thaliana
  G230,MYB-(R1)R2R3 domain coordinates 13-113
MSGSTRKEMDRIKGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRKCSGGGGGGEEGQSCDFGGNGGYDGNLTDEKPLKRRASGGGGVVVVTALSPTGSDVSEQSQSSGSVLPVSSSCHVFKPTARAGGVVIESSSPEEEEKDPMTCLRLSLPWVNESTTPPELFPVKREEEEEKEREISGLGGDFMTVVQEMIKTEVRSYMADLQLGNGGGAGGGASSCMVQGTNGRNVGFREFIGLGRIE

SEQ ID NO: 203 - DNA, 916 bp, Arabidopsis thaliana
  G231,family:MYB-(R1)R2R3
ttccatatctcttccatttcgctctctatttcacatccccatataacataatatacaatcacacatatcatttctatatagtatttaatggggagacagccatgctgtgacaagctaggggtgaagaaagggccgtggacggtggaggaagataagaagcttataaacttcatactaaccaatggccattgttgctggcgtgctttgccgaagctggccggtctccgtcgctgtggaaagagctgccgcctccggtggactaactatctccggcctggcttaaaacgaggccttctctcgcatgatgaagaacaacttgtcatagatcttcatgctaatctcggcaataagtggtctaagatagcttcaagattacctggaagaacagataacgaaataaaaaaccattggaatactcatatcaagaagaaacttcttaagatgggaatcgatcctatgacccatcaacccctaaatcaagaaccttctaatatcgataattccaaaaccattccgtccaatccagacgatgtctcagtggaaccaaagacaactaacacgaaatacgtggagataagtgtcacgacaacagaagaagaaagtagtagcacggttactgatcaaaacagttcgatggataatgaaaatcatctaattgacaacatttatgatgatgatgaattgtttagttacttatggtccgacgaaactactaaagatgaggcctcttggagtgatagtaactttggtgttggtggaacattatatgaccacaatatctccggcgccgatgcagattttccgatatggtcaccggaaagaatcaatgacgagaagatgtttttggattattgtcaagactttggtgttcatgattttgggttttgactgttcaccattgacatattggcaacgc

SEQ ID NO: 204 - protein, 266 aa, Arabidopsis thaliana
  G231,MYB-(R1)R2R3 domain coordinates 14-118
MGRQPCCDKLGVKKGPWTVEEDKKLINFILTNGHCCWRALPKLAGLRRCGKSCRLRWTNYLRPGLKRGLLSHDEEQLVIDLHANLGNKWSKIASRLPGRTDNEIKNHWNTHIKKKLLKMGIDPMTHQPLNQEPSNIDNSKTIPSNPDDVSVEPKTTNTKYVEISVTTTEEESSSTVTDQNSSMDNENHLIDNIYDDDELFSYLWSDETTKDEASWSDSNFGVGGTLYDHNISGADADFPIWSPERINDEKMFLDYCQDFGVHDFGF

SEQ ID NO: 205 - DNA, 858 bp, Arabidopsis thaliana
  G233,family:MYB-(R1)R2R3
atgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaaccggcggggaacaagatctcttagccgggctctag

SEQ ID NO: 206 - protein, 285 aa, Arabidopsis thaliana
  G233,MYB-(R1)R2R3 domain coordinates 13-115
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMDFWFDVLARTGGEQDLLAGL

SEQ ID NO: 207 - DNA, 1139 bp, Arabidopsis thaliana
  G234,family:MYB-(R1)R2R3
cacaacatcatacccaccaacatatataatcttgatcatagagagataaacagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatggaataacgatctagtttgtttaaatttaaaa

SEQ ID NO: 208 - protein, 309 aa, Arabidopsis thaliana
  G234,MYB-(R1)R2R3 domain coordinates 14-115
MGRAPCCDKANVKKGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKKKLINKQRKELQEACMEQQEMMVMMKRQHQQQQIQTSFMMRQDQTMFTWPLHHHNVQVPALFRIKPTRFATKKMLSQCSSRTWSRSKIKNWRKQTSSSSRFNDNAFDHLSFSQLLLDPNHNHLGSGEGFSMNSILSANTNSPLLNTSNDNQWFGNFQAETVNLFSGASTSTSADQSTISWEDISSLVYSDSKQFF

SEQ ID NO: 209 - DNA, 920 bp, Arabidopsis thaliana
  G237,family:MYB-(R1)R2R3
atggcgaagacgaaatatggagagagacataggaaagggttatggtcacctgaagaagacgagaagctaaggagcttcatcctctcttatggccattcttgctggaccactgttcccatcaaagctgggttacaaaggaatgggaagagctgcagattaagatggattaattacctaagaccagggttaaagagggatatgattagtgcagaagaagaagagactatcttgacgtttcattctcccttgggtaacaagtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggagaaagaaatccggaaaccttgatctcgaatcacgtgttctccctccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccaccaacaacgacgtaaattgcgtttattgtaatgtaaatcaaatttctaaggcaaaaccggaaaaaaaaaaaaaaaaaaaaaaa

SEQ ID NO: 210 - protein, 283 aa, Arabidopsis thaliana
  G237,MYB-(R1)R2R3 domain coordinates 11-113
MAKTKYGERHRKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKKWLKSQSLQDAKSISPPSSSSSSLVACGERNPETLISNHVFSLQRLLENKSSSPSQESNGNNSHQCSSAPEIPRLFFSEWLSSSYPHTDYSSEFTDSKHSQAPNVEETLSAYEEMGDVDQFHYNEMMINNSNWTLNDIVFGSKCKKQEHHIYREASDCNSSAEFFSPPTTT

SEQ ID NO: 211 - DNA, 1046 bp, Arabidopsis thaliana
  G241,family:MYB-(R1)R2R3
gaaaaacatttcaacttcttttatcagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaaaagaagggtactaaaccaaaatctgaatccgtaataacgagctcgaacagtactagaagcgaatcggagctagcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtcgctggtttagttgagatacaacaagagtttcaaaacttgggctccgctaataatgagatgatttttgacagtgagatggaacttctggttcgatgtattggctagaaccggcggggaacaagatctcttagccgggctctagttaacatgtttgaggagtaaagtgaaatggtgcaaattagttaaggctaagaaattcaaaagcttttgtttaccgagaaaaaaacacactctaactcttgatgtgatgtagttagtgtattaattagaggctgcgttttcaa

SEQ ID NO: 212 - protein, 273 aa, Arabidopsis thaliana
  G241,MYB-(R1)R2R3 domain coordinates 14-114
MGRAPCCEKMGLKRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKRLEDYQPAKPKTSNKKKGTKPKSESVITSSNSTRSESELADSSNPSGESLFSTSPSTSEVSSMTLISHDGYSNEINMDNKPGDISTIDQECVSFETFGADIDESFWKETLYSQDEHNYVSNDLEVAGLVEIQQEFQNLGSANNEMIFDSEMELLVRCIG

SEQ ID NO: 213 - DNA, 1195 bp, Arabidopsis thaliana
  G242,family:MYB-(R1)R2R3
ctctcaaaaccaaaatcactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcgggaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtctttttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagacaaagtgagattattaggaaactgtttaaattggagaagaagaaaaatgctctgtttttttctcctttggattaggcttaagaattttgggttttaaggaaatgtatagaggaaatcgagtgaacaaagctcgagagctggggacgtagtgacgaagacgaagatcaaatttctcttaagctattcaggaaaataaaataaatttttattt

SEQ ID NO: 214 - protein, 305 aa, Arabidopsis thaliana
  G242,MYB-(R1)R2R3 domain coordinates 6-106
MADRIKGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRKCGGYDHRGYDGSEDHRPVKRSVSAGSPPVVTGLYMSPGSPTGSDVSDSSTIPILPSVELFKPVPRPGAVVLPLPIETSSFSDDPPTSLSLSLPGADVSEESNRSHESTNINNTTSSRHNHNNTVSFMPFSGGFRGAIEEMGKSFPGNGGEFMAVVQEMIKAEVRSYMTEMQRNNGGGFVGGFIDNGMIPMSQIGVGRIE

SEQ ID NO: 215 - DNA, 981 bp, Arabidopsis thaliana
  G246,family:MYB-(R1)R2R3
atgtatctgtttatgtataaatgtaacatagttttggaggagactcatgtttttcaaaataccccttgtgatgtttcattgcagaggccatttaatgggtttggagaaaacaatgcattaccattgagaaagatgcatcaagaggagaagaagaagaaacataggggtggacactggacactttcagaggatctcaaactcaaagagcttgtggcggtttttggtcctcagaactggaaattcattggagagaagatggaaccaagaacaagtctaagttgtagacaaaggtggtttaaccagctcgatccgaagattaacaaaagaaatttcactgatgaggaagaagagaagctgcttagagctcacatattatatggtaacaaatggtctaagatcgctaagcttttcaatcgaagaacagaccatgctgttaagaatcattggcacagtctcatgaatagaatcattaggaagcaatcagcttctgacataagatctttcgataacatccagaattatcaaacctccaactttcttcctgctcaatgctcaatatctccaagaaaagaattattcttcatgcatgccattgcaacactcatgtcatcatcatcacttctctaccttccctgcaaattccttggccttattcacacctcatgtctccatctctcaaccatcatcatcatcgttactatcatcatcagaagcagaagatataatgactacaaaaaccccgaggtatatagattttctcggggtaggagattcttgaagaaactacttaagaacttcctaactgtaaccttaattccaatgatgaggaagggtgggcgcgccgacccagctttcttgtacaaagttggcattataagaaagcattgctcatcaatttgttgcaacgaacaggtcactatcagtcaaaataaaatcattatttgccatccagctgatatcccctatagtgagtcgtattaa

SEQ ID NO: 216 - protein, 326 aa, Arabidopsis thaliana
  G246,MYB-(R1)R2R3 domain coordinates 57-159
MYLFMYKCNIVLEETHVFQNTPCDVSLQRPFNGFGENNALPLRKMHQEEKKKKHRGGHWTLSEDLKLKELVAVFGPQNWKFIGEKMEPRTSLSCRQRWFNQLDPKINKRNFTDEEEEKLLRAHILYGNKWSKIAKLFNRRTDHAVKNHWHSLMNRIIRKQSASDIRSFDNIQNYQTSNFLPAQCSISPRKELFFMHAIATLMSSSSLLYLPCKFLGLIHTSCLHLSTIIIIVTIIIRSRRYNDYKNPEVYRFSRGRRFLKKLLKNFLTVTLIPMMRKGGRADPAFLYKVGIIRKHCSSICCNEQVTISQNKIIICHPADIPYSESY

SEQ ID NO: 217 - DNA, 660 bp, Arabidopsis thaliana
  G247,family:MYB-(R1)R2R3
atgagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacgacttcgagcttagttcactcactatgatggattttactaatgggtattgcctttga

SEQ ID NO: 218 - protein, 219 aa, Arabidopsis thaliana
  G247,MYB-(R1)R2R3 domain coordinates 15-116
MRMTRDGKEHEYKKGLWTVEEDKILMDYVRTHGQGHWNRIAKKTGLKRCGKSCRLRWMNYLSPNVNRGNFTDQEEDLIIRLHKLLGNRWSLIAKRVPGRTDNQVKNYWNTHLSKKLGLGDHSTAVKAACGVESPPSMALITTTSSSHQEISGGKNSTLRFDTLVDESKLKPKSKLVHATPTDVEVAATVPNLFDTFWVLEDDFELSSLTMMDFTNGYCL

SEQ ID NO: 219 - DNA, 1317 bp, Arabidopsis thaliana
  G248,family:MYB-(R1)R2R3
tcgacagttggtgtttaaatggaattctcattgatctccgatgaaaatttcatcttaaacgatgctcatcgatgtcctgttaatgatgatgcatcgcatataccaaaaaataatcttaactttttcaatgacaatttaggtcaatcttctcgtactggatggtctttttcaccagatctgactgatatctctaatcagcaccaccaaaatcttatacctttgatcccaaattatgattctcaaaatcagaatttggatactaatcaaaaccatttggtttacaactcttcctcctatgaaattccatcaaactacccattcatgagtatcaaatcctactcaaatattgatactcttgagcaatctatgaataacatagtcaacaacggaaaaatccatatgatcgataatcccccaatttttgcaaaccctaagggtatattcgaaaattttcatgatttgcaggaatacactatagggaatgagattgtacacaatgaagaactgactaataagggttatgagccaactcttgataaggtaatgggtgaacctcaattatttgatgtgccagtgctagaaggtatcaaaaatacaaccaacgaaatcatgaatcaacttgaagatgataagatgaaaaaaacttatgagaataaaaaggaggcgagcacaagcaaatatttgaagaaaagtgacatcaccaaaaaaagatggacagaatctgaggacataaaattgaaagagatggtggcacttgaacccaaaaaatggacaaaggtcgcaaaacattttgaaggacgaacaccaaaacaatgcagagagaggtggcataaccatgctcgtcctaacgttaagaaaactacttggagtgaagaagaagatcaaatactaattgaagtacacaaagtaattggtgccaaatggatccagatctcagagcaacttccggggaggagctataacaatgttaagaaccattggaataccacaaagcgtcgggtgcaaaataaaagtggtcgaactgtcaaccgtgtcggcaataacatccttgaaaactacataaggagtatcacaatcaacaacgatgatgaatctgatggtgaaccgacaaacattgagaattatcatgatgactctgaagatatgttatatggggagatgaatttgagtccagaggctataacgcagaccaccaaaccattgaccgatgcttctacaatatcaccttatattccgatgccaaaagaaaactatactctggaggtttgtgaatcactggaggactatctagagctgctgcgttggtgggattaatgc

SEQ ID NO: 220 - protein, 431 aa, Arabidopsis thaliana
  G248,MYB-(R1)R2R3 domain coordinates 264-332
MEFSLISDENFILNDAHRCPVNDDASHIPKNNLNFFNDNLGQSSRTGWSFSPDLTDISNQHHQNLIPLIPNYDSQNQNLDTNQNHLVYNSSSYEIPSNYPFMSIKSYSNIDTLEQSMNNIVNNGKIHMIDNPPIFANPKGIFENFHDLQEYTIGNEIVHNEELTNKGYEPTLDKVMGEPQLFDVPVLEGIKNTTNEIMNQLEDDKMKKTYENKKEASTSKYLKKSDITKKRWTESEDIKLKEMVALEPKKWTKVAKHFEGRTPKQCRERWHNHARPNVKKTTWSEEEDQILIEVHKVIGAKWIQISEQLPGRSYNNVKNHWNTTKRRVQNKSGRTVNRVGNNILENYIRSITINNDDESDGEPTNIENYHDDSEDMLYGEMNLSPEAITQTTKPLTDASTISPYIPMPKENYTLEVCESLEDYLELLRWWD

SEQ ID NO: 221 - DNA, 731 bp, Arabidopsis thaliana
  G249,family:MYB-(R1)R2R3
ccgccgacatggagaaaagagaaagtagtggtgggtctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgcgcgacggggaaatatcacaccagaagaacagctcaccatcatggaacttcatgcaaaatggggaaataggtggtcaaaaattgcaaagcatttaccaggaagaaccgacaatgagataaagaatttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccggttcgatcatgatgccattatctgttgatcagtccgaacaaaactattggagcgtcgatgatctttggcccatgaatatatataatggtaattaataaataagttcgttaaaacttatatatatttacggtccaaagagggttctatataaacagagtactgtatgggattgc

SEQ ID NO: 222 - protein, 214 aa, Arabidopsis thaliana
  G249,MYB-(R1)R2R3 domain coordinates 19-116
MEKRESSGGSGSGDAEVRKGPWTMEEDLILINYIANHGEGVWNSLAKSAGLKRTGKSCRLRWLNYLRPDARRGNITPEEQLTIMELHAKWGNRWSKIAKHLPGRTDNEIKNFWRTKIQKYIIKSGETTTVGSQSSEFINHHATTSHVMNDTQETMDMYSPTTSYQHASNINQQLNYGNYVPESGSIMMPLSVDQSEQNYWSVDDLWPMNIYNGN

SEQ ID NO: 223 - DNA, 624 bp, Arabidopsis thaliana
  G253,family:MYB-(R1)R2R3
atggatccacttaaacaggttcaagaagaaatcaattcattgaggtggaaacgttggacactttcagaggatttgaaactaaaagagcttgtggctgtgtatggtcctcaaaaatggccgcacattggaaagcaaatgcaaggcagatcaggtaagtcttgtagatcaaggtggtataaccatttggatccaaggattaggaatgatgtttttagtgacgaggaagaaaaattgctaatcaaagcttacaacgaatggggttgcaaatggtctaagattgctaggcttttccctggaagaacagacagacaaatgcagagactatggcgattgtttgtacgtgataaaagtacaaagatgccacaagaggaaaccactcacctcgaagctaagtatcgcaacgaaacaatgaattacttagctcatcaacgtcgcttctataacatccctaaaggtttcttggcaatgtccacaccgcctgtctccaactctcaaccatcatcatcatcatcatcaccatcattaccatccaaacccgaagatgcaaaggccaatatacccgcaaagtatatagactttctcgggttaggagattctgaaaagaaaaagaagaaactactatag

SEQ ID NO: 224 - protein, 207 aa, Arabidopsis thaliana
  G253,MYB-(R1)R2R3 domain coordinates 16-116
MDPLKQVQEEINSLRWKRWTLSEDLKLKELVAVYGPQKWPHIGKQMQGRSGKSCRSRWYNHLDPRIRNDVFSDEEEKLLIKAYNEWGCKWSKIARLFPGRTDRQMQRLWRLFVRDKSTKMPQEETTHLEAKYRNETMNYLAHQRRFYNIPKGFLAMSTPPVSNSQPSSSSSSPSLPSKPEDAKANIPAKYIDFLGLGDSEKKKKKLL

SEQ ID NO: 225 - DNA, 1391 bp, Arabidopsis thaliana
  G254,family:MYB-related
cgatttcgagctctatggtgtccgtaaaccctagacctaagggttttccagttttcgattcctcgaatatgagtttaccaagctccgatggatttggttcgattccggccacgggacggaccagtacggtgtcgttttctgaggatccgacgacgaagattcggaagccgtacacaatcaagaagtcgagagagaattggacagatcaagagcacgataaatttctagaagctcttcacttattcgatagggattggaagaaaatagaagcctttgttggatcaaaaacagtagttcagatacgaagccacgctcagaaatactttctcaaagttcagaagagtggtgctaacgaacatcttccacttcctcgacctaagaggaaagcgagtcatccttatcctataaaggctcctaaaaatgttgcttatacctctctcccgtcttcgagtacattaccgttgcttgagcctggttatttgtatagctctgattcgaagtcattgatgggaaaccaggctgtttgtgcatctacctcttcttcgtggaatcatgaatcgacaaatctgccaaaaccggtgattgaagaggaaccgggagtctcggccacggctcctctcccaaataatcgctgcagacaggaagatacagagagggtacgagcagtgacaaagccaaataacgaagaaagttgtgaaaagccacatagagtgatgccgaattttgctgaagtttacagcttcattggaagtgtcttcgatcccaacacatcaggccacctccagagattaaagcagatggatccaataaatatggaaacggttcttttactgatgcaaaacctgtctgtaaatctgacaagtcccgagtttgcagagcaaaggaggttgatatcatcatacagcgctaaagctttgaaatagagatagaataaaacaataatgtaccttatgtgagatcaagagacaatcatccaaggtctgtatgcattgcttggatttaggcctcgtgttctcactacaggagcagaaccaatcgcaaagactcttagatggctactgagttgtggtttttatgtctctgtaagtcgcggtggagcacacgtgtttgtcctgtcttgtgtatgtgtgtatagataatacaaggttttgcagagtaaggtcacagttagctgcaagtgagtttggatcaatcttaagattaaaaccctgagagtgagtgtccaaagagactgtgtaatattggtttggcggtcagcagaagagttttgaagtgcacatccagttagtgataacacggttgaagaaaaggtaaggttacaagtttagttttgaataattgtatactcaaaaaatatgaatgtataaagaataatcacttgagtcgcctta

SEQ ID NO: 226 - protein, 302 aa, Arabidopsis thaliana
  G254,MYB-related domain coordinates 60-106
MVSVNPRPKGFPVFDSSNMSLPSSDGFGSIPATGRTSTVSFSEDPTTKIRKPYTIKKSRENWTDQEHDKFLEALHLFDRDWKKIEAFVGSKTVVQIRSHAQKYFLKVQKSGANEHLPLPRPKRKASHPYPIKAPKNVAYTSLPSSSTLPLLEPGYLYSSDSKSLMGNQAVCASTSSSWNHESTNLPKPVIEEEPGVSATAPLPNNRCRQEDTERVRAVTKPNNEESCEKPHRVMPNFAEVYSFIGSVFDPNTSGHLQRLKQMDPINMETVLLLMQNLSVNLTSPEFAEQRRLISSYSAKALK

SEQ ID NO: 227 - DNA, 891 bp, Arabidopsis thaliana
  G255,family:MYB-(R1)R2R3
agcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtctgataatgaatgttagattc

SEQ ID NO: 228 - protein, 269 aa, Arabidopsis thaliana
  G255,MYB-(R1)R2R3 domain coordinates 14-116
MGRSPCCEKEHMNKGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKLLSKGIDPATHRGINEAKISDLKKTKDQIVKDVSFVTKFEETDKSGDQKQNKYIRNGLVCKEERVVVEEKIGPDLNLELRISPPWQNQREISTCTASRFYMENDMECSSETVKCQTENSSSISYSSIDISSSNVGYDFLGLKTRILDFRSLEMK

SEQ ID NO: 229 - DNA, 1547 bp, Arabidopsis thaliana
  G256,family:MYB-(R1)R2R3
tcgtgagcgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtttgctaaggtgtagcaagagttgcagacttagatggactaattaccttcgtcccgggatcaaacgaggaaatttcactcaaccggaagagaagatgatcatccaccttcaagctcttttgggaaatagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtggtcaagtcgatgaagatcaaactgtgatatactatttatatgtaaagtactataaagttaagagtagttgaataaaaaaaaaaaaaaaaaa

SEQ ID NO: 230 - protein, 332 aa, Arabidopsis thaliana
  G256,MYB-(R1)R2R3 domain coordinates 14-116
MGRPPCCEKIEVKKGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKLVMMKFQNGIINENKTNLATDISSCNNNNNGCNHNKRTTNKGQWEKKLQTDINMAKQALFQALSLDQPSSLIPPDPDSPKPHHHSTTTYASSTDNISKLLQNWTSSSSSKPNTSSVSNNRSSSPGEGGLFDHHSLFSSNSESGSVDEKLNLMSETSMFKGESKPDIDMEATPTTTTTTTDDQGSLSLIEKWLFDDQGLVQCDDSQEDLIDVSLEELK

SEQ ID NO: 231 - DNA, 998 bp, Arabidopsis thaliana
  G258,family:MYB-(R1)R2R3
agtgaccaccctgctggttaatcaacaccaagagaccttgtaatatataagttaggaagatgagagagaagtgggaaatgaaaagagatgaaatgggacatcgatgttgtggaaaacacaaagtgaagagaggtctttggtctccagaggaagacgagaagcttcttcgttatatcaccactcatggtcatcctagttggagttccgttccaaagcttgccgggttgcagagatgtgggaagagttgcagattaaggtggataaactatctaaggcctgatctgaggagaggttcgtttaatgaggaagaagagcagattatcatcgacgtacatcgtattcttggtaacaaatgggctcagattgctaagcacttacctggacgcactgataatgaagtcaagaacttttggaactcatgcattaagaagaaacttctttctcaaggcttagatccttctacacataatcttatgccttcacacaaaagatcttcttcttcaaacaataataatatccccaagccaaacaaaacgacgtccatcatgaagaaccctactgatcttgatcaatcaaccactgctttttcaatcacaaacatcaatccacccacttccactaaaccaaacaaacttaaatctcctaaccagactacaatcccatctcaaaccgtgatccctatcaatgataacatgtcaagtactcaaaccatgatccctatcaatgatcccatgtcaagtcttttagatgatgagaatatgattcctcactggtcagatgttgatggaatggcgatccacgaagctccgatgttgcctagtgataaggcagtagtgggagtggatgatgatgatctcaacatggacattttgtttaacactccttcttcttctgcttttgatcctgattttgcttccattttctcctctgcaatgtctatcgatttcaatcccatggatgatcttggcagctggaccttttagcttttactctacagc

SEQ ID NO: 232 - protein, 307 aa, Arabidopsis thaliana
  G258,MYB-(R1)R2R3 domain coordinates 24-124
MREKWEMKRDEMGHRCCGKHKVKRGLWSPEEDEKLLRYITTHGHPSWSSVPKLAGLQRCGKSCRLRWINYLRPDLRRGSFNEEEEQIIIDVHRILGNKWAQIAKHLPGRTDNEVKNFWNSCIKKKLLSQGLDPSTHNLMPSHKRSSSSNNNNIPKPNKTTSIMKNPTDLDQSTTAFSITNINPPTSTKPNKLKSPNQTTIPSQTVIPINDNMSSTQTMIPINDPMSSLLDDENMIPHWSDVDGMAIHEAPMLPSDKAVVGVDDDDLNMDILFNTPSSSAFDPDFASIFSSAMSIDFNPMDDLGSWTF

SEQ ID NO: 233 - DNA, 896 bp, Arabidopsis thaliana
  G259,family:HS
gagatcttctactacttgttttcttcaagaataataattttcgttttatatatggaagatgctggtgaacatttacggtgtaacgataacgttaacgacgaggagcgtttgccattggagtttatgatcggaaactcaacatccacggcggagctacagccgcctccaccgttcttggtaaagacatacaaagtggtggaggatccgacgacggacggggttatatcttggaacgaatacggaactggtttcgtcgtgtggcagccggcagaattcgctagagatctgttaccaacacttttcaagcattgcaacttctctagcttcgttcgccagctcaatacttacggttttcgaaaagtaacgacgataagatgggaatttagtaatgagatgtttcgaaaggggcaaagagagcttatgagcaatatccgaagaaggaagagccaacattggtcacacaacaagtctaatcaccaggttgtaccaacaacaacgatggtgaatcaagaaggtcatcaacggattgggattgatcatcaccatgaggatcaacagtcttccgccacttcatcctctttcgtatacactgcattactcgacgaaaacaaatgcttgaagaatgaaaacgagttattaagctgcgaacttgggaaaaccaagaagaaatgcaagcagcttatggagttggtggagagatacagaggagaagacgaagatgcaactgatgaaagtgatgatgaagaagatgaagggcttaagttgttcggagtaaaacttgaatgaaactagattgctagattgatattcgtaatataccagtttcttcatattcttagaagttttgcataactatatatagtactcttttaagacatgcaagatcagaacatatg

SEQ ID NO: 234 - protein, 244 aa, Arabidopsis thaliana
  G259,HS domain coordinates 40-131
MEDAGEHLRCNDNVNDEERLPLEFMIGNSTSTAELQPPPPFLVKTYKVVEDPTTDGVISWNEYGTGFVVWQPAEFARDLLPTLFKHCNFSSFVRQLNTYGFRKVTTIRWEFSNEMFRKGQRELMSNIRRRKSQHWSHNKSNHQVVPTTTMVNQEGHQRIGIDHHHEDQQSSATSSSFVYTALLDENKCLKNENELLSCELGKTKKKCKQLMELVERYRGEDEDATDESDDEEDEGLKLFGVKLE

SEQ ID NO: 235 - DNA, 1904 bp, Arabidopsis thaliana
  G261,family:HS
gctgcttgaaattctcttgtctgattaaaatatatatacccaagtccagaagctgtttaggttcgagaagcagagagggttcgagaagctaataagggtttcttctttttgattttaatgctaaaagggttctagattcgttgaattttacaagggttttaggggttcttagaagcttttgcttgattgtcttttatttagaaacagtggtgagtttttagtctttcactttgttcaagttcgaagctttttttggagggaattttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatggttttagaaaagctgatcctgagcaatgggaatttgcgaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcat

SEQ ID NO: 236 - protein, 401 aa, Arabidopsis thaliana
  G261,HS domain coordinates 15-106
MDENNHGVSSSSLPPFLTKTYEMVDDSSSDSIVSWSQSNKSFIVWNPPEFSRDLLPRFFKHNNFSSFIRQLNTYGFRKADPEQWEFANDDFVRGQPHLMKNIHRRKPVHSHSLPNLQAQLNPLTDSERVRMNNQIERLTKEKEGLLEELHKQDEEREVFEMQVKELKERLQHMEKRQKTMVSFVSQVLEKPGLALNLSPCVPETNERKRRFPRIEFFPDEPMLEENKTCVVVREEGSTSPSSHTREHQVEQLESSIAIWENLVSDSCESMLQSRSMMTLDVDESSTFPESPPLSCIQLSVDSRLKSPPSPRIIDMNCEPDGSKEQNTVAAPPPPPVAGANDGFWQQFFSENPGSTEQREVQLERKDDKDKAGVRTEKCWWNSRNVNAITEQLGHLTSSERS

SEQ ID NO: 237 - DNA, 1104 bp, Arabidopsis thaliana
  G263,family:HS
tttttagttttatttttctgtggtaaaataaaaaaagttcgccggagatgacggctgtgacggcggcgcaaagatcagttccggcgccgtttttaagcaaaacgtatcagctagttgatgatcatagcacagacgacgtcgtttcatggaacgaagaaggaacagcttttgtcgtgtggaaaacagcagagtttgctaaagatcttcttcctcaatacttcaagcataataatttctcaagcttcattcgtcagctcaacacttacggatttcgtaaaactgtaccggataaatgggaatttgcaaacgattatttccggagaggcggggaggatctgttgacggacatacgacggcgtaaatcggtgattgcttcaacggcggggaaatgtgttgttgttggttcgccttctgagtctaattctggtggtggtgatgatcacggttcaagctccacgtcatcacccggttcgtcgaagaatcctggttcggtggagaacatggttgctgatttatcaggagagaacgagaagcttaaacgtgaaaacaataacttgagctcggagctcgcggcggcgaagaagcagcgcgatgagctagtgacgttcttgacgggtcatctgaaagtaagaccggaacaaatcgataaaatgatcaaaggagggaaatttaaaccggtggagtctgacgaagagagtgagtgcgaaggttgcgacggcggcggaggagcagaggagggggtaggtgaaggattgaaattgtttggggtgtggttgaaaggagagagaaaaaagagggaccgggatgaaaagaattatgtggtgagtgggtcccgtatgacggaaataaagaacgtggactttcacgcgccgttgtggaaaagcagcaaagtctgcaactaaaaaaagagtagaagactgttcaaaccagcgtgtgacacgtcatcgacgacgacgaaaaaaatgatttaaaaaactatttttttccgtaaggaagaaaagttatttttatgttttaaaaaggtgaagaaggtccagaaggatcaacgcaaatatataaatggattttcatgtattatataatttaattagtgtattaagaaaa

SEQ ID NO: 238 - protein, 284 aa, Arabidopsis thaliana
  G263,HS domain coordinates 14-105
MTAVTAAQRSVPAPFLSKTYQLVDDHSTDDVVSWNEEGTAFVVWKTAEFAKDLLPQYFKHNNFSSFIRQLNTYGFRKTVPDKWEFANDYFRRGGEDLLTDIRRRKSVIASTAGKCVVVGSPSESNSGGGDDHGSSSTSSPGSSKNPGSVENMVADLSGENEKLKRENNNLSSELAAAKKQRDELVTFLTGHLKVRPEQIDKMIKGGKFKPVESDEESECEGCDGGGGAEEGVGEGLKLFGVWLKGERKKRDRDEKNYVVSGSRMTEIKNVDFHAPLWKSSKVCN

SEQ ID NO: 239 - DNA, 1613 bp, Arabidopsis thaliana
  G264,family:HS
cttgtaccagtttctgattagattcaacaatgaacggcgcattaggtaactcctccgcctccgttagcggcggagaaggagccggaggaccagcgcctttcttggtgaaaacctacgagatggtcgacgattcatcaacggaccagatcgtatcgtggagcgctaacaacaacagcttcatcgtttggaatcatgccgaattttcacgcctccttcttccaacctacttcaaacacaataacttctcttccttcattcgtcagctcaatacctatgggtttaggaagattgatccagagaggtgggagtttttgaatgatgattttattaaggatcagaagcatcttctcaagaatatacatagaaggaaacctatacacagccacagtcatccacctgcttcgtcgactgatcaagaaagagcagtgttgcaagagcaaatggacaagctttcacgtgagaaagctgcaattgaagctaagcttttaaagttcaaacaacagaaggttgtagcaaagcatcagtttgaagaaatgactgagcatgttgatgatatggagaataggcagaagaagctgctgaattttttggaaactgcgattcggaatcctacttttgttaagaattttggtaagaaagtcgagcagttggatatttcagcttacaacaaaaagcgaaggctccctgaagttgagcaatcaaagccaccttcagaagattctcatctggataatagtagtggtagctcgagacgcgagtctggaaacatttttcatcaaaatttctctaataaattgcgactagagctttctccagctgattcagatatgaacatggtttcacacagtatacaaagttccaatgaagaaggtgcgagtcccaaagggatactgtcaggaggtgatccaaatactacactaacaaaaagagaaggcctaccatttgcacctgaagctctagagcttgcggataccgggacatgcccgaggagattactgttaaatgataatacaagggtggagaccttgcagcagaggctaacttcttcagaggagactgatggtagcttttcatgtcatttaaatctaaccctggcttctgctccgttaccggacaaaacagcttcacagatagctaagacgactcttaaaagtcaggagttaaactttaactcaatagaaacaagtgcaagtgagaaaaatcggggtagacaagagattgcagttggaggtagccaagcaaatgcagctcctccagcaagagtgaatgatgtattctgggaacagttcctaacagaaaggccagggtcttcagataatgaggaggcaagttcgacttatagaggtaacccatacgaagagcaagaggagaaaagaaacgggagtatgatgttacgtaatacaaagaatatcgagcagctgaccttataaactatttggacggttacatcaacgagagtacgaactgaggttttggtaagaagtatgggtgagtaagtaatgaaacattggactgaaaaagcgtaagtagctttgttgtaaacacttgcgtctctgtctacacaagtaatttgactgtaaatgtaagtgtacaggatttaaattgaataagca

SEQ ID NO: 240 - protein, 466 aa, Arabidopsis thaliana
  G264,HS domain coordinates 23-114
MNGALGNSSASVSGGEGAGGPAPFLVKTYEMVDDSSTDQIVSWSANNNSFIVWNHAEFSRLLLPTYFKHNNFSSFIRQLNTYGFRKIDPERWEFLNDDFIKDQKHLLKNIHRRKPIHSHSHPPASSTDQERAVLQEQMDKLSREKAAIEAKLLKFKQQKVVAKHQFEEMTEHVDDMENRQKKLLNFLETAIRNPTFVKNFGKKVEQLDISAYNKKRRLPEVEQSKPPSEDSHLDNSSGSSRRESGNIFHQNFSNKLRLELSPADSDMNMVSHSIQSSNEEGASPKGILSGGDPNTTLTKREGLPFAPEALELADTGTCPRRLLLNDNTRVETLQQRLTSSEETDGSFSCHLNLTLASAPLPDKTASQIAKTTLKSQELNFNSIETSASEKNRGRQEIAVGGSQANAAPPARVNDVFWEQFLTERPGSSDNEEASSTYRGNPYEEQEEKRNGSMMLRNTKNIEQLTL

SEQ ID NO: 241 - DNA, 2253 bp, Arabidopsis thaliana
  G268,family:AKR
cgctgatccttcacacgcaagctaatgaagcctctcactaatggcgatctgttcaaatccccaactctgatcaagatctccgccttagttttcgtcaccgtcgctttcttctacttaggcaagcattggtccgacgatggctaccaacagctcgtcttcttctcctcttccacttccggtagctcgatcccggaggtctccgtttcaccgaatagtaacagagtctttaatttatcagcgataattcctactaaccatacccagattgaaatccccgccacaatacgacaacaacctccgtcggtggtggcggacacggagaaggttaaggtggaagctaatcctcctcctcctccacctccttctccttcacctcctcctccgcctggtccggttaagagctttgggatagttgatgcgaacggtgtgatgtctgacgattttgaggtgggtgaggttgagagtgatacagtggaagattgggggaatcagactgagatcgttgaggcgaaaagcgacggtgattctaaggctagggttagaattaagaaatttgggatgtgtcctgagagtatgagagagtatataccttgtttggataatactgatgtgataaagaagcttaaatcgacagagcgaggtgagagattcgagcgtcattgtcctgagaaaggtaaaggcttgaattgcttagttccacctcctaaaggttaccgtcagccgattccatggcctaaaagccgtgacgaggtatggtttagcaatgttcctcatactcggcttgttgaagacaaaggaggtcagaactggatttcacgagacaagaacaagttcaagtttcctggaggtggtacacagtttattcatggggctgatcagtacttggaccagatgtctaagatggtttctgatattacgtttggcaagcatattagggttgctatggatgttggttgtggtgtggcgagttttggtgcttatctattgtctcgtgatgtcatgacaatgtctgttgcaccaaaagatgtccatgagaaccaaattcaatttgctcttgagcgtggtgtgcctgctatggcggcagcatttgcgacaaggcgtttgttatatccaagccaagcttttgatcttattcattgttcaagatgtagaatcaactggactcgtgatgatggaattttgctccttgagatcaatagaatgctgcgcgctggaggatattttgcttgggctgcacagcctgtttataagcatgaacccgctttggaagaacaatggacagaaatgctgaatcttactattagcctctgctggaaattggtaaagaaggaaggatacgttgcaatctggcagaagcctttcaacaacgactgctatttgagtcgtgaggctgggactaaacctcctctttgtgatgaatcagatgatcccgataatgtttggtacacaaatctgaaaccttgcatcagtcgcatacctgagaaagggtacggaggaaacgtccccttatggcctgcccgtctgcatactccacctgataggctgcagacgataaaatttgattcctacattgctaggaaagagctattcaaggcagaatcaaaatattggaatgaaataattgggggctatgttcgcgccttaaaatggaaaaagatgaaactaagaaatgttttggacatgagagcaggctttggcggatttgcagctgcactaaatgatcataaactcgattgctgggttctaagcgtggttcctgtcagtgggcctaacacattgcctgtcatttatgaccgtggactgttaggagtgatgcacgattggtgtgaaccatttgatacatacccacggacatatgacttcttacatgcctctggactcttctcgatcgagagaaaaagatgtgagatgtcaaccatattgttagagatggaccggatattaagacccggtggaagagcatacattagggattcaattgatgttatggatgaaattcaagaaatcacaaaggccatgggttggcatacttctctgcgtgacacatccgagggtcctcacgcaagttacaggattctaacatgcgagaagcgtctccttcgagcttaataccacacaagttactgcactagtcaacacaatatattttgtttggtagtatatctcttattgttttcttcttttttctcttaatgtaactgtaaatttgattgtggtgttttactgagtaaaagtttacctcgtcctcaaaaa

SEQ ID NO: 242 - protein, 694 aa, Arabidopsis thaliana
  G268,AKR domain coordinates 186-689
MKPLTNGDLFKSPTLIKISALVFVTVAFFYLGKHWSDDGYQQLVFFSSSTSGSSIPEVSVSPNSNRVFNLSAIIPTNHTQIEIPATIRQQPPSVVADTEKVKVEANPPPPPPPSPSPPPPPGPVKSFGIVDANGVMSDDFEVGEVESDTVEDWGNQTEIVEAKSDGDSKARVRIKKFGMCPESMREYIPCLDNTDVIKKLKSTERGERFERHCPEKGKGLNCLVPPPKGYRQPIPWPKSRDEVWFSNVPHTRLVEDKGGQNWISRDKNKFKFPGGGTQFIHGADQYLDQMSKMVSDITFGKHIRVAMDVGCGVASFGAYLLSRDVMTMSVAPKDVHENQIQFALERGVPAMAAAFATRRLLYPSQAFDLIHCSRCRINWTRDDGILLLEINRMLRAGGYFAWAAQPVYKHEPALEEQWTEMLNLTISLCWKLVKKEGYVAIWQKPFNNDCYLSREAGTKPPLCDESDDPDNVWYTNLKPCISRIPEKGYGGNVPLWPARLHTPPDRLQTIKFDSYIARKELFKAESKYWNEIIGGYVRALKWKKMKLRNVLDMRAGFGGFAAALNDHKLDCWVLSVVPVSGPNTLPVIYDRGLLGVMHDWCEPFDTYPRTYDFLHASGLFSIERKRCEMSTILLEMDRILRPGGRAYIRDSIDVMDEIQEITKAMGWHTSLRDTSEGPHASYRILTCEKRLLRA

SEQ ID NO: 243 - DNA, 1537 bp, Arabidopsis thaliana
  G270,family:AKR
gataatgcagtcactgtccacgccacacaccatctctcttcttctccccagaacctctccgtctcgtctttctccctctcttcactcccttgctttccccactcgattacggtctctttcctattcttctcaaacgtcgatcctccccgatgccggcgatgatttcattgtcggtgactgtctcgtctacgaggacggcgtcttcgaagacccttaccttgataaggaggtcactcaggttgcgaagcaggagcgcaagaagaatcggcgtggcggggctaagagattagatgaatccgagattgagcccgagaacctcgtgccagaggaatggagggatattcaggcggaggtgaatctgacgaagaaggacaagcgcaaaatagcgcaggagatggagttcggggttcgggtggagaagaagaggcaagggctaattccgctgaggaaagttgacttgaatgactttctcacgtacaaggaagccaagttggctcaattgaggcctgtcattctcgataaaccgggaaatttctccgacgacagtggagcgtcaagcgatggagagaccgctgtatcatctcccagcgagcgagtggctcctaagaaccctagatgggcagtttacggaaagggattcgaccacgttgccaagttcttcaatagcgacaagtacgatcccagcgacaagaaatccgacggccctcgaaagctgctttcaaaagaagagaagtttatgctcaatagccggaatcctgacctagccgttgccacatcaaaaaaatggcttcctcttcacacactggcagcatgtggagagttttatctggttgattccttgctaaagcacaatcttgatatcaatgcaaccgatgtgggcggcttgacagtacttcaccgagcaatcattggtaagaagcaggctattactaactacctgctgagggaatcggcaaatccatttgttcttgatgacgaaggtgcgaccttgatgcactatgctgtgcaaacagcatcagctcccacaataaaacttctcctactgtataacgctgatataaacgctcaggacagggacgggtggactccactgcacgttgcagtacaggccagaagaagcgacattgtaaagcttcttttgataaaaggggcggacatagaagtgaagaacaaggatgggttaactccgcttgggctttgcctctaccttggaagagagataaggacgtatgaggtgatgaagctgttgaaagagtttccacttagcagacacaagaagagattggtaacaacagatgaagatattgaatagtcctttcaatttcagcttgaagtacactcacttatgagaacctgagaaaaggagatggaggtaaaggtgatgattagggcattggaacctcggagtcggagtgggtccactgtctcacttccttaaatttggtttgctgttagtcttatccatcgattttggatatttatcacaacttgatccattcttaaagaaaatatctgaaaataaaaaaaaaaaaaaaaa

SEQ ID NO: 244 - protein, 435 aa, Arabidopsis thaliana
  G270,AKR domain coordinates 259-424
MQSLSTPHTISLLLPRTSPSRLSPSLHSLAFPTRLRSLSYSSQTSILPDAGDDFIVGDCLVYEDGVFEDPYLDKEVTQVAKQERKKNRRGGAKRLDESEIEPENLVPEEWRDIQAEVNLTKKDKRKIAQEMEFGVRVEKKRQGLIPLRKVDLNDFLTYKEAKLAQLRPVILDKPGNFSDDSGASSDGETAVSSPSERVAPKNPRWAVYGKGFDHVAKFFNSDKYDPSDKKSDGPRKLLSKEEKFMLNSRNPDLAVATSKKWLPLHTLAACGEFYLVDSLLKHNLDINATDVGGLTVLHRAIIGKKQAITNYLLRESANPFVLDDEGATLMHYAVQTASAPTIKLLLLYNADINAQDRDGWTPLHVAVQARRSDIVKLLLIKGADIEVKNKDGLTPLGLCLYLGREIRTYEVMKLLKEFPLSRHKKRLVTTDEDIE

SEQ ID NO: 245 - DNA, 1379 bp, Arabidopsis thaliana
  G271,family:AKR
ttaaggcaagaacttttctataaaatagatcttgactttcttcttctcctatctaagttcaattcatttgatattccttctaaaaatggggcaacaacaatcacagtccaaggatgagatgctgtttcaagaagtgagtaacaacaacgtcgaaggtatcaaatcacttcaccatgaaggagcaggactcgagggggtggataaattagggagaacaccattaatcttagcttgtacgaacgacgatctatatgatgtagcaaaaactctgcttgagttgggctccaatgtcaatgcttatcgttctggttgcaatggtgggactcctctgcaccatgctgcaaaaagaggtctcgtacacacggttaagttacttctgtctcacggtgcaaatccattggttcttgatgatgatgttaagacagctctcgaggttgctagagatgaaggttacagtaatgtcgtacgcgcaatcgagagtcatatctgcttgttctctggttgtatgcgtgagtattctggctccagcttgcttaatttatttgctcctcagcttctttcaagaaaagtatgggtagttgtcgtaccaactggttcaagaaaccctacaaagcctttaaagttggagttggttctgtatgatagtattcaggatgcacaaccaagaatggtgatacctttgtggaaagcaaacttagaggaaccaaaatcatttcggtgtgatgattcagtgatgattattgatgactccagaagtccaaagtccatgaggcagagaagagaaagcggattcatttctcaggcgaggcgttgggctcaagtcgatagagaaatacgtcttaagctagcagctgagatcaaaggcgacatgaaacagatgaattggttttctgaggcatgtaaaggagttccacagccaatgaatcctccaaggtttatgaaaacatctcaagcaacaacaacaacaaccaatgttcctgcactaagtgatgatgctttgactcgtgtcgccatgtcacttccttctccaaaaactgcgaataaagaagatggactgtgtgtgatttgtgtggatgcaccatctgaagcagtgtgtgtgccgtgtggacatgtcgccggatgcatttcttgcttgaaagagattgaaaacaagaaaatgggatgtcctgtttgtcgcgccaacattgatcaggtcattaagctatatcatgtttgaagcatatctcctctatggctggaagatattgaaactatctcctattttttactttgtctttaaaagataactacaaatttttttattgtgtgtatgttatgtggtgaagtcaaagaagtcgaaatatagaatcacgacaagtttagtttgtctttttatcaaa

SEQ ID NO: 246 - protein, 376 aa, Arabidopsis thaliana
  G271,AKR domain coordinates 41-106,325-363
MGQQQSQSKDEMLFQEVSNNNVEGIKSLHHEGAGLEGVDKLGRTPLILACTNDDLYDVAKTLLELGSNVNAYRSGCNGGTPLHHAAKRGLVHTVKLLLSHGANPLVLDDDVKTALEVARDEGYSNVVRAIESHICLFSGCMREYSGSSLLNLFAPQLLSRKVWVVVVPTGSRNPTKPLKLELVLYDSIQDAQPRMVIPLWKANLEEPKSFRCDDSVMIIDDSRSPKSMRQRRESGFISQARRWAQVDREIRLKLAAEIKGDMKQMNWFSEACKGVPQPMNPPRFMKTSQATTTTTNVPALSDDALTRVAMSLPSPKTANKEDGLCVICVDAPSEAVCVPCGHVAGCISCLKEIENKKMGCPVCRANIDQVIKLYHV

SEQ ID NO: 247 - DNA, 2330 bp, Arabidopsis thaliana
  G274,family:AKR
agctttatactttctggctactgcaagctcatcagtgaaaagagcttaaaccagagagatctgataagagaaattttagagtctctctgcttcaacaagatctacatcgaccaggagattagaaagaatcatgggttctaagcataacccaccagggaataacagatcgagaagtacactatctctactcgttgtggttggtttatgttgtttcttctatcttcttggagcatggcaaaagagtgggtttggtaaaggagatagcatagctatggagattacaaagcaagcgcagtgtactgacattgtcactgatcttgattttgaacctcatcacaacacagtgaagatcccacataaagctgatcccaaacctgtttctttcaaaccgtgtgatgtgaagctcaaggattacacgccttgtcaagagcaagaccgagctatgaagttcccgagagagaacatgatttacagagagagacattgtcctcctgataatgagaagctgcgttgtcttgttccagctcctaaagggtatatgactcctttcccttggcctaaaagcagagattatgttcactatgctaatgctcctttcaagagcttgactgtcgaaaaagctggacagaattgggttcagtttcaagggaatgtgtttaaattccctggtggaggaactatgtttcctcaaggtgctgatgcgtatattgaagagctagcttctgttatccctatcaaagatggctctgttagaaccgcattggacactggatgtggggttgctagttggggtgcttatatgcttaagaggaatgttttgactatgtcgtttgcgccaagggataaccacgaagcacaagtccagtttgcgcttgagagaggtgttccagcgattatcgctgttcttggatcaatccttcttccttaccctgcaagagcctttgacatggctcaatgctctcgatgcttgataccatggaccgcaaacgagggaacatacttaatggaagtagatagagtcttgagacctggaggttactgggtcttatcgggtcctccaatcaactggaagacatggcacaagacgtggaaccgaactaaagcagagctaaatgccgagcaaaagagaatagagggaatcgcagagtccttatgctgggagaagaagtatgagaagggagacattgcaattttcagaaagaaaataaacgatagatcatgcgatagatcaacaccggttgacacctgcaaaagaaaggacactgacgatgtctggtacaaggagatagaaacgtgtgtaacaccattccctaaagtatcaaacgaagaagaagttgctggaggaaagctaaagaagttccccgagaggctattcgcagtgcctccaagtatctctaaaggtttgattaatggcgtcgacgaggaatcataccaagaagacatcaatctatggaagaagcgagtgaccggatacaagagaattaacagactgataggttccaccagataccgtaatgtgatggatatgaacgccggtcttggtggattcgctgctgcgcttgaatcgcctaaatcgtgggttatgaatgtgattccaaccattaacaagaacacattgagtgttgtttatgagagaggtctcattggtatctatcatgactggtgtgaaggcttttcaacttatccaagaacatacgatttcattcacgctagtggtgtcttcagcttgtatcagcacagctgcaaacttgaggatattcttcttgaaactgatcggattttacgaccggaagggattgtgattttccgggatgaggttgatgttttgaatgatgtgaggaagatcgttgatggaatgagatgggatactaagttaatggatcatgaagacggtcctctcgtgccggagaagattcttgtcgccacgaagcagtattgggtagccggcgacgatggaaacaattctccgtcgtcttctaatagtgaagaagaataaaacaaaaacaaaaaactcctcaggttactaagcttgaagtgtagatctattttacaacatctggaaaattcttatcaaaaaaggaaggaatcagaatttccattaaagaaaggtgtcaaaaaaaagttgtaaaactatatagtagtgatcaagacgaatatgtgcatttatgttttatttttgttccctagtttttaattttatttttttgaaggaagaaaaaattagttccatgtgtttttgcaagatagttgaaaccttggacgcttgttatgtatgatgcgatcttgacattttttaataacagttattttaaataaatttatgatataaa

SEQ ID NO: 248 - protein, 621 aa, Arabidopsis thaliana
  G274,AKR domain coordinates 94-600
MGSKHNPPGNNRSRSTLSLLVVVGLCCFFYLLGAWQKSGFGKGDSIAMEITKQAQCTDIVTDLDFEPHHNTVKIPHKADPKPVSFKPCDVKLKDYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATKQYWVAGDDGNNSPSSSNSEEE

SEQ ID NO: 249 - DNA, 2930 bp, Arabidopsis thaliana
  G275,family:AKR
tcaaaatcgtaaagatcagaatcaatattctcttgccacatatatcctttatagatacacctttctctcccgcatcttcaacatatatccagggccagtgcaattttctcgagaaagtgacggaaaatggctccgcagctgcaaaattgagattcggattctcccttctttcgtcactctcattcattctcgcctgtatcaggcgtacacgcgttgttatcatctgttgcttatatttgaaccatggcgcaaccaaggtacactaggatagataacaggaggccctcatcaaattattgctctacagtgacagtagttgtgtttgtggccctatgcttagtcgggatctggatgatgacatcatcttctgttggaccggctcagaatgttgatgaggtttctctggacaacaaagatgggataaagaaacagatgaccccacctgcagaggagggtaatggtcagaagtttgaagacgcacctgttgaaacaccgaacgaggataaaaaaggagatggtgatgcaagcttgcccaaagaggatgagagctcaagcaaacaagataaccaggaagagaagaaagaagagaaaactaaagaagagtttactccatccagtgagacgaaaagtgagaccgaaggtggggaagatcaaaaagatgactccaagtcagaaaatggtggtggaggtgatttagatgagaaaaaagatttgaaagacaactcagatgaagaaaatcctgacacaaatgaaaagcaaactaaaccagaaacagaggacaatgagttgggtgaggatggtgaaaaccaaaagcaatttgagtctgataacggtgagaaaaaatccattgatgatgataaaaaatccagtgatgatgataaagaaaacaagacaggcaacgaagatactgaaaccaagactgagaaggaaaacactgagacaaatgtggatgttcaagtagagcaagagggtcaatccaaaaacgagacctcaggtgatctttcacctcctggggcacaattagagctactgaatgaaactaccgcacagaatggttcattttcaacccaggcaacagagtccaaaaatgagaaagaagctcagaagggttctggtgataaacttgattacaaatgggcactatgcaatacaacagcaggacctgattacattccctgtctcgataatgtgcaagccattaggagtcttccgagtactaaacattacgagcatcgtgagaggcattgcccagacagcccacccacctgccttgttcctttgcctgatggatacaagcggccaattgagtggcccaaaagtcgagaaaagatctggtacaccaacgtccctcataccaagcttgctgagtataaggggcatcaaaattgggttaaagttaccggtgagtatctaacttttcctggtggaggaacccaattcaagcatggtgctcttcattacatcgatttcatacaggagtctgtccctgctattgcatggggtaaacgctctcgtgtggtcctggatgttggatgcggtgttgcaagctttggaggtttcctctttgacagagatgtgatcactatgtctcttgcacctaaagatgaacatgaagctcaggtgcaatttgctcttgagaggggcattcccgccatttctgcagttatgggcacgacaaggctacctttccctggcagagtttttgacatagttcattgtgctcgctgtagagtgccatggcacattgaaggtggtaaacttctcctggagcttaaccgtgtattgagacccggtgggttctttgtgtggtctgctactcctgtttatcagaagaagaccgaagatgttgaaatttggaaagctatgagtgaactcattaagaagatgtgttgggaactcgtatccattaacaaggacactatcaatggagtaggtgttgctacttacagaaagccaacttcaaatgagtgctacaaaaacagatcagaaccggtgcctccaatttgtgcagactctgatgatccaaatgcatcttggaaagtgccgcttcaagcatgcatgcacaccgcgccagaagacaaaacgcaacgtggatctcagtggcccgaacaatggccagcgagattagagaaagcaccgttctggttatcaagttcccagactggagtttacggaaaagcagcaccagaggatttcagtgctgattatgagcactggaaacgcgtagtgaccaaatcataccttaatggtttaggaatcaactgggcatctgttagaaatgtgatggacatgagagccgtttatggaggttttgcggcagctctaagagatctgaaagtgtgggtcatgaatgtggttccaatagattcaccagacacacttgcaataatctatgaacgaggactctttggtatctaccacgattggtgcgaatctttcagtacatacccgagatcatatgatctccttcacgccgaccatcttttctccaaactcaaacaaaggtgcaatctaactgcggtgatagcagaagtggatcgtgttttgagaccggaagggaaactgatagttctagacgatgcggaaacaatacagcaagtggaaggcatggtgaaagcgatgaaatgggaagttcgaatgacttattctaaggaaaaagaaggtttgctctctgttcaaaaatcaatctggcgacccagtgaagtggaaacactcacttacgctatcggttgagaagacttacttcaagtcccactcttttttgtacgtataaaaacactcttattaactccatatcatccctttttttgttggttcgtcttttaggaagttctttttttttagctgttgagtcatttgtttgtactattcgcacatttttgtgttcttgaaggtgaagaactctattgaggttctttggtaaagttaaa

SEQ ID NO: 250 - protein, 829 aa, Arabidopsis thaliana
  G275,AKR domain coordinates 308-813
MAQPRYTRIDNRRPSSNYCSTVTVVVFVALCLVGIWMMTSSSVGPAQNVDEVSLDNKDGIKKQMTPPAEEGNGQKFEDAPVETPNEDKKGDGDASLPKEDESSSKQDNQEEKKEEKTKEEFTPSSETKSETEGGEDQKDDSKSENGGGGDLDEKKDLKDNSDEENPDTNEKQTKPETEDNELGEDGENQKQFESDNGEKKSIDDDKKSSDDDKENKTGNEDTETKTEKENTETNVDVQVEQEGQSKNETSGDLSPPGAQLELLNETTAQNGSFSTQATESKNEKEAQKGSGDKLDYKWALCNTTAGPDYIPCLDNVQAIRSLPSTKHYEHRERHCPDSPPTCLVPLPDGYKRPIEWPKSREKIWYTNVPHTKLAEYKGHQNWVKVTGEYLTFPGGGTQFKHGALHYIDFIQESVPAIAWGKRSRVVLDVGCGVASFGGFLFDRDVITMSLAPKDEHEAQVQFALERGIPAISAVMGTTRLPFPGRVFDIVHCARCRVPWHIEGGKLLLELNRVLRPGGFFVWSATPVYQKKTEDVEIWKAMSELIKKMCWELVSINKDTINGVGVATYRKPTSNECYKNRSEPVPPICADSDDPNASWKVPLQACMHTAPEDKTQRGSQWPEQWPARLEKAPFWLSSSQTGVYGKAAPEDFSADYEHWKRVVTKSYLNGLGINWASVRNVMDMRAVYGGFAAALRDLKVWVMNVVPIDSPDTLAIIYERGLFGIYHDWCESFSTYPRSYDLLHADHLFSKLKQRCNLTAVIAEVDRVLRPEGKLIVLDDAETIQQVEGMVKAMKWEVRMTYSKEKEGLLSVQKSIWRPSEVETLTYAIG

SEQ ID NO: 251 - DNA, 2104 bp, Arabidopsis thaliana
  G278,family:AKR
tcgatctttaaccaaatccagttgataaggtctcttcgttgattagcagagatctctttaatttgtgaatttcaattcatcggaacctgttgatggacaccaccattgatggattcgccgattcttatgaaatcagcagcactagtttcgtcgctaccgataacaccgactcctctattgtttatctggccgccgaacaagtactcaccggacctgatgtatctgctctgcaattgctctccaacagcttcgaatccgtctttgactcgccggatgatttctacagcgacgctaagcttgttctctccgacggccgggaagtttctttccaccggtgcgttttgtcagcgagaagctctttcttcaagagcgctttagccgccgctaagaaggagaaagactccaacaacaccgccgccgtgaagctcgagcttaaggagattgccaaggattacgaagtcggtttcgattcggttgtgactgttttggcttatgtttacagcagcagagtgagaccgccgcctaaaggagtttctgaatgcgcagacgagaattgctgccacgtggcttgccggccggcggtggatttcatgttggaggttctctatttggctttcatcttcaagatccctgaattaattactctctatcagaggcacttattggacgttgtagacaaagttgttatagaggacacattggttatactcaagcttgctaatatatgtggtaaagcttgtatgaagctattggatagatgtaaagagattattgtcaagtctaatgtagatatggttagtcttgaaaagtcattgccggaagagcttgttaaagagataattgatagacgtaaagagcttggtttggaggtacctaaagtaaagaaacatgtctcgaatgtacataaggcacttgactcggatgatattgagttagtcaagttgcttttgaaagaggatcacaccaatctagatgatgcgtgtgctcttcatttcgctgttgcatattgcaatgtgaagaccgcaacagatcttttaaaacttgatcttgccgatgtcaaccataggaatccgaggggatatacggtgcttcatgttgctgcgatgcggaaggagccacaattgatactatctctattggaaaaaggtgcaagtgcatcagaagcaactttggaaggtagaaccgcactcatgatcgcaaaacaagccactatggcggttgaatgtaataatatcccggagcaatgcaagcattctctcaaaggccgactatgtgtagaaatactagagcaagaagacaaacgagaacaaattcctagagatgttcctccctcttttgcagtggcggccgatgaattgaagatgacgctgctcgatcttgaaaatagagttgcacttgctcaacgtctttttccaacggaagcacaagctgcaatggagatcgccgaaatgaagggaacatgtgagttcatagtgactagcctcgagcctgaccgtctcactggtacgaagagaacatcaccgggtgtaaagatagcacctttcagaatcctagaagagcatcaaagtagactaaaagcgctttctaaaaccgtggaactcgggaaacgattcttcccgcgctgttcggcagtgctcgaccagattatgaactgtgaggacttgactcaactggcttgcggagaagacgacactgctgagaaacgactacaaaagaagcaaaggtacatggaaatacaagagacactaaagaaggcctttagtgaggacaatttggaattaggaaattcgtccctgacagattcgacttcttccacatcgaaatcaaccggtggaaagaggtctaaccgtaaactctctcatcgtcgtcggtgagactcttgcctcttagtgtaatttttgctgtaccatataattctgttttcatgatgactgtaactgtttatgtctatcgttggcgtcatatagtttcgctcttcgttttgcatcctgtgtattattgctgcaggtgtgcttcaaacaaatgttgtaacaatttgaaccaatggtatacagatttgtaatatatatttatgtacatcaacaataaaaaaaaaaaaaaaaaa

SEQ ID NO: 252 - protein, 593 aa, Arabidopsis thaliana
  G278,AKR domain coordinates 2-593
MDTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFKIPELITLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREQIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKLSHRRR

SEQ ID NO: 253 - DNA, 983 bp, Arabidopsis thaliana
  G280,family:AT-hook
aagttaatatgagaataatgagaaaaccactttcccaaattgctttttaaaatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgagataagatataacattagcgactgtgtattattattattactgcattgtgttatgtgaaactttgttctcttgttgaaaaaaaaaaaaaaaaaaa

SEQ ID NO: 254 - protein, 204 aa, Arabidopsis thaliana
  G280,AT-hook domain coordinates 97-104,130-137-155-162,185-192
MAFDLHHGSASDTHSSELPSFSLPPYPQMIMEAIESLNDKNGCNKTTIAKHIESTQQTLPPSHMTLLSYHLNQMKKTGQLIMVKNNYMKPDPDAPPKRGRGRPPKQKTQAESDAAAAAVVAATVVSTDPPRSRGRPPKPKDPSEPPQEKVITGSGRPRGRPPKRPRTDSETVAAPEPAAQATGERRGRGRPPKVKPTVVAPVGC

SEQ ID NO: 255 - DNA, 2843 bp, Arabidopsis thaliana
  G287,family:MISC
gtgtttgtcgtgggtcggtttataatcattatctcccccggaaaacttctcggagaaggagaagaatggttattccggcgacttctaggtttgggtttcgtgctgaattcaacaccaaggagtttcaagcttcctgcatctctctcgctaatgaaatcgatgcggctattgggagaaatgaagttccagggaatattcaagagctcgctttaatcctcaataatgtgtgccgacgtaaatgtgatgattatcaaaccagggcggtggtaatggcgctgatgatctcagtcaagagtgcttgtcagcttggatggttcccggagagagagactcaagaattgttggctatcatagacttgatgtggaatggtttcagctgtcctgaaaatgtcacctcttgtgtaaatagtcccgtcactctaatatcgcaggtcattgagaggttctatccatgtgtgaagctggggcatattcttgtttcttttgaagctaagccagaatcaaagatgatgatgaaggacttccatatttcaaagaagatgccacattctcccaaacagaaagttggattatttgttgttcggacagaggacataagcagatctaattgtattgtacatccacaaggagtcagctttttgttgaatggaaagggcattgacaagagagttaacatctcaatggagtctgggccgcagcttccaactaatgttactgccctgctaaaccttggggcaaatcttctacaagcaataggctgttttggaggtagttacttgattgctattgctttcatggatgtcataccactgcccaacaaaccgttactgaaagattatgttcatcctgaagtcgttggatcaaactcagattgtgacataattgaggggccatcgaggatatctctcagttgtcctatcagccggacgcgtatcaaacttcctgtgaagggtcatgtctgtaaacatcttcagtgttttgatttctggaattatgtcaacatgaacacaagacgaccatcatggcgctgcccgcattgtaatcagtctgtttgctatactgatatccgtgtagatcaaaaactgagaaagattctagaagaagtgggacgtaatgctgcagatgtggttatctctgctgatggaacctggatggttgagacggaaaatgatgaggacgtggaacttgtgccagaaaccactcatgaccatggagacccaaatagtttcatcaacttggggcctactgttaagaatcctgccagagatgagaatgaaatggaaacatccacccaagtcgaagaacataatccttgtttatctgagattcagggtccgtcaaatgacacacataggcctgcttcagattatactatgcttaaccagtctcatacttcaaccaacacactaccacagctgccacgaactttgaatgcctttgatggtcaacaattcgtgaacttaccacaagtaataaacacccgagattcaccagcaagccaagccttacctatgacattctcaccaaccccatctccacaagatatattagctactaatgcggcaaactttggcacatcaatgccggctgctcagtcttctcagtttcaaggctcacatgttacgtcccttggaaattgtgaaggaagaacttctgatttgatggcgagatggaaccacatctatggacgtgttcaaactcaatttccacctgcacctctttcgcatcatcattattcaatgcagaatcagagcccgtcccctgcacagcaaagaccagtgccatcttacattgcacatcctcaaacttttcatgtcaactacggagagaacgctgaccaaagatggatgccgtcttccattgcacatcctcaaactttacctgttaactacggaggaaatactaaccaaagaccgataccatcttccattgcacatcctcaaactttacctgtcaactacagggggaatactgaccatagatcgacgccatattccattacacatctccaaacattacttaactacggagggaacgccgatcaaagaccaatgccatcttccattacaaatctccaaactttacctgccacgtacggagggtacgcccaccaaagaccaatgtcatcttccattacacatccccgaacttcacctgtcaactacggagggacccctgaccaaagaccaatgccatcttccattacacatccccaaactttacctgtcagctacggagggaccacagaccaaatactgaatcctggtggtgcaatgggacagttctcatcacgagagttcatgaatttgactcctgctaacactgagaattggcgcccacaaagccggatgcgaggcagcgtagcacctggtacgggatatgaccatatgatcattcatcctacccgtccagttcatccacaagctcaaacacctcctgcgcctctttcaacatcttatgatggagcagatgaaattcaagcatttatagggcacccaagctatcccgttagtaataacgaaacacaagcgggtaccagttcgttgccagtggcagagggtcttgggtattcagggtcgttttggtcaatgcctcctgagacatggtgatatctgatggcttagagattgtagcacacggtcactaacacaatcagtcagtagtaagtagtaacagtatataactaaggcctttctttttttggtacttacagctttagtcttcgggtacatatatggggctaagttcttgatgtagcgtattcgtgagatttacttcatgtgaaacattagggtatcttttggccgatttactatcacaatatagcaggttcagttcgcttt

SEQ ID NO: 256 - protein, 847 aa, Arabidopsis thaliana
  G287,MISC domain coordinates 293-354
MVIPATSRFGFRAEFNTKEFQASCISLANEIDAAIGRNEVPGNIQELALILNNVCRRKCDDYQTRAVVMALMISVKSACQLGWFPERETQELLAIIDLMWNGFSCPENVTSCVNSPVTLISQVIERFYPCVKLGHILVSFEAKPESKMMMKDFHISKKMPHSPKQKVGLFVVRTEDISRSNCIVHPQGVSFLLNGKGIDKRVNISMESGPQLPTNVTALLNLGANLLQAIGCFGGSYLIAIAFMDVIPLPNKPLLKDYVHPEVVGSNSDCDIIEGPSRISLSCPISRTRIKLPVKGHVCKHLQCFDFWNYVNMNTRRPSWRCPHCNQSVCYTDIRVDQKLRKILEEVGRNAADVVISADGTWMVETENDEDVELVPETTHDHGDPNSFINLGPTVKNPARDENEMETSTQVEEHNPCLSEIQGPSNDTHRPASDYTMLNQSHTSTNTLPQLPRTLNAFDGQQFVNLPQVINTRDSPASQALPMTFSPTPSPQDILATNAANFGTSMPAAQSSQFQGSHVTSLGNCEGRTSDLMARWNHIYGRVQTQFPPAPLSHHHYSMQNQSPSPAQQRPVPSYIAHPQTFHVNYGENADQRWMPSSIAHPQTLPVNYGGNTNQRPIPSSIAHPQTLPVNYRGNTDHRSTPYSITHLQTLLNYGGNADQRPMPSSITNLQTLPATYGGYAHQRPMSSSITHPRTSPVNYGGTPDQRPMPSSITHPQTLPVSYGGTTDQILNPGGAMGQFSSREFMNLTPANTENWRPQSRMRGSVAPGTGYDHMIIHPTRPVHPQAQTPPAPLSTSYDGADEIQAFIGHPSYPVSNNETQAGTSSLPVAEGLGYSGSFWSMPPETW

SEQ ID NO: 257 - DNA, 1350 bp, Arabidopsis thaliana
  G291,family:MISC
caagaacccaaagatctctctctatttgtttgccttcttctttctttctgactcaaaccctcaaatcaattctcgcgattaagcaaaaccctagatttattctactcttcgaagtcgatttcaatggaaggttcctcgtcagccatcgcgaggaagacatgggagctagagaacaacattctcccagtggaaccaaccgattcagcctccgacagtatattccactacgacgacgcttcacaagccaaaatccagcaggagaagccatgggcctccgatcctaactacttcaagcgcgttcacatctcagcccttgctcttctcaagatggtggttcacgctcgctccggtggcacaatcgagatcatgggtcttatgcagggtaaaaccgagggtgatacaatcatcgttatggatgcttttgctttgcctgttgaaggtactgagactagggttaatgctcagtctgatgcctatgagtatatggttgaatactctcagaccagcaagctggctgggaggttggagaacgttgttggatggtatcactctcaccctgggtatggatgttggctctcgggtattgatgtttcgacacagatgcttaaccaacagtatcaggagccattcttagctgttgttattgatccaacaaggactgtttcggctggtaaggttgagattggggcattcagaacatatccagagggacataagatctcggatgatcatgtttctgagtatcagactatccctcttaacaagattgaggactttggtgtacattgcaaacagtactactcattggacatcacttatttcaagtcatctctcgatagtcaccttctggatctcctttggaacaagtactgggtgaacactctttcttcttccccactgttgggcaatggagactatgttgccgggcaaatatcagacttggctgagaagctcgagcaagcggagagtcagctcgctaactcccggtatggaggaattgcgccagccggtcaccaaaggaggaaagaggatgagcctcaactcgcgaagataactcgggatagtgcaaagataactgtcgagcaggtccatggactaatgtcacaggttatcaaagacatcttgttcaattccgctcgtcagtccaagaagtctgctgacgactcatcagatccagagcccatgattacatcgtgaagttggtctattcttttgttttttggctgcggaaattgactatcggtttgacccggtttatgaggcaatgcccattgttccctatatctctagtgtagtatctgcttcagacaaagatctttgggttattaaatgacattaacataaaaaaaa

SEQ ID NO: 258 - protein, 357 aa, Arabidopsis thaliana
  G291,MISC domain coordinates 132-160
MEGSSSAIARKTWELENNILPVEPTDSASDSIFHYDDASQAKIQQEKPWASDPNYFKRVHISALALLKMVVHARSGGTIEIMGLMQGKTEGDTIIVMDAFALPVEGTETRVNAQSDAYEYMVEYSQTSKLAGRLENVVGWYHSHPGYGCWLSGIDVSTQMLNQQYQEPFLAVVIDPTRTVSAGKVEIGAFRTYPEGHKISDDHVSEYQTIPLNKIEDFGVHCKQYYSLDITYFKSSLDSHLLDLLWNKYWVNTLSSSPLLGNGDYVAGQISDLAEKLEQAESQLANSRYGGIAPAGHQRRKEDEPQLAKITRDSAKITVEQVHGLMSQVIKDILFNSARQSKKSADDSSDPEPMITS

SEQ ID NO: 259 - DNA, 1072 bp, Arabidopsis thaliana
  G303,family:HLH/MYC
aaaagataacgtagccattaacttttatgcattaactccttcatttctttttgtgctcgtttggttgagagagagagaggctatatatgatgttccaacaagattaccctcatggcttttcactcgtggaaacatccttaagttacgaaatgttggattactttcaaaacatcgtcgtttcgaactctgaagacgtggcgtcacagcaaaattccatttcgtcctcttcttattcatcagcgacactctcctgctccataacagagcaaaaatctcacttaactgaaaagttatctcctctacgagaaagatatggttgcggtgactttctgtcgcggaagaggagaaggagaagtgaaaaaacgattgtagataaagagaatcaaaggatgaatcacattgccgtcgagcgtaaccggagaaaacagatgaatcattttctgtctatcctcaagtctatgatgcctctctcttattctcaacctaatgaccaagcatcaatcatagaagggaccattagctatctgaagaagctagaacaacgtctccaatctctcgaagcccaattaaaagctactaaactcaatcaatcaccaaatatattttccgacttcttcatgttccctcaatactccaccgccactgccactgccaccgccactgcctcctcatcctcctcgagccaccaccatcacaagcgactagaggtggttgctgacgtggaggttacaatggtagaaagacatgccaacattaaagtgttaacgaagacacagccaagattgctcttcaagattatcaatgagtttaactctttaggtttaagtactcttcatctcaacctcacaacttccaaagacatgtctctcttcacttttagcgtcaaggtagaggcagattgtcaattgacgccttctggtaatgaggtcgcaaatacggtgcatgaagtcgttagaagagttcacaaggaacgttgaattttgtttacatactagctaactttgaaattctattttattgtataaacaatctcttatgtgtgtaatttacatatatacaattaattaacatt

SEQ ID NO: 260 - protein, 296 aa, Arabidopsis thaliana
  G303,HLH/MYC domain coordinates 96-155
MMFQQDYPHGFSLVETSLSYEMLDYFQNIVVSNSEDVASQQNSISSSSYSSATLSCSITEQKSHLTEKLSPLRERYGCGDFLSRKRRRRSEKTIVDKENQRMNHIAVERNRRKQMNHFLSILKSMMPLSYSQPNDQASIIEGTISYLKKLEQRLQSLEAQLKATKLNQSPNIFSDFFMFPQYSTATATATATASSSSSSHHHHKRLEVVADVEVTMVERHANIKVLTKTQPRLLFKIINEFNSLGLSTLHLNLTTSKDMSLFTFSVKVEADCQLTPSGNEVANTVHEVVRRVHKER

SEQ ID NO: 261 - DNA, 1764 bp, Arabidopsis thaliana
  G307,family:SCR
atgaagagagatcatcaccaattccaaggtcgattgtccaaccacgggacttcttcttcttcatcatcaatctctaaagataagatgatgatggtgaaaaaagaagaagacggtggaggtaacatggacgacgagcttctcgctgttttaggttacaaagttaggtcatcggagatggcggaggttgctttgaaactcgaacaattagagacgatgatgagtaatgttcaagaagatggtttatctcatctcgcgacggatactgttcattataatccgtcggagctttattcttggcttgataatatgctctctgagcttaatcctcctcctcttccggcgagttctaacggtttagatccggttcttccttcgccggagatttgtggttttccggcttcggattatgaccttaaagtcattcccggaaacgcgatttatcagtttccggcgattgattcttcgtcttcgtcgaataatcagaacaagcgtttgaaatcatgctcgagtcctgattctatggttacatcgacttcgacgggtacgcagattggtggagtcataggaacgacggtgacgacaaccaccacgacaacgacggcggcggctgagtcaactcgttctgttatcctggttgactcgcaagagaacggtgttcgtttagtccacgcgcttatggcttgtgcagaagcaatccagcagaacaatttgactctagcggaagctcttgtgaagcaaatcggatgcttagctgtgtctcaagccggagctatgagaaaagtggctacttacttcgccgaagctttagctcggcggatctaccgtctctctccgccgcagaatcagatcgatcattgtctctccgatactcttcagatgcacttttacgagacttgtccttatcttaaattcgctcacttcacggcgaaccaagcgattctcgaagcttttgaaggtaagaagagagtacacgtcattgatttctcgatgaaccaaggtcttcaatggcctgcgcttatgcaagctcttgcgcttcgagaaggaggtcctccaactttccggttaaccggaattggtccaccggcgccggataattctgatcatcttcatgaagttggttgtaaattagctcagcttgcggaggcgattcacgtagaattcgaataccgtggattcgttgctaacagcttagccgatctcgatgcttcgatgcttgagcttagaccgagcgatacggaagctgttgcggtgaactctgtttttgagctacataagctcttaggtcgtcccggtgggatagagaaagttctcggcgttgtgaaacagattaaaccggtgattttcacggtggttgagcaagaatcgaaccataacggaccggttttcttagaccggtttactgaatcgttacattattattcgactctgtttgattcgttggaaggagttccgaatagtcaagacaaagtcatgtctgaagtttacttagggaaacagatttgtaatctggtggcttgtgaaggtcctgacagagtcgagagacacgaaacgttgagtcaatggggaaaccggtttggttcgtccggtttagcgccggcacatcttgggtctaacgcgtttaagcaagcgagtatgcttttgtctgtgtttaatagtggccaaggttatcgtgtggaggagagtaatggatgtttgatgttgggttggcacactcgcccactcattaccacctccgcttggaaactctcgacggcggcgcactga

SEQ ID NO: 262 - protein, 587 aa, Arabidopsis thaliana
  G307,SCR domain coordinates 292-357,417-502,505-580
MKRDHHQFQGRLSNHGTSSSSSSISKDKMMMVKKEEDGGGNMDDELLAVLGYKVRSSEMAEVALKLEQLETMMSNVQEDGLSHLATDTVHYNPSELYSWLDNMLSELNPPPLPASSNGLDPVLPSPEICGFPASDYDLKVIPGNAIYQFPAIDSSSSSNNQNKRLKSCSSPDSMVTSTSTGTQIGGVIGTTVTTTTTTTTAAAESTRSVILVDSQENGVRLVHALMACAEAIQQNNLTLAEALVKQIGCLAVSQAGAMRKVATYFAEALARRIYRLSPPQNQIDHCLSDTLQMHFYETCPYLKFAHFTANQAILEAFEGKKRVHVIDFSMNQGLQWPALMQALALREGGPPTFRLTGIGPPAPDNSDHLHEVGCKLAQLAEAIHVEFEYRGFVANSLADLDASMLELRPSDTEAVAVNSVFELHKLLGRPGGIEKVLGVVKQIKPVIFTVVEQESNHNGPVFLDRFTESLHYYSTLFDSLEGVPNSQDKVMSEVYLGKQICNLVACEGPDRVERHETLSQWGNRFGSSGLAPAHLGSNAFKQASMLLSVFNSGQGYRVEESNGCLMLGWHTRPLITTSAWKLSTAAH

SEQ ID NO: 263 - DNA, 1951 bp, Arabidopsis thaliana
  G308,family:SCR
agtaatttagttttttttttttttttttacaatttattttgttattagaagtggtagtggagtgaaaaaacaaatcctaagcagtcctaaccgatccccgaagctaaagattcttcaccttcccaaataaagcaaaacctagatccgacattgaaggaaaaaccttttagatccatctctgaaaaaaacccaaccatgaagagagatcatcatcatcatcatcaagataagaagactatgatgatgaatgaagaagacgacggtaacggcatggatgagcttctagctgttcttggttacaaggttaggtcatcggaaatggctgatgttgctcagaaactcgagcagcttgaagttatgatgtctaatgttcaagaagacgatctttctcaactcgctactgagactgttcactataatccggcggagctttacacgtggcttgattctatgctcaccgaccttaatcctccgtcgtctaacgccgagtacgatcttaaagctattcccggtgacgcgattctcaatcagttcgctatcgattcggcttcttcgtctaaccaaggcggcggaggagatacgtatactacaaacaagcggttgaaatgctcaaacggcgtcgtggaaaccaccacagcgacggctgagtcaactcggcatgttgtcctggttgactcgcaggagaacggtgtgcgtctcgttcacgcgcttttggcttgcgctgaagctgttcagaaggagaatctgactgtggcggaagctctggtgaagcaaatcggattcttagctgtttctcaaatcggagctatgagacaagtcgctacttacttcgccgaagctctcgcgcggcggatttaccgtctctctccgtcgcagagtccaatcgaccactctctctccgatactcttcagatgcacttctacgagacttgtccttatctcaagttcgctcacttcacggcgaatcaagcgattctcgaagcttttcaagggaagaaaagagttcatgtcattgatttctctatgagtcaaggtcttcaatggccggcgcttatgcaggctcttgcgcttcgacctggtggtcctcctgttttccggttaaccggaattggtccaccggcaccggataatttcgattatcttcatgaagttgggtgtaagctggctcatttagctgaggcgattcacgttgagtttgagtacagaggatttgtggctaacactttagctgatcttgatgcttcgatgcttgagcttagaccaagtgagattgaatctgttgcggttaactctgttttcgagcttcacaagctcttgggacgacctggtgcgatcgataaggttcttggtgtggtgaatcagattaaaccggagattttcactgtggttgagcaggaatcgaaccataatagtccgattttcttagatcggtttactgagtcgttgcattattactcgacgttgtttgactcgttggaaggtgtaccgagtggtcaagacaaggtcatgtcggaggtttacttgggtaaacagatctgcaacgttgtggcttgtgatggacctgaccgagttgagcgtcatgaaacgttgagtcagtggaggaaccggttcgggtctgctgggtttgcggctgcacatattggttcgaatgcgtttaagcaagcgagtatgcttttggctctgttcaacggcggtgagggttatcgggtggaggagagtgacggctgtctcatgttgggttggcacacacgaccgctcatagccacctcggcttggaaactctccaccaattagatggtggctcaatgaattgatctgttgaaccggttatgatgatagatttccgaccgaagccaaactaaatcctactgtttttccctttgtcacttgttaagatcttatctttcattatattaggtaattgaaaaattttaatctcgcctaaattact

SEQ ID NO: 264 - protein, 532 aa, Arabidopsis thaliana
  G308,SCR domain coordinates 239-304,364-449,452-527
MKRDHHHHHQDKKTMMMNEEDDGNGMDELLAVLGYKVRSSEMADVAQKLEQLEVMMSNVQEDDLSQLATETVHYNPAELYTWLDSMLTDLNPPSSNAEYDLKAIPGDAILNQFAIDSASSSNQGGGGDTYTTNKRLKCSNGVVETTTATAESTRHVVLVDSQENGVRLVHALLACAEAVQKENLTVAEALVKQIGFLAVSQIGAMRQVATYFAEALARRIYRLSPSQSPIDHSLSDTLQMHFYETCPYLKFAHFTANQAILEAFQGKKRVHVIDFSMSQGLQWPALMQALALRPGGPPVFRLTGIGPPAPDNFDYLHEVGCKLAHLAEAIHVEFEYRGFVANTLADLDASMLELRPSEIESVAVNSVFELHKLLGRPGAIDKVLGVVNQIKPEIFTVVEQESNHNSPIFLDRFTESLHYYSTLFDSLEGVPSGQDKVMSEVYLGKQICNVVACDGPDRVERHETLSQWRNRFGSAGFAAAHIGSNAFKQASMLLALFNGGEGYRVEESDGCLMLGWHTRPLIATSAWKLSTN

SEQ ID NO: 265 - DNA, 1536 bp, Arabidopsis thaliana
  G309,family:SCR
atgaagagagagcacaaccaccgtgaatcatccgccggagaaggtgggagttcatcaatgacgacggtgattaaagaagaagctgccggagttgacgagcttttggttgttttaggttacaaagttcgatcatccgacatggctgacgtggcacacaagcttgaacagttagagatggttcttggtgatggaatctcgaatctttctgatgaaactgttcattacaatccttctgatctctctggttgggtcgaaagcatgctctcggatcttgacccgacccggattcaagaaaagcctgactcagagtacgatcttagagctattcctggctctgcagtgtatccacgtgacgagcacgtgactcgtcggagcaagaggacgagaattgaatcggagttatcctctacgcgctctgtggtggttttggattctcaagaaactggagtgcgtttagtccacgcgctattagcttgtgctgaagctgttcaacagaacaatttgaagttagccgacgcgctcgtgaagcacgtggggttactcgcgtcctctcaagctggtgctatgaggaaagtcgcgacttacttcgctgaagggcttgcgagaaggatttaccgtatttaccctcgagacgatgtcgcgttgtcttcgttttcggacactcttcagattcatttctatgagtcttgtccgtatctcaagtttgcgcattttacggcgaatcaagcgatacttgaggtttttgctacggcggagaaggttcatgttattgatttaggacttaaccatggtttacaatggccggctttgattcaagctcttgctttacgtcctaatggtccaccggattttcggttaaccgggatcggttattcgttaaccgatattcaagaagttggttggaaacttggtcagcttgcgagtactattggtgtcaatttcgaattcaagagcattgctttaaacaatttgtctgatcttaaaccggaaatgctagacattagacccggtttagaatcagtggcggttaactcggtcttcgagcttcatcgcctcttagctcatcccggttccatcgataagtttttatcgacaatcaaatcaatccgaccggatataatgactgtggtcgagcaagaagcaaaccataacggtaccgtatttctcgatcggttcacggaatcgctacattactattcgagcttattcgactcgctcgagggcccgccaagccaagaccgagtgatgtcggagttattcctaggacggcagatactaaaccttgtggcatgcgaaggagaagaccgggtagagaggcatgagactttaaatcagtggagaaaccggttcggtttaggaggatttaaaccggttagtatcggttcgaacgcgtataagcaagcaagcatgttgttggcactttatgccggggctgatgggtataatgtggaagagaatgaaggttgtttgttgcttggatggcaaacgcgaccgcttattgcaacatctgcgtggcgaatcaatcgtgtggaataa

SEQ ID NO: 266 - protein, 511 aa, Arabidopsis thaliana
  G309,SCR domain coordinates 223-288,342-427,431-505
MKREHNHRESSAGEGGSSSMTTVIKEEAAGVDELLVVLGYKVRSSDMADVAHKLEQLEMVLGDGISNLSDETVHYNPSDLSGWVESMLSDLDPTRIQEKPDSEYDLRAIPGSAVYPRDEHVTRRSKRTRIESELSSTRSVVVLDSQETGVRLVHALLACAEAVQQNNLKLADALVKHVGLLASSQAGAMRKVATYFAEGLARRIYRIYPRDDVALSSFSDTLQIHFYESCPYLKFAHFTANQAILEVFATAEKVHVIDLGLNHGLQWPALIQALALRPNGPPDFRLTGIGYSLTDIQEVGWKLGQLASTIGVNFEFKSIALNNLSDLKPEMLDIRPGLESVAVNSVFELHRLLAHPGSIDKFLSTIKSIRPDIMTVVEQEANHNGTVFLDRFTESLHYYSSLFDSLEGPPSQDRVMSELFLGRQILNLVACEGEDRVERHETLNQWRNRFGLGGFKPVSIGSNAYKQASMLLALYAGADGYNVEENEGCLLLGWQTRPLIATSAWRINRVE

SEQ ID NO: 267 - DNA, 1755 bp, Arabidopsis thaliana
  G312,family:SCR
atggcttacatgtgcactgatagtggcaatctaatggctattgctcaacaagtcatcaaacagaagcagcaacaagaacaacaacagcagcaacatcatcaagaccatcagatttttggtattaatcctttgtctcttaacccatggcccaatacttccctcgggtttgggctttcaggttcggcttttcccgacccgtttcaagttaccggcggcggagattccaacgatcctggctttccttttcctaacttagaccaccaccacgccacaaccaccggcggtgggttcaggttatctgatttcggcggtggaaccggcggcggcgagtttgagtccgacgagtggatggagactcttatcagcggtggagactccgttgcagacggtcctgattgtgacacctggcatgataatcccgattacgtaatctacggtcctgatccattcgatacttacccgagtcgactcagtgtccaaccgtcagatctaaaccgagtcattgacacgtcgagtccgcttcctccgccgaccttgtggcctccttcttcgccattatcgattcctccgcttactcatgagtcaccaaccaaagaagatccagagactaacgactccgaagacgatgacttcgacctagaaccacctctcctcaaagctatatacgactgtgcacggatctcagactctgaccctaacgaagcttccaagacgcttcttcagatccgagaatctgtatcggagctaggtgatccgacggagcgagttgcattttacttcacggaagctctctccaacagactgtctcctaattcgccggcgacgtcgtcttcttcttcatctacggaggatttaatcttatcttataaaaccctaaacgacgcttgtccttactccaaattcgcacatttgacggcgaatcaagcgattctagaagcgacggagaagtcgaacaagattcacatcgtcgattttggaatcgttcaaggtatacaatggcctgctcttcttcaagctctagctactcgtacttctggtaaacccactcaaatccgggtctcgggtatacccgctccatctctcggtgaatctccggaaccgtcgttaatcgccaccggaaaccgcctccgtgatttcgccaaggttctggatctgaatttcgatttcatcccaattctcactcccatacatttacttaacgggtcaagtttccgggtcgacccggatgaagtactggccgtgaatttcatgctccagctctacaaattactcgacgagacgccgacgatagttgacaccgcactacggctcgccaaatcgttgaacccgagggtcgtcactctcggagaatacgaagtgagcttaaaccgggtcggtttcgctaaccgggtaaagaacgcgcttcaattctattccgcggttttcgaatcccttgaaccgaacttggggcgtgattcggaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataa

SEQ ID NO: 268 - protein, 584 aa, Arabidopsis thaliana
  G312,SCR domain coordinates 289-355,414-503,503-583
MAYMCTDSGNLMAIAQQVIKQKQQQEQQQQQHHQDHQIFGINPLSLNPWPNTSLGFGLSGSAFPDPFQVTGGGDSNDPGFPFPNLDHHHATTTGGGFRLSDFGGGTGGGEFESDEWMETLISGGDSVADGPDCDTWHDNPDYVIYGPDPFDTYPSRLSVQPSDLNRVIDTSSPLPPPTLWPPSSPLSIPPLTHESPTKEDPETNDSEDDDFDLEPPLLKAIYDCARISDSDPNEASKTLLQIRESVSELGDPTERVAFYFTEALSNRLSPNSPATSSSSSSTEDLILSYKTLNDACPYSKFAHLTANQAILEATEKSNKIHIVDFGIVQGIQWPALLQALATRTSGKPTQIRVSGIPAPSLGESPEPSLIATGNRLRDFAKVLDLNFDFIPILTPIHLLNGSSFRVDPDEVLAVNFMLQLYKLLDETPTIVDTALRLAKSLNPRVVTLGEYEVSLNRVGFANRVKNALQFYSAVFESLEPNLGRDSEERVRVERELFGRRISGLIGPEKTGIHRERMEEKEQWRVLMENAGFESVKLSNYAVSQAKILLWNYNYSNLYSIVESKPGFISLAWNDLPLLTLSSWR

SEQ ID NO: 269 - DNA, 930 bp, Arabidopsis thaliana
  G314,family:SCR
atgaacacaacccaaattctaaacccgacccgacccatttggcccagtttctcttcgtccaaatctcttagcggtgatgctaactgcatggagcagcttctcctccattgcgcaaacgccatcgaatcaaacgacgccacgttggctcaacagatcatttgggtgctcaacaacctcgcttcacccgacggcgactcaactcaaagactcgctgcctctttcctccgcgcgttaatatcacgcaccgcctccaaaagccctgcgtttgcgtttctatcactggctgctacagcttccatatcccagaaaacgctacaccggttctccgtcatagagctcgctgagttcgtcgacttgacgccatggcaccgtttcggattcatagccgccaacgccgcaatcctcgacgccgtagaaggttactcatccgttcacatcgttgacttaagtttgactcactgcatgcaaatccctactcttatagactccatggcaaacaaactccacaaaaaaccgcctccgcttctcaaactcaccgtcattgcttccgacgctgaatttcatccgccgccgttgctcggaatctcctacgaagagctaggttcaaagctagtaaacttcgcaaccacacgtaacgttgcaatggagtttagaatcatatcttcttcttactccgacggcctctcctcccttatcgaacaactaagaatcgacccattcgtcttcaacgaagctctcgtcgttaactgccacatgatgcttcactatatccccgacgaaatattaacttcgaatctccgatcagttttcttgaaagaacttcgagatctaaacccaacgatcgtaacccttatcgacgaagactcggatttcacgtcgactaactttatctccaggtttatcttttttcggttctatttcaaaatttaa

SEQ ID NO: 270 - protein, 309 aa, Arabidopsis thaliana
  G314,SCR domain coordinates 113-180
MNTTQILNPTRPIWPSFSSSKSLSGDANCMEQLLLHCANAIESNDATLAQQIIWVLNNLASPDGDSTQRLAASFLRALISRTASKSPAFAFLSLAATASISQKTLHRFSVIELAEFVDLTPWHRFGFIAANAAILDAVEGYSSVHIVDLSLTHCMQIPTLIDSMANKLHKKPPPLLKLTVIASDAEFHPPPLLGISYEELGSKLVNFATTRNVAMEFRIISSSYSDGLSSLIEQLRIDPFVFNEALVVNCHMMLHYIPDEILTSNLRSVFLKELRDLNPTIVTLIDEDSDFTSTNFISRFIFFRFYFKI

SEQ ID NO: 271 - DNA, 1056 bp, Arabidopsis thaliana
  G319,family:Z-CO-like
atgggatcaccattgtgcgagcatttggctaggctttgtcttcaatgtgatttgaagttacactctaagagtagtaccgctcttgtagaatcccttgaacaagggttgtgcctatgccaatcatgcttttcaaatcccaatgtaatctcgcgttttcttcttcttcttagaaacgatgctagtgattattcggcatataattttccactggatcttgattcctcttcttcgtcttgttcatcttcttttatcgatcgcaattgggaattttcccttggttccttacctctcaataatgaggactcatcatcatcttttgaaatccttcaaatatttgaagatcatacaaagaattatagtgatcaacaagtgttgacgcttcagcccgattatttggacataattcctaaggatagttcatgctcaggcttcaaaagctacgaaactaaagaagatatagagaatgttttgatgaacacttttgatggcgccgaggcagcagtattagacctaaaacaatataaccccgaggaagatttgatcctcacggagctaatcgatgaattagcaagagacaattcagagaccacgccgaccaatactttaccaacttcagcatctggtatgtcatcggatatacataaagattacaacactgaagctttggctaatgcaagttctcaagattattttataaaccaaatgattggctcaaaagcaaaggaagagaccaatgatcttgcaatactccctaacgctcttgttcaacttgactgtggacaatcgcagttgatacttaccgatgagatgttaccatgggagaatcaaacatttgtacctgttaagggatttagtccgaaagatcgagaagaggccaagaaaagatatttcgaaaagaagaagaaacgcaagtttgggaaacaaattagatatgaatctcgaaaatctacagcagatacgaagaaaagaatgaaaggaagatttacaaaagctggtgctgattatgactatgacccacgagctaatgatattaacaaagggaaaatacaaacatga

SEQ ID NO: 272 - protein, 351 aa, Arabidopsis thaliana
  G319,Z-CO-like domain coordinates 12-42
MGSPLCEHLARLCLQCDLKLHSKSSTALVESLEQGLCLCQSCFSNPNVISRFLLLLRNDASDYSAYNFPLDLDSSSSSCSSSFIDRNWEFSLGSLPLNNEDSSSSFEILQIFEDHTKNYSDQQVLTLQPDYLDIIPKDSSCSGFKSYETKEDIENVLMNTFDGAEAAVLDLKQYNPEEDLILTELIDELARDNSETTPTNTLPTSASGMSSDIHKDYNTEALANASSQDYFINQMIGSKAKEETNDLAILPNALVQLDCGQSQLILTDEMLPWENQTFVPVKGFSPKDREEAKKRYFEKKKKRKFGKQIRYESRKSTADTKKRMKGRFTKAGADYDYDPRANDINKGKIQT

SEQ ID NO: 273 - DNA, 2481 bp, Arabidopsis thaliana
  G324,family:RING/C3H2C3
cataagtgaacacagaagaagcggtggctctgagccggcgaaatctcctttctcatccctaaaattttcatgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctagggaaccgagtgttgcagctgaggagggacatagccgtggatcttccaaagagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcagtctgttgatggtcagcacattatccttcacactttgaatgtgaagtgccttctgcatcactatggaagctatgactttcttccaccaagattgagtggaaagatactggaaatggaaaccattacccaatcagaagcgataaggagacgctaccgctttttaagtcatttttctttatcaactacacttcagatatgtgagattgatatgaaggaatccttgcctcctgatgcatttgctccatttatacatgaaattaagaagcgtgagaagcagcggaaagaacgtgcttggaaggatcgaaaaaataaaatcaaagctgaagtagctgcagctgcagagcttgtaccattgatggccagttttgggcagtcgtcttctagtgatgactttcccccattttccttggatgactttgaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactgaaaaggcctatggatttgtgtatgtataataatcttttcatctaagaaaaactgagtaaagaaagaaccagagattatggtgagtgagtaagtg

SEQ ID NO: 274 - protein, 772 aa, Arabidopsis thaliana
  G324,RING/C3H2C3 domain coordinates 245-291
MSILPPPIIQGHNSSSPSSDSSLNPSSEHGNNSSSSLSPLPSSPPSRISSSTGTRFSGHSESSHNFSGGSREPSVAAEEGHSRGSSKEMTQNGAGKESFSPPNADKRDHFRYDGRRNRSRGRGTGAAGSSSSQLQHNSGPFNSPRGGVSHHNPTGRRANMISGNHLLNFQYDPISQPQSRGPPPPQRRQQYKGRPFNKDLFLKANYKFVVLDTGDHSPDSMDPDKMLQWDDIICVRYSTPSPVQCPICLEYPLCPQITSCGHIFCFPCILQYLLTGVDNHKVDCFKRCPLCFVMISPRELYTVYIENVKQYSVGDPIEFVLLTRKKDSFAPTRKNEHDLAVPNGENEIYDPFSKFTFTQDVDLSVRQAVSELDSWIARADPQLVEDLEKHLYVNAALERLEQRKLYWNEHKLSIYSKVCTTARNQTQSLSPPDVSRVGYQAPMGGHGAPDSGSNDQDKSTEDSSADKSDGESQSSLEKGCDNDLGHPLEDQDAPSSSSCNGSKGFLSHQIDTKDLKDNDAYNFYQSVDGQHIILHTLNVKCLLHHYGSYDFLPPRLSGKILEMETITQSEAIRRRYRFLSHFSLSTTLQICEIDMKESLPPDAFAPFIHEIKKREKQRKERAWKDRKNKIKAEVAAAAELVPLMASFGQSSSSDDFPPFSLDDFEALGNSAPISSSPPNIGERSSFSHVTRLGFAAGHDSPNLNNEPTNVQSSSSSSEVSNATTGARNTNITSFASVASRTTTPMAPTVKEPGKRGKKQSRVLLSTTSVRRY

SEQ ID NO: 275 - DNA, 876 bp, Arabidopsis thaliana
  G325,family:Z-CO-like
atggaggctcgatgtgacttttgtggaaccgaaaaagcattaatctactgcaaatctgattcggctaaactttgtttaaactgtgacgttaatgtacactcagcgaatcctctgtctcaaagacacacgcgatctctactctgcgagaaatgttccttacaacccacggcagtacactgtatgaacgaaaatgtttctctttgccaaggatgtcagtggaccgctagtaactgcactggtttaggacacagacttcagagtctgaacccttactctgattgtccttctccatcagatttcggcaagatctggtcttcaactttagaaccttctgtcacaagtttggtctctccattttctgataccctgctccaggaattagacgattggaatggttcatcaacttccgtggttacacaaactcagaaccttaaagactattcttctttctttcctatggaatctaatcttccaaaagtgatagaagaggaatgttctggtttggatctatgcgaagggataaacttagatgatgcgccgttgaatttcaacgcaagcaatgatataatcggatgttcatcacttgacaataccaaatgttacgagtacgaggattcttttaaggaagagaataacattggccttccttcattactgcttcctactttatccgggaacgttgtaccgaacatgtcactttcgatgtctaacctcacaggagaaagcaatgcgactgattaccaagattgcggaatttcaccagggtttctcataggagattcgccatgggaatcgaatgttgaagttagttttaatccaaaattaagggatgaggctaaaaagagatacaaacaaaagaaatcaaagcgcatgtaa

SEQ ID NO: 276 - protein, 291 aa, Arabidopsis thaliana
  G325,Z-CO-like domain coordinates 5-28,48-71
MEARCDFCGTEKALIYCKSDSAKLCLNCDVNVHSANPLSQRHTRSLLCEKCSLQPTAVHCMNENVSLCQGCQWTASNCTGLGHRLQSLNPYSDCPSPSDFGKIWSSTLEPSVTSLVSPFSDTLLQELDDWNGSSTSVVTQTQNLKDYSSFFPMESNLPKVIEEECSGLDLCEGINLDDAPLNFNASNDIIGCSSLDNTKCYEYEDSFKEENNIGLPSLLLPTLSGNVVPNMSLSMSNLTGESNATDYQDCGISPGFLIGDSPWESNVEVSFNPKLRDEAKKRYKQKKSKRM

SEQ ID NO: 277 - DNA, 1558 bp, Arabidopsis thaliana
  G326,family:Z-CO-like
caattaatgacatcttcttcttctcctttcactgcaaaaccgaaagcttgagactttgagattatgtctatgtcatcttcttcttcttccatcgatcacttcatcacctttcgtcatcttgatcttattctccactgtataaaatcagcgagattttaagggattgtgaaggtaccatcttaaacacaaaatgggtacttctactacagagagtgtggtggcgtgtgaattttgcggcgagagaacggcggttctgttttgtagagccgatacggcgaagctttgtttgccttgtgaccagcacgtgcactcggcgaaccttctctcgaggaagcatgttcgttctcagatctgtgataactgtagcaaagagccggtgtccgtacgttgcttcacagataatctcgtattgtgtcaggagtgtgattgggatgttcacggaagctgttcctcctccgcgacgcatgaacgctccgccgtggaagggttttcaggttgtccttcggttttggagcttgctgctgtgtggggaatcgatttaaagggtaagaagaaagaagatgacgaagacgaattgactaagaattttgggatggggttggattcgtggggttctggatctaacatcgttcaagaactgattgttccttatgatgtgtcttgcaaaaagcaaagctttagctttgggaggtctaagcaggtagtgtttgaacagcttgagttactgaagagaggcttcgttgaaggcgaaggagagattatggttccggagggaatcaatggcggaggaagcatttctcagccatctccgacgacgtcgtttacttctttgcttatgtctcaaagtctttgtggtaatggtatgcaatggaatgctactaatcatagcactggccagaacactcagatatgggattttaacttgggacagtcgaggaaccctgatgaacctagtccagtcgaaactaaaggctctactttcacattcaacaacgttactcatctcaagaacgatacccgaaccaccaatatgaatgctttcaaagagagttaccaggaggattccgtccactcaacttctaccaagggacaggaaacatctaagagcaacaatattcctgctgccattcactcgcataaaagttctaacgactcctgtggcttgcattgcacggaacatattgctattactagtaatagagccacaagattggtggcggtaacgaatgctgatctagagcagatggcacagaacagagataatgctatgcagcggtacaaggaaaagaagaaaacgcggagatatgataagaccataagatatgaaacgaggaaggcgagagccgagaccaggttgcgtgttaagggcagatttgtgaaagctacagatccttagatgtctctccacgttaggttttacatttgagatcctaagttaggaactttttttgttttttctactttcaactaccttgtaaatgtaaatgatcgatcttcagctgcataatgtgtggccagatttttgtaatttttacgtttaaccttctaaaaaaaaaaa

SEQ ID NO: 278 - protein, 401 aa, Arabidopsis thaliana
  G326,Z-CO-like domain coordinates 11-94,354-400
MGTSTTESVVACEFCGERTAVLFCRADTAKLCLPCDQHVHSANLLSRKHVRSQICDNCSKEPVSVRCFTDNLVLCQECDWDVHGSCSSSATHERSAVEGFSGCPSVLELAAVWGIDLKGKKKEDDEDELTKNFGMGLDSWGSGSNIVQELIVPYDVSCKKQSFSFGRSKQVVFEQLELLKRGFVEGEGEIMVPEGINGGGSISQPSPTTSFTSLLMSQSLCGNGMQWNATNHSTGQNTQIWDFNLGQSRNPDEPSPVETKGSTFTFNNVTHLKNDTRTTNMNAFKESYQEDSVHSTSTKGQETSKSNNIPAAIHSHKSSNDSCGLHCTEHIAITSNRATRLVAVTNADLEQMAQNRDNAMQRYKEKKKTRRYDKTIRYETRKARAETRLRVKGRFVKATDP

SEQ ID NO: 279 - DNA, 1068 bp, Arabidopsis thaliana
  G328,family:Z-CO-like
atgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctga

SEQ ID NO: 280 - protein, 355 aa, Arabidopsis thaliana
  G328,Z-CO-like domain coordinates 12-78
MLKVESNWAQACDTCRSAACTVYCRADSAYLCSSCDAQVHAANRLASRHERVRVCQSCERAPAAFFCKADAASLCTTCDSEIHSANPLARRHQRVPILPISEYSYSSTATNHSCETTVTDPENRLVLGQEEEDEDEAEAASWLLPNSGKNSGNNNGFSIGDEFLNLVDYSSSDKQFTDQSNQYQLDCNVPQRSYGEDGVVPLQIEVSKGMYQEQQNFQLSINCGSWGALRSSNGSLSHMVNVSSMDLGVVPESTTSDATVSNPRSPKAVTDQPPYPPAQMLSPRDREARVLRYREKKKMRKFEKTIRYASRKAYAEKRPRIKGRFAKKKDVDEEANQAFSTMITFDTGYGIVPSF

SEQ ID NO: 281 - DNA, 795 bp, Arabidopsis thaliana
  G343,family:GATA/Zn
atggacgtctatggcttatcttcaccagacttacttcgaatcgacgaccttcttgatttctccaacgaagacatcttctccgcttcttcttccggtggttccaccgccgctacttcctcttcttctttccctcctcctcaaaaccctagtttccaccaccaccatctcccttcctccgccgatcatcactccttcctccacgacatttgcgttcccagtgatgacgcagctcatcttgaatggctttcgcaattcgtggacgattctttcgctgattttccggcgaatccattaggaggaactatgacttctgtcaaaactgaaacttcctttccggggaaaccaagaagcaaacgatcaagagctcctgctcctttcgccggaacatggtctccgatgccactggaatccgagcatcagcagcttcactccgccgccaaattcaagccaaagaaagaacaatccggcggaggaggaggaggaggaggaagacatcagtcatcgtcatcggagactacggaaggaggaggaatgaggagatgtactcactgtgcatcggagaaaacgccacagtggaggacaggaccacttggacctaaaacactatgtaacgcttgtggagtccggtttaaatccggtagacttgtaccggaatatagaccggcttcgagtcctacttttgttttgactcagcattcaaactctcaccggaaagtgatggagcttcgacggcagaaagaagttatgagacaaccacaacaagttcaacttcatcaccaccaccacccgttttag

SEQ ID NO: 282 - protein, 264 aa, Arabidopsis thaliana
  G343,GATA/Zn domain coordinates 178-214
MDVYGLSSPDLLRIDDLLDFSNEDIFSASSSGGSTAATSSSSFPPPQNPSFHHHHLPSSADHHSFLHDICVPSDDAAHLEWLSQFVDDSFADFPANPLGGTMTSVKTETSFPGKPRSKRSRAPAPFAGTWSPMPLESEHQQLHSAAKFKPKKEQSGGGGGGGGRHQSSSSETTEGGGMRRCTHCASEKTPQWRTGPLGPKTLCNACGVRFKSGRLVPEYRPASSPTFVLTQHSNSHRKVMELRRQKEVMRQPQQVQLHHHHHPF

SEQ ID NO: 283 - DNA, 717 bp, Arabidopsis thaliana
  G344,family:GATA/Zn
atggagtgtgtagaagcatttctcggtgatttttccgtcgacgatcttctcgacctctctaacgccgacacttctttagagtcgtcttcgtcacaaagaaaagaagacgaacaagaacgtgagaaatttaagagcttttctgaccaaagtacccgtctttcaccgccagaggatctcttatcttttcccggcgacgctccggttggtgatttggaggacttagagtggttatccaacttcgtggaggattctttctcagaatcgtatatttcgagtgatttcccggtgaatccagtcgcgtcggtggaggttcggagacagtgcgttcctgttaaacctagaagcaaacgccgccgcaccaacggccgtatctggtctatggagtctccatctcctctgctatccaccgctgttgccagaaggaagaagagagggagacagaaggtggatgcatcgtacggtggcgtagtccagcagcagcagctgaggcggtgctgcagccattgtggagtccagaagacgcctcaatggagaatgggtccattaggtgcgaagacactgtgtaatgcttgtggggtccggtttaagtcgggtcgacttttacccgaatatagacccgcttgtagcccaacattcaccaacgagattcactctaactctcaccggaaagtgttggagctacggctcatgaaagtggcggatccggctcgggtttaa

SEQ ID NO: 284 - protein, 238 aa, Arabidopsis thaliana
  G344,GATA/Zn domain coordinates 166-192
MECVEAFLGDFSVDDLLDLSNADTSLESSSSQRKEDEQEREKFKSFSDQSTRLSPPEDLLSFPGDAPVGDLEDLEWLSNFVEDSFSESYISSDFPVNPVASVEVRRQCVPVKPRSKRRRTNGRIWSMESPSPLLSTAVARRKKRGRQKVDASYGGVVQQQQLRRCCSHCGVQKTPQWRMGPLGAKTLCNACGVRFKSGRLLPEYRPACSPTFTNEIHSNSHRKVLELRLMKVADPARV

SEQ ID NO: 285 - DNA, 825 bp, Arabidopsis thaliana
  G346,family:GATA/Zn
atggaaatggaatcattcatggacgaccttttgaacttctctgtaccggaagaggaagaagacgacgacgaacatacgcaaccaccgaggaatattactcgccggaaaactggattacggccaacagactccttcggtctctttaataccgacgaccttggagtggttgaagaagaggatttggaatggatttcaaacaaaaatgcttttccggtgattgaaacattcgtcggtgtattaccgtcggagcattttcctataacgtctcttctggaaagagaagcgactgaggtaaaacagctgagtccggtttcagtacttgagacgagtagccatagctccacaacgactacctcaaacagtagcggcggaagtaacggaagcacggccgtggctacgaccaccaccactccaacaataatgagctgttgcgttggttttaaagcgccggctaaagcgagaagcaagcgtcgtcgtacaggacgccgtgatttacgagttttgtggacaggaaacgagcaaggaggaatacagaagaagaagacgatgactgtggcggcggctgcgttgattatgggaaggaagtgtcaacactgtggagcggagaagactccgcaatggagggcaggaccagcggggcctaagactctgtgtaacgcttgtggcgtgaggtataagtccgggaggctagttccggagtatcgtccagcgaacagtccaactttcacggcggagttacattcgaattctcaccggaagattgtagagatgaggaagcagtatcagtccggtgacggtgacggtgatcggaaagattgtggataa

SEQ ID NO: 286 - protein, 274 aa, Arabidopsis thaliana
  G346,GATA/Zn domain coordinates 196-221
MEMESFMDDLLNFSVPEEEEDDDEHTQPPRNITRRKTGLRPTDSFGLFNTDDLGVVEEEDLEWISNKNAFPVIETFVGVLPSEHFPITSLLEREATEVKQLSPVSVLETSSHSSTTTTSNSSGGSNGSTAVATTTTTPTIMSCCVGFKAPAKARSKRRRTGRRDLRVLWTGNEQGGIQKKKTMTVAAAALIMGRKCQHCGAEKTPQWRAGPAGPKTLCNACGVRYKSGRLVPEYRPANSPTFTAELHSNSHRKIVEMRKQYQSGDGDGDRKDCG

SEQ ID NO: 287 - DNA, 570 bp, Arabidopsis thaliana
  G347,family:Z-LSDlike
atgaaagtagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaa

SEQ ID NO: 288 - protein, 189 aa, Arabidopsis thaliana
  G347,Z-LSDlike domain coordinates 9-39,50-70,80-127
MKVADMQDQLVCHGCRNLLMYPRGASNVRCALCNTINMVPPPPPPHDMAHIICGGCRTMLMYTRGASSVRCSCCQTTNLVPAHSNQVAHAPSSQVAQINCGHCRTTLMYPYGASSVKCAVCQFVTNVNMSNGRVPLPTNRPNGTACPPSTSTSTPPSQTQTVVVENPMSVDESGKLVSNVVVGVTTDKK

SEQ ID NO: 289 - DNA, 775 bp, Arabidopsis thaliana
  G351,family:Z-C2H2
ctcacgcaacttcctctcttctcaagattcttctccatacttcaccttcttctatatatctctctgctctcaaattaggttttaaattttctatagcaatggcgcttgaagctcttaattcaccaagattggtcgaggatcccttaagattcaatggcgttgagcagtggaccaaatgtaagaaacgatccaaacgttcgagatctgatcttcatcataaccaccgtctcactgaggaagagtatctagctttctgtctcatgcttcttgctcgggatggcggcgatcttgactctgtgacggttgcggagaagccgagttataagtgtggcgtttgttacaagacgttttcgtcttaccaagctctcggcggtcataaagcgagccaccggagcttatacggtggtggagagaatgataaatcgacaccatccaccgccgtgaaatctcacgtttgttcggtttgcgggaaatctttcgccaccggtcaagctctcggcggccacaagcggtgccactacgatggtggcgtttcgaactcggaaggtgtggggtctactagccacgtcagcagtagtagccaccgtggatttgaccttaatattataccggtgcagggattttcgccggacgacgaagtgatgagtccgatggcgactaagaagcctcgcctgaagtaagtctttgttgaagacctggaagtttatcaaatgtaaatatcaaatttcaatttcaaggaacagttttgttgattctattaccaatacacaatacg

SEQ ID NO: 290 - protein, 193 aa, Arabidopsis thaliana
  G351,Z-C2H2 domain coordinates 77-97,118-140
MALEALNSPRLVEDPLRFNGVEQWTKCKKRSKRSRSDLHHNHRLTEEEYLAFCLMLLARDGGDLDSVTVAEKPSYKCGVCYKTFSSYQALGGHKASHRSLYGGGENDKSTPSTAVKSHVCSVCGKSFATGQALGGHKRCHYDGGVSNSEGVGSTSHVSSSSHRGFDLNIIPVQGFSPDDEVMSPMATKKPRLK

SEQ ID NO: 291 - DNA, 727 bp, Arabidopsis thaliana
  G353,family:Z-C2H2
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttcatagagtgtaatcttttctttctgtaaaaatatattttacttgtagcaaa

SEQ ID NO: 292 - protein, 162 aa, Arabidopsis thaliana
  G353,Z-C2H2 domain coordinates 41-61,84-104
MVAISEIKSTVDVTAANCLMLLSRVGQENVDGGDQKRVFTCKTCLKQFHSFQALGGHRASHKKPNNDALSSGLMKKVKTSSHPCPICGVEFPMGQALGGHMRRHRNESGAAGGALVTRALLPEPTVTTLKKSSSGKRVACLDLSLGMVDNLNLKLELGRTVY

SEQ ID NO: 293 - DNA, 628 bp, Arabidopsis thaliana
  G354,family:Z-C2H2
cctagaagtcactaagtcgattcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccgatcgatgtgaatattattttgatacaataaaa

SEQ ID NO: 294 - protein, 168 aa, Arabidopsis thaliana
  G354,Z-C2H2 domain coordinates 42-62,88-109
MVARSEEIVIVEEDTTAKCLMLLSRVGECGGGCGGDERVFRCKTCLKEFSSFQALGGHRASHKKLINSDNPSLLGSLSNKKTKTSHPCPICGVKFPMGQALGGHMRRHRNEKVSGSLVTRSFLPETTTVTALKKFSSGKRVACLDLDLDSMESLVNWKLELGRTISWS

SEQ ID NO: 295 - DNA, 537 bp, Arabidopsis thaliana
  G355,family:Z-C2H2
atgaagagagaaagatctgatttcgaagaatccctcaagaatattgacattgctaaatgtctgatgatactagcacaaacctccatggtcaaacagatcggtttgaaccaacataccgagagccatacaagcaaccaattcgaatgcaaaacatgtaacaagagattttcttcgtttcaagcccttggtggccaccgggcaagccataagaagccaaagctcaccgttgagcagaaagatgtgaaacatcttagcaacgattataaaggaaatcattttcacaagtgttccatatgcagtcagagttttgggaccggacaggctttaggtggtcacatgagacggcataggtcaagcatgacggtcgagccatcgttcatctctccgatgattccatccatgccggttttgaaacgatgcggtagtagtaagaggattttgagtttggatttgaatctgactccgttagagaatgatcttgaatatatctttgggaagacatttgtcccaaaaatagatatgaagttcgttctttag

SEQ ID NO: 296 - protein, 178 aa, Arabidopsis thaliana
  G355,Z-C2H2 domain coordinates 49-69,94-116
MKRERSDFEESLKNIDIAKCLMILAQTSMVKQIGLNQHTESHTSNQFECKTCNKRFSSFQALGGHRASHKKPKLTVEQKDVKHLSNDYKGNHFHKCSICSQSFGTGQALGGHMRRHRSSMTVEPSFISPMIPSMPVLKRCGSSKRILSLDLNLTPLENDLEYIFGKTFVPKIDMKFVL

SEQ ID NO: 297 - DNA, 966 bp, Arabidopsis thaliana
  misc_feature (915)..(915): n is a, c, g, or t
  G359,family:Z-C2H2
atctctctctctctctctaagagacagacagacatagatatatcttagatttttcccaggggaaaaaacatagccaaaaagaaagagcttgcacatatggagagatcaaacagcatagagttgaggaacagcttctatggccgtgcaagaacttcaccatggagctatggagattatgataattgccaacaggatcatgattatcttctagggttttcatggccaccaagatcctacacttgcagcttctgcaaaagggaattcagatcggctcaagcacttggtggccacatgaatgttcacagaagagacagagcaagactcagattacaacagtctccatcatcatcttcaacaccttctcctccttaccctaaccctaattactcttactcaaccatggcaaactctcctcctcctcatcattctcctctaaccctatttccaaccctttctcctccatcctcaccaagatatagggcaggtttgatccgttccttgagccccaagtcaaaacatacaccagaaaacgcttgtaagactaagaaatcatctcttttagtggaggctggagaggctacaaggttcaccagtaaagatgcttgcaagatcctgaggaatgatgaaatcatcagcttggagcttgagattggtttgattaacgaatcagagcaagatctggatctagaactccgtttgggtttcgcttaattagatggtaataactttatccataaaggattcgaagttcacaattctagaagatatgatgcttctctaaggttaattagtttcatccatatgaaattctctaagcttgctatttagtagaacgttatagttgattatatgattatagtataagctataagcttgcgttagatgttatataatatgtatgcgcttgttaccgtntttatgtatgacaatggatacaattttgtctccttaattattgtttatctc

SEQ ID NO: 298 - protein, 204 aa, Arabidopsis thaliana
  G359,Z-C2H2 domain coordinates 49-69
MERSNSIELRNSFYGRARTSPWSYGDYDNCQQDHDYLLGFSWPPRSYTCSFCKREFRSAQALGGHMNVHRRDRARLRLQQSPSSSSTPSPPYPNPNYSYSTMANSPPPHHSPLTLFPTLSPPSSPRYRAGLIRSLSPKSKHTPENACKTKKSSLLVEAGEATRFTSKDACKILRNDEIISLELEIGLINESEQDLDLELRLGFA

SEQ ID NO: 299 - DNA, 922 bp, Arabidopsis thaliana
  G361,family:Z-C2H2
tctgtctctctctctctctttgtaaatatacatatatagataagctcacatatatggcgactgaaacatcttctttgaagctcttcggtataaacctacttgaaacgacgtcggttcaaaaccagtcatcggaaccaagacccggatccggatcaggatccgagtcacgtaagtacgagtgtcaatactgttgtagagagtttgctaactctcaagctcttggtggtcaccaaaacgctcacaagaaagagcgtcagcttcttaaacgtgcacagatgttagctactcgtggtttgccacgtcatcataattttcaccctcataccaatccgcttctctccgccttcgcgccgctgcctcacctcctctctcagccgcatcctccgccgcatatgatgctctctccttcttcttcgagttctaagtggctttacggtgaacacatgtcgtcacaaaacgccgttgggtactttcatggtggaaggggactttacggaggtggcatggagtctatggccggagaagtaaagactcatggtggttctttgccggagatgaggaggttcgccggagatagtgatcggagtagcggaattaagttagagaatggtattgggctggacctccatttaagccttgggccatgaatgattataattttggcccagtaaagatctgtaaaatactactaggatttcatttttatagagtatgtttttttccttaatttcggttgaaattggtgaatatttttatctcttacttaccaaatctcatatttctatgtatgcgtttgctttcactttttttttttatataattcttcttgtaaaaaatgcaatgtgagttttcttccctatcattctgtcaagctttggttcaattatttagtaatcgaataatataggaatagtgttgaaag

SEQ ID NO: 300 - protein, 197 aa, Arabidopsis thaliana
  G361,Z-C2H2 domain coordinates 43-63
MATETSSLKLFGINLLETTSVQNQSSEPRPGSGSGSESRKYECQYCCREFANSQALGGHQNAHKKERQLLKRAQMLATRGLPRHHNFHPHTNPLLSAFAPLPHLLSQPHPPPHMMLSPSSSSSKWLYGEHMSSQNAVGYFHGGRGLYGGGMESMAGEVKTHGGSLPEMRRFAGDSDRSSGIKLENGIGLDLHLSLGP

SEQ ID NO: 301 - DNA, 977 bp, Arabidopsis thaliana
  G362,family:Z-C2H2
ataaaaaacccttcatacaatataaaatttctttagacatacaatatattatactattacagatgcaatgcatcattagttacaaactattaaactaaatatcccccgtctctctcttgctatataaagaagatcatttacacatctccttaagcaaattaaacccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaattaaagagagatatatgattaagattatatgtactatagtggcgtatttcattgggatcatgaaggggaaaaaacgagacatatagtattcttgatgcaatttgagttttgtaatttatttaggtttatgtatgttttcgaag

SEQ ID NO: 302 - protein, 211 aa, Arabidopsis thaliana
  G362,Z-C2H2 domain coordinates 62-82
MSINPTMSRTGESSSGSSSDKTIKLFGFELISGSRTPEITTAESVSSSTNTTSLTVMKRHECQYCGKEFANSQALGGHQNAHKKERLKKKRLQLQARRASIGYYLTNHQQPITTSFQRQYKTPSYCAFSSMHVNNDQMGVYNEDWSSRSSQINFGNNDTCQDLNEQSGEMGKLYGVRPNMIQFQRDLSSRSDQMRSINSLDLHLGFAGDAA

SEQ ID NO: 303 - DNA, 780 bp, Arabidopsis thaliana
  G363,family:Z-C2H2
atgagaccaatattagacctcgaaattgaagcttcatcgggcagtagtagcagccaagtggcctcaaacttgtctccggttggggaagattacaaaccaatctcgctgaatcttagcctcagtttcaacaacaacaacaacaataatctggatcttgaatcatcgtctttgacgctgccactttcgagcacgagtgagagtagtaacccggagcagcagcagcaacaacaaccatctgtatcaaagagagtcttctcttgtaactactgccaaaggaagttctatagctctcaagcgctaggtggtcaccaaaacgctcacaaacgtgagagaacactcgccaaacgcgctatgctatgggtcttgctggggtcttccccggtagaggatcaagtagcaattatgcggctgctgccacagcagccgctctcgtgtttgccgcttcacggaagcggaaacgggaacatgacatcgttcaggactttgggaatccgggcacattcctcggcgcacgacgtcagcatgacaaggcagacaccagaaacacttattagaaacattgccaggttcaaccaggggtatttcggtaattgtatacctttttacgtggaggacgacgaggccgagatgctctggccggggagtttccggcaagctacgaatgcggttgcggttgaagcgggtaatgataatttaggtgaaagaaaaatggatttcttggacgtcaagcaagcgatggatatggaaagttctcttccagatctaaccttgaagctttga

SEQ ID NO: 304 - protein, 259 aa, Arabidopsis thaliana
  G363,Z-C2H2 domain coordinates 87-108
MRPILDLEIEASSGSSSSQVASNLSPVGEDYKPISLNLSLSFNNNNNNNLDLESSSLTLPLSSTSESSNPEQQQQQQPSVSKRVFSCNYCQRKFYSSQALGGHQNAHKRERTLAKRAMLWVLLGSSPVEDQVAIMRLLPQQPLSCLPLHGSGNGNMTSFRTLGIRAHSSAHDVSMTRQTPETLIRNIARFNQGYFGNCIPFYVEDDEAEMLWPGSFRQATNAVAVEAGNDNLGERKMDFLDVKQAMDMESSLPDLTLKL

SEQ ID NO: 305 - DNA, 577 bp, Arabidopsis thaliana
  G366,family:Z-C2H2
tcctctgtagcttaagaacctctcaaaaatggcggaaccaccaccgtcttaccttcatttcgtaggtcctgcaaaaactcgatcatcaagcaaacgccactctttctcctcctctgcacatccagcttcccaccgtctctttccatgtcagtactgtcctcgaaagttctacacatctcaagctctcggcggtcaccaaaacgctcacaaacgcgaacgcgccgctgctcgtcgtaacctcggcgtcctcgctaactctccacccatcctcgacgacaacaacacgtttcttcgtccttacccttgcttttaccaaaacccatttcaaggatctacttctggaaacgaaccgcttcaggaacagccgacgatgatgacgatggatggctacgatccgtttcatccgtatccgtatgtgtacccttttgcattatccggtaacaacaacgacggaggaaacggcgttatggaagaagacgagcctctcgatctagacctttctctccgtttataagttatctctgctttcttctctgttttgttttttgttcagatgactcttttaagtacaactttg

SEQ ID NO: 306 - protein, 161 aa, Arabidopsis thaliana
  G366,Z-C2H2 domain coordinates 40-60
MAEPPPSYLHFVGPAKTRSSSKRHSFSSSAHPASHRLFPCQYCPRKFYTSQALGGHQNAHKRERAAARRNLGVLANSPPILDDNNTFLRPYPCFYQNPFQGSTSGNEPLQEQPTMMTMDGYDPFHPYPYVYPFALSGNNNDGGNGVMEEDEPLDLDLSLRL

SEQ ID NO: 307 - DNA, 774 bp, Arabidopsis thaliana
  G370,family:Z-C2H2
atggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctga

SEQ ID NO: 308 - protein, 257 aa, Arabidopsis thaliana
  G370,Z-C2H2 domain coordinates 97-117
MDETNGRRETHDFMNVNVESFSQLPFIRRTPPKEKAAIIRLFGQELVGDNSDNLSAEPSDHQTTTKNDESSENIKDKDKEKDKDKDKDNNNNRRFECHYCFRNFPTSQALGGHQNAHKRERQHAKRGSMTSYLHHHQPHDPHHIYGFLNNHHHRHYPSWTTEARSYYGGGGHQTPSYYSRNTLAPPSSNPPTINGSPLGLWRVPPSTSTNTIQGVYSSSPASAFRSHEQETNKEPNNWPYRLMKPNVQDHVSLDLHL

SEQ ID NO: 309 - DNA, 582 bp, Arabidopsis thaliana
  G371,family:RING/C3HC4
atggagattgagaaggatgaggacgacacaacattggttgattctggaggagacttcgactgcaacatatgtttggatcaggttcgagacccggtcgtgactttatgtggccacctgttttgttggccctgcattcacaagtggacttatgcgtccaacaattcaagacaacgagtcgatcaatacgatcataagagggaaccaccaaaatgtccggtatgcaaatctgatgtctccgaggctacgcttgtcccgatctacggacgaggacagaaagctccccagtccggttcaaatgtaccgagcagaccaactggtccggtttatgacttaagaggagttggtcaacgtttaggagaaggggagagtcaacgttacatgtatagaatgcctgatccggtgatgggtgtggtatgcgaaatggtataccggagactatttggagagtcttcgagcaacatggcaccttaccgcgatatgaatgtccggtctaggcgacgggcaatgcaggctgaggagtcattaagcagagtctacttgtttctactttgcttcatgtttatgtgtctatttctcttctaa

SEQ ID NO: 310 - protein, 193 aa, Arabidopsis thaliana
  G371,RING/C3HC4 domain coordinates 21-74
MEIEKDEDDTTLVDSGGDFDCNICLDQVRDPVVTLCGHLFCWPCIHKWTYASNNSRQRVDQYDHKREPPKCPVCKSDVSEATLVPIYGRGQKAPQSGSNVPSRPTGPVYDLRGVGQRLGEGESQRYMYRMPDPVMGVVCEMVYRRLFGESSSNMAPYRDMNVRSRRRAMQAEESLSRVYLFLLCFMFMCLFLF

SEQ ID NO: 311 - DNA, 1379 bp, Arabidopsis thaliana
  G372,family:RING/C3HC4
atgcagaattcataaacaccgctctggaattttactttttaggataacaaaggagggtcattttatctgttaatgggtgaagagatatctagcactgtgaacctggatttgaatctgggtcctgatcctgagttaggtctcgagccagcgacgaattatgctcggtctgattggggtaatggacttgctgctagggaatccgaatctctgagaaggtttagaagtcggtaccggtcacgtttcagacggattgatatgcttccggttcttgctgagacacatagcccggcgatggaattgagtcagttgttgatcacttctggaaatgtagttgctttgcctgctggtgagggaagcatggctagtggagaaagggtcatcgaggactccaaaaagtgcgagaatgggagcaaagtgatggcagaagacaatgtaacagaggagaaaagagatgttgagaagagcgttggcagcgatgggagctttttcgattgttatatatgtttggatttgtccaaggatccagttgttactaattgtggccacctttactgttggtcttgcctttaccagtggctacaggtttcagaggcaaaagaatgcccggtttgtaaaggggaggtatctgtgaaaacagtgactccaatctatggacgtgggatacagaaaagagaatctgaggaggtttcaaacaccaagatcccttcgagaccccaagcacgacgcacagagagtttgaggactacacttaacaggtcaggtcatataccaacggaaatatttagacatttgcaggataggcttgaaagggaatctagtacaggagaaagacgcgccagaccatctcttaaccggtttatgacttcgaggggagttagagcagaggagaaccagtctagtgaagcactggttgaaccttcatcagatgagattaacgatattgatctgatcttaaataatgcccctgaaaatgaagaggaaaacgaaaacctaagctcgtcacgtgctttggcaacccagagacgatgggcacagatgtatgggagggtgtcgtcgtttactttgagctctgctgaaagattagcggatacttatttgataacacatgcattggggaggaaccaagaacaaaacagcagtcctcctgttggtgttgaagacagggattcgttctcaagcatagtaggtgtgataaactcggagagtcaagttgaaacggcggctgagattaattcaatgttgactgtatcgacttcttcgtctgttagaagacatgagaacagttcaagggtctctgatgttgacagtgcagattctcgtccactgaggagaagaaggagattagcttagaagagaatggaggagaagaaagaggaagc

SEQ ID NO: 312 - protein, 425 aa, Arabidopsis thaliana
  G372,RING/C3HC4 domain coordinates 141-180
MGEEISSTVNLDLNLGPDPELGLEPATNYARSDWGNGLAARESESLRRFRSRYRSRFRRIDMLPVLAETHSPAMELSQLLITSGNVVALPAGEGSMASGERVIEDSKKCENGSKVMAEDNVTEEKRDVEKSVGSDGSFFDCYICLDLSKDPVVTNCGHLYCWSCLYQWLQVSEAKECPVCKGEVSVKTVTPIYGRGIQKRESEEVSNTKIPSRPQARRTESLRTTLNRSGHIPTEIFRHLQDRLERESSTGERRARPSLNRFMTSRGVRAEENQSSEALVEPSSDEINDIDLILNNAPENEEENENLSSSRALATQRRWAQMYGRVSSFTLSSAERLADTYLITHALGRNQEQNSSPPVGVEDRDSFSSIVGVINSESQVETAAEINSMLTVSTSSSVRRHENSSRVSDVDSADSRPLRRRRRLA

SEQ ID NO: 313 - DNA, 1805 bp, Arabidopsis thaliana
  G374,family:Z-ZPF
attccctctcttcgatttttaattccttgctcctctgctcgtttctctaccggcgacgtaacctctctgtctctgttctgttccttgcctgctcgaggtgtgcatcttcttggaatcagctgactttgcggtcaatcggatttcttgggattgtttggagaaactttggaggtgatggacaacaaaaatgatcaggatattgatgttagatcagtggttgaagctgtttccgccgatctttcctttggtgctcccctctatgtggttgagagcatgtgcatgcgctgccaagaaaatggaacaaccagatttctattgaccttaattcctcacttcagaaaggtcttaatatctgcatttgaatgtccgcattgcggggaaaggaataatgaagttcagttcgcaggcgagattcaaccccgtggatgctgttacaatctagaggttctagctggtgatgtgaagatatttgaccggcaagttgtgaaatctgaatcagccactattaagattcctgaactggattttgagattccaccagaggcccaacgtggaagtttgtctactgtggaagggatattagcacgggctgctgatgaactgagtgcccttcaagaagaacgcaagaaagttgatcctaaaactgctgaagcaatagaccaattcttgtccaaactgagagcttgtgctaaagcagagacatccttcaccttcattttggatgatcctgctggaaacagtttcattgagaacccacatgctccatcaccagatccctctctaaccatcaaattctatgagcgaacaccagagcaacaagcaacacttggatatgttgctaacccatctcaggctggacaatcagaaggaagccttggcgcaccttctactaaaacagcttatgtacctaatggaacaatcggagcaactgctggtcatcgcgcgattgctcagagtaatagcactgatatttccgacaacttgttcagatactctgcgcctgaagaggtgatgactttcccttcaacttgcggagcatgtacggagccgtgtgagacacggatgttcgtgactaaaatcccgtactttcaggaagttattgtcatggcatctacatgtgacagttgtggctatcgtaattctgagttgaagcctggtggtgcaattcctgaaaagggaaagaagattactctctctgtgaggaacattacagaccttagccgagatgttatcaagtcggacactgcaggagtgataatcccagaacttgatctggagctagctggtggtacacttggtggaatggtaacaacagttgaagggttggttacacagatcagagaaagcctagcgagagttcacggattcacttttggtgatagtatggaagagagtaagttgaacaaatggagagaatttggagccaggctcactaagctcctaagctttgaacagccgtggacattgattcttgatgatgaattagcaaattcctttattgcaccagtaacagatgatatcaaagatgaccatcagctcacatttgaagagtacgagaggtcatgggatcaaaacgaggagttgggtctcaacgacatagatacttcttcagctgatgctgcttatgaatccacagagacgactaaattaccttaagattagttggtcttacatgatttaattttagatggtgatgatcagactgatggatccatatgttgttgtattgtaacaattaaagaatcaaagaacaaattcctctttttaatctattaaaaaaaaaacttttgagccaaaaaaaaaac

SEQ ID NO: 314 - protein, 493 aa, Arabidopsis thaliana
  G374,Z-ZPF domain coordinates 35-67,286-318
MDNKNDQDIDVRSVVEAVSADLSFGAPLYVVESMCMRCQENGTTRFLLTLIPHFRKVLISAFECPHCGERNNEVQFAGEIQPRGCCYNLEVLAGDVKIFDRQVVKSESATIKIPELDFEIPPEAQRGSLSTVEGILARAADELSALQEERKKVDPKTAEAIDQFLSKLRACAKAETSFTFILDDPAGNSFIENPHAPSPDPSLTIKFYERTPEQQATLGYVANPSQAGQSEGSLGAPSTKTAYVPNGTIGATAGHRAIAQSNSTDISDNLFRYSAPEEVMTFPSTCGACTEPCETRMFVTKIPYFQEVIVMASTCDSCGYRNSELKPGGAIPEKGKKITLSVRNITDLSRDVIKSDTAGVIIPELDLELAGGTLGGMVTTVEGLVTQIRESLARVHGFTFGDSMEESKLNKWREFGARLTKLLSFEQPWTLILDDELANSFIAPVTDDIKDDHQLTFEEYERSWDQNEELGLNDIDTSSADAAYESTETTKLP

SEQ ID NO: 315 - DNA, 1290 bp, Arabidopsis thaliana
  G375,family:Z-Dof
tcgacaaaaactctcactctccctcaaactaaacaaacatacagaacacaaaatgggtctcacttctcttcaagtttgcatggattctgattggctccaggaatccgagtcatcaggaggaagcatgttagactcttcaacgaattctccgtcagcagccgacatactagcagcttgcagcactagaccacaagcctcggccgtggctgtagccgctgcagctctgatggacggtggaaggaggctgcgtccacctcacgaccatcctcaaaagtgtcctcgttgcgagtcaacacatactaagttctgttactacaataactacagcctctctcagcctcgttacttctgcaagacttgtcgccgttactggacaaaaggcggaactctaaggaatattccggttggtggtggatgccgtaaaaacaagaaaccatcttcctctaattcctcctcctccacttcttccggcaaaaaaccatccaacatcgttaccgccaatacctctgatcttatggctttagcacattctcatcaaaattaccaacattctcctctagggttttcacattttggtgggatgatggggtcttactcaactccggagcatggtaacgttggtttcttggagagcaagtatggcggtttgctttcgcagagccctagacctattgatttcttggacagtaagtttgatctcatgggagtgaacaatgacaacctggtcatggttaatcatggaagtaacggagatcatcatcatcatcataatcatcacatgggtctgaatcacggtgtaggtcttaacaacaacaacaacaatggtggatttaatgggatttctacgggaggcaatggaaatggtggtggtctcatggatatatcgacatgccaaagacttatgctatctaattatgatcatcaccattacaatcatcaagaagatcatcaaagggtagcaacaataatggatgtgaagccaaatccgaagttgttatcgcttgattggcagcaagatcaatgctactccaatggtggtggtagcggaggcgcaggaaaatccgacggtggtggatacggcaatggtggttatatcaacggtttaggttcgtcgtggaatggtttgatgaatggctatggaacgtccactaaaacaaactccttggtttgataagttaatcagaacttcttttttcttgtcgtcatcaactagtagtagtagtaatagtagttggagactagagaagcacttcaaattatttatgggtttgtttgctaagccagttttac

SEQ ID NO: 316 - protein, 372 aa, Arabidopsis thaliana
  G375,Z-Dof domain coordinates 75-103
MGLTSLQVCMDSDWLQESESSGGSMLDSSTNSPSAADILAACSTRPQASAVAVAAAALMDGGRRLRPPHDHPQKCPRCESTHTKFCYYNNYSLSQPRYFCKTCRRYWTKGGTLRNIPVGGGCRKNKKPSSSNSSSSTSSGKKPSNIVTANTSDLMALAHSHQNYQHSPLGFSHFGGMMGSYSTPEHGNVGFLESKYGGLLSQSPRPIDFLDSKFDLMGVNNDNLVMVNHGSNGDHHHHHNHHMGLNHGVGLNNNNNNGGFNGISTGGNGNGGGLMDISTCQRLMLSNYDHHHYNHQEDHQRVATIMDVKPNPKLLSLDWQQDQCYSNGGGSGGAGKSDGGGYGNGGYINGLGSSWNGLMNGYGTSTKTNSLV

SEQ ID NO: 317 - DNA, 396 bp, Arabidopsis thaliana
  G377,family:RING/C3H2C3
atgggtctctcgcattttccaacagcgtcagaaggagtactaccacttctggtgatgaacacggttgtttcaatcactctgttgaagaacatggtgaggtctgtttttcaaattgttgcatccgagactgaatcttccatggagatagacgacgagcctgaagatgattttgttactagaagaatctcgataacacagttcaagtctctatgtgagaacatagaagaggaagaagaagagaaaggtgtggagtgttgtgtgtgcctttgtgggtttaaagaggaagaggaagtgagtgagttggtttcttgcaagcatttcttccacagagcttgtctagacaactggtttggtaataaccacaccacatgccctctttgcaggtccattctctag

SEQ ID NO: 318 - protein, 131 aa, Arabidopsis thaliana
  G377,RING/C3H2C3 domain coordinates 85-128
MGLSHFPTASEGVLPLLVMNTVVSITLLKNMVRSVFQIVASETESSMEIDDEPEDDFVTRRISITQFKSLCENIEEEEEEKGVECCVCLCGFKEEEEVSELVSCKHFFHRACLDNWFGNNHTTCPLCRSIL

SEQ ID NO: 319 - DNA, 726 bp, Arabidopsis thaliana
  G378,family:RING/C3H2C3
atggcctcgtcatcatcatcatcttatagattccaatctgggtcttaccctctttcgtcaagtccttctcttgggaatttcgtcgaacgcattaaagacgcttgtcatttccttgtctctgctgttttgggtaccattatctccgcgatcttgaccttcttcttcgcactagtgggcacattgctaggggcacttacaggagctttgataggtcaagaaactgagagtggtttcattagaggagcagcaattggagccatttcgggagctgttttctctatcgaggtctttgaatcatctctggatctctggaaatccgatgagtcgggtttcggatgttttctctacttgattgatgtcattgttagtcttctaagcgggagacttgtacgagagcgcattggtcctgcaatgctaagtgcagtgcaaagtcaaatgggagctgtggatacagcttttgatgatcacacaagcctttttgatacaggaggctcaaaaggattgacaggagaccttgttgagaaaatcccaaagatgacaatcactggcaacaataacactgatgcttctgagaacacagactcatgttctgtttgtcttcaggatttccagctcggtgaaacagttagaagcttgcctcattgtcatcacatgtttcacttaccttgcatagacaattggctccttagacacggttcttgcccgatgtgtagacgtgatatttaa

SEQ ID NO: 320 - protein, 241 aa, Arabidopsis thaliana
  G378,RING/C3H2C3 domain coordinates 196-237
MASSSSSSYRFQSGSYPLSSSPSLGNFVERIKDACHFLVSAVLGTIISAILTFFFALVGTLLGALTGALIGQETESGFIRGAAIGAISGAVFSIEVFESSLDLWKSDESGFGCFLYLIDVIVSLLSGRLVRERIGPAMLSAVQSQMGAVDTAFDDHTSLFDTGGSKGLTGDLVEKIPKMTITGNNNTDASENTDSCSVCLQDFQLGETVRSLPHCHHMFHLPCIDNWLLRHGSCPMCRRDI

SEQ ID NO: 321 - DNA, 2253 bp, Arabidopsis thaliana
  G380,family:RING/C3H2C3
gtctccccattaggcacattgttgagggcagggtagtctcgtgagttctcttctcctgagtgtaactgtggttaaaagcttagccaagatgcagggggagagggccagtcttggctatttatcagaggccttgaactttgagcatggttcttcttcaagtaatggtgtgatagatcattgggagaatattcacagtcttggtgataatgacttgcaggattacatgattgcaaattctgaatcaaatacttcgcttgcaaactcagtttatcacgagcaacagggtttacgcagatttagccttggtgaggctagctctagtggcacgaaggatgaagcttccagtcacaatgagcaacgaatggaaacaagatgctttgacggacgaggaaatgaaataattgatttagacccagtgtttgcgcagccatcaggcacaaatcaacctgttcagaatgtcaatctgaatgcagagtatatagaaattcacgaggatattaatccatatagaggtcggtctggcttcatagaagctaatggaccagggaccagggtctcacaacctggcagatcttttgaagagaacggtgttggaacaggttcttctgtagagggacgtcgtgcatcctgcaaaagaaaagctcttgaaggcagtattagtcaatcttcttcaggaggttatcatgatttccagcgtggagaaagcagttcgtggaccccaggttctacggtttttaggccaggaaatggtttaaacatatctggctcccttgacaatggaccaagaggaatggtctccggtactgtaccaaattttcctgtttctgcaccaaattttcctgtttctgccattgcagagagctccagtagaaatatatgcgtcaggagtaatccctcagatcatcaagaaactgtaaacccatctacctttgctgcgggaactgttgtcaggcggcctgtccctccatcccagttgaacttgtcaagacacttaccagcagatcagcattcattggacttgagacctggacagtcttttgtcgtttctcgtaacccaaattctactcctgtgagcataccacctggttcaaggactatgctaccaccatttcggtggactgggagctcactagtgggtggaacatcgaactctactgcgcccgttgagagaaatcttcatctagatgaaaccaggtcaagaagcatacccgggaatactcttgagattcccatgtttgcagctcctgaggtaggaaattttgcccgtagtcagagtagcagaaatgtaacaaatggaaacctgaatagtgcatcatcagtgtccaggacaggctcaacaacaagtgttccaccaccaccaccaccatcttctaatctagcgtggacttcttaccagaattcaccacattatcaaagaagaaggactgaaaggtctgaacttgcacgtaggtccttgctttcttcccttgcagcagatgctacaaaccagagatctggtgatcatccaacacttcgttcgttggcccctcctgcctcttcggatgggcttgtgcttcagcctggtggtgataatagtcagatgcataatcgggcttactcgagagcaggtccgttgtttgataggcaaggggatagtgtggttggtattcctcatcctttgcgggccttggcagctgcaagcagaggaagaagcagacttatggtgtcccagatgcagaatgtcttggatgtcatgcgtagggatgctaataataacaacttgcggcttgaggacgttatgcttctaaatcactcagtactatttgatggggctactggtcatgaccggtatagagacatgcgacttgatgtggacaacatgtcatatgaggaattgttggcactagaagagcggattggagatgtttgtaccggtgtaaacgaggaaaccatatcaaaccggttaaagcaacgaaaatacaaaagcaacacaaaatctccacaagatgcagagccatgctgtgtttgtcaggaggaatacaccgaaggagaagacatggggacactagaatgtgggcatgaattccatagccaatgcattaaagaatggctgaaacagaagaatctttgcccaatctgcaagactacaggcttgaacaccgcgaagaagcggaggatagcatgatgatttctcgaaagagctttttttttttcttaactattcaattttataatcaaaaatgaaagaaacagaaggtaccctaagcccaaggg

SEQ ID NO: 322 - protein, 691 aa, Arabidopsis thaliana
  G380,RING/C3H2C3 domain coordinates 637-677
MQGERASLGYLSEALNFEHGSSSSNGVIDHWENIHSLGDNDLQDYMIANSESNTSLANSVYHEQQGLRRFSLGEASSSGTKDEASSHNEQRMETRCFDGRGNEIIDLDPVFAQPSGTNQPVQNVNLNAEYIEIHEDINPYRGRSGFIEANGPGTRVSQPGRSFEENGVGTGSSVEGRRASCKRKALEGSISQSSSGGYHDFQRGESSSWTPGSTVFRPGNGLNISGSLDNGPRGMVSGTVPNFPVSAPNFPVSAIAESSSRNICVRSNPSDHQETVNPSTFAAGTVVRRPVPPSQLNLSRHLPADQHSLDLRPGQSFVVSRNPNSTPVSIPPGSRTMLPPFRWTGSSLVGGTSNSTAPVERNLHLDETRSRSIPGNTLEIPMFAAPEVGNFARSQSSRNVTNGNLNSASSVSRTGSTTSVPPPPPPSSNLAWTSYQNSPHYQRRRTERSELARRSLLSSLAADATNQRSGDHPTLRSLAPPASSDGLVLQPGGDNSQMHNRAYSRAGPLFDRQGDSVVGIPHPLRALAAASRGRSRLMVSQMQNVLDVMRRDANNNNLRLEDVMLLNHSVLFDGATGHDRYRDMRLDVDNMSYEELLALEERIGDVCTGVNEETISNRLKQRKYKSNTKSPQDAEPCCVCQEEYTEGEDMGTLECGHEFHSQCIKEWLKQKNLCPICKTTGLNTAKKRRIA

SEQ ID NO: 323 - DNA, 636 bp, Arabidopsis thaliana
  G383,family:GATA/Zn
atgggtttctcaatgttcttctcccccgaaaacgacgtcagccatcattcctctccatatgcttctgttgactgcactctctcacttggaactccctccactcgcctctgcaacgaggatgatgaacgtagattctcgtctcatacctccgacaccataggctgggacttcttgaacggttccaagaaaggcggtggaggcggcggacataacctcctcgctcgccgttgcgccaactgcgacaccacttctactcctctttggagaaacggtccaagaggtcccaagtcgttgtgtaatgcgtgtggaatccgattcaagaaagaagagagacgtgcatcgaccgccagaaactcgacctccggcggaggatcaactgcagctggagttccaactttggatcatcaagcaagtgcaaattattattataacaataataaccaatatgcttcatcgtcgccttggcaccatcagcataatacgcagagagttccatattactcgccggccaataacgaatactcatacgttgatgatgtcagagttgttgatcatgacgtcacaaccgacccgttcttgtcttggaggcttaacgtcgccgaccggaccggccttgtccacgattttacgatgtga

SEQ ID NO: 324 - protein, 211 aa, Arabidopsis thaliana
  G383,GATA/Zn domain coordinates 77-102
MGFSMFFSPENDVSHHSSPYASVDCTLSLGTPSTRLCNEDDERRFSSHTSDTIGWDFLNGSKKGGGGGGHNLLARRCANCDTTSTPLWRNGPRGPKSLCNACGIRFKKEERRASTARNSTSGGGSTAAGVPTLDHQASANYYYNNNNQYASSSPWHHQHNTQRVPYYSPANNEYSYVDDVRVVDHDVTTDPFLSWRLNVADRTGLVHDFTM

SEQ ID NO: 325 - DNA, 2940 bp, Arabidopsis thaliana
  G384,family:HB
gttttttcttctgaagagtgatatatattctacctttctctggttaaagaaactccctgaatccaccggttatgtcttgaccggctttaagcctataaactgatgccctaagacacctttttaggtttctcaataattctccgcatctatcttttcttctccacaagtaagggaaccagaaaaccagggaagaatccgagcaagctagggtttcattgtgtgcacaaaatgggatatacaggcagaagaaaatcgagataaatcaactaaatgatttggataatcatcttgaagatttgaaggatttcgagactaagtccggcgcagaagtcaccatggagaatcctttagaagaagagcttcaagatcctaatcagcgtcccaacaaaaagaagcgttaccaccgtcacacacaacgccagattcaagagctagagtcgttcttcaaggaatgtcctcatccagacgataagcaaagaaaggagctgagtcgcgagctaagcttagaacctcttcaagtcaagttctggttccaaaacaaacgcactcaaatgaaggcacaacatgagaggcacgagaaccagatactgaagtcagaaaatgacaagctccgagcagagaacaataggtacaaggatgctctaagcaacgcaacatgcccaaactgtggtggtccggcagctataggagaaatgtccttcgacgaacagcatttaaggatcgaaaatgctcgtttacgcgaagagattgacagaatctctgccatagctgctaaatacgtagggaagcctttaatggctaattcctcttctttccctcagctctcttcttcacaccacattccctcgcgctcgcttgatcttgaagttgggaactttgggaacaataacaatagccacactggtttcgttggggaaatgtttggaagcagcgacattttgaggtcggtttcgataccttctgaggctgataagcctatgattgttgagttagctgttgcagcaatggaagagcttgtgagaatggctcaaactggtgatcccttatgggtttcaagcgataattctgttgagattctcaatgaagaagagtattttaggacgtttcctagaggaattggaccgaaacctatcggtttgagatcagaagcttcaagagagtctactgttgttatcatgaatcatatcaatctcattgagattctaatggatgtgaatcaatggtctagtgtgttctgcgggattgtatcaagagcattgactctagaagttctctcaactggcgtacgagggaactacaatggggcattgcaagtgatgacagcagagttccaagtcccatcgccgcttgtccctactcgtgagaactactttgtaaggtactgtaaacagcacagtgacggtatttgggcggttgtggatgtctctttggacagcctaagaccaagtccgatcactagaagcagaagaagaccctctggttgtctgattcaagaattgcagaatggttactccaaggtgacatgggtagagcatattgaggtggatgatagatcggttcacaacatgtataaaccgttggttaataccggtttagctttcggtgcaaaacgttgggtggctacacttgaccgccaatgtgagcggctcgccagttccatggccagcaacattccggcttgtgatctttccgtgataacgagtcctgaggggagaaagagcatgctgaaactagcggagagaatggtgatgagcttctgtaccggagtcggcgcgtcaaccgccgatgcctggactacattgtcgaccacaggatccgacgacgttcgggtcatgacccgaaagagcatggatgatccgggaagacctccaggcatcgttctcagcgccgctacttctttctggatccctgtagctccaaaacgagtgttcgattttctcagagatgaaaactcaagaagcgagtgggatatactttccaatggaggcttggttcaagaaatggctcatatcgcaaatggtcgtgatcctgggaatagtgtctccttgcttcgagtcaatagtgggaactcagggcagagcaacatgttgatcttacaagaaagttgtacggacgcatcagggtcctatgtgatatacgcaccagttgatataatagctatgaacgttgtcctgagtggtggtgatccggattatgtcgctttgttaccatccggattcgctattttgccggatggctctgctagaggaggaggaggtagtgctaatgccagtgctggagccggagttgaaggaggaggagaggggaataatcttgaagtggttactactactgggagttgtggcggttcactactcacagttgcgtttcagatacttgttgactctgttcctaccgctaaactctctctcggttcagttgctacagtcaatagtctgatcaaatgcactgtcgagcggattaaagccgctctggcctgcgacggagcctaatcgatgttttcggaaggtaagagtgaaaggggaggtttagggagtttatgataatgtttgtgttcttttggtttttaaagtcttttgagattctccaaaggaagtcaagaacgctcctttttgcgtttaatctcatttccgcgtttgttagcggacgggccaaagaaagaggcttgagaaagaaaaggtaaagaggttcgggtattgacttctgctggaaccaaaaaaaaaggaatcgggtttgttgtgtttcggcggtttagcattttgcgttttctttgttattatttatcattgactagtgaacagtttagcgttctgcttttcgcgtctactgtgaaactccttgttattaagccactctagtggtactgtcattatatattatgaatctatgaaactgtgtttattagtttgtttctttaatccaaacttgagattctcttct

SEQ ID NO: 326 - protein, 718 aa, Arabidopsis thaliana
  G384,HB domain coordinates 14-77
MENPLEEELQDPNQRPNKKKRYHRHTQRQIQELESFFKECPHPDDKQRKELSRELSLEPLQVKFWFQNKRTQMKAQHERHENQILKSENDKLRAENNRYKDALSNATCPNCGGPAAIGEMSFDEQHLRIENARLREEIDRISAIAAKYVGKPLMANSSSFPQLSSSHHIPSRSLDLEVGNFGNNNNSHTGFVGEMFGSSDILRSVSIPSEADKPMIVELAVAAMEELVRMAQTGDPLWVSSDNSVEILNEEEYFRTFPRGIGPKPIGLRSEASRESTVVIMNHINLIEILMDVNQWSSVFCGIVSRALTLEVLSTGVRGNYNGALQVMTAEFQVPSPLVPTRENYFVRYCKQHSDGIWAVVDVSLDSLRPSPITRSRRRPSGCLIQELQNGYSKVTWVEHIEVDDRSVHNMYKPLVNTGLAFGAKRWVATLDRQCERLASSMASNIPACDLSVITSPEGRKSMLKLAERMVMSFCTGVGASTADAWTTLSTTGSDDVRVMTRKSMDDPGRPPGIVLSAATSFWIPVAPKRVFDFLRDENSRSEWDILSNGGLVQEMAHIANGRDPGNSVSLLRVNSGNSGQSNMLILQESCTDASGSYVIYAPVDIIAMNVVLSGGDPDYVALLPSGFAILPDGSARGGGGSANASAGAGVEGGGEGNNLEVVTTTGSCGGSLLTVAFQILVDSVPTAKLSLGSVATVNSLIKCTVERIKAALACDGA

SEQ ID NO: 327 - DNA, 2217 bp, Arabidopsis thaliana
  G385,family:HB
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattagc

SEQ ID NO: 328 - protein, 721 aa, Arabidopsis thaliana
  G385,HB domain coordinates 60-123
MFEPNMLLAAMNNADSNNHNYNHEDNNNEGFLRDDEFDSPNTKSGSENQEGGSGNDQDPLHPNKKKRYHRHTQLQIQEMEAFFKECPHPDDKQRKQLSRELNLEPLQVKFWFQNKRTQMKNHHERHENSHLRAENEKLRNDNLRYREALANASCPNCGGPTAIGEMSFDEHQLRLENARLREEIDRISAIAAKYVGKPVSNYPLMSPPPLPPRPLELAMGNIGGEAYGNNPNDLLKSITAPTESDKPVIIDLSVAAMEELMRMVQVDEPLWKSLALDEEEYARTFPRGIGPRPAGYRSEASRESAVVIMNHVNIVEILMDVNQWSTIFAGMVSRAMTLAVLSTGVAGNYNGALQVMSAEFQVPSPLVPTRETYFARYCKQQGDGSWAVVDISLDSLQPNPPARCRRRASGCLIQELPNGYSKVTWVEHVEVDDRGVHNLYKHMVSTGHAFGAKRWVAILDRQCERLASVMATNISSGEVGVITNQEGRRSMLKLAERMVISFCAGVSASTAHTWTTLSGTGAEDVRVMTRKSVDDPGRSPGIVLSAATSFWIPVPPKRVFDFLRDENSRNEWDILSNGGVVQEMAHIANGRDTGNCVSLLRVNSANSSQSNMLILQESCIDPTASFVIYAPVDIVAMNIVLNGGDPDYVALLPSGFAILPDGNANSGAPGGDGGSLLTVAFQILVDSVPTAKLSLGSVATVNNLIACTVERIKASMSCETA

SEQ ID NO: 329 - DNA, 2409 bp, Arabidopsis thaliana
  G386,family:HB
atgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatctatgttcaaagagtgtccgcatccagacgagaaacaaagattagaactaagtaagagactttgcttagagacaagacaagtcaagttctggttccagaatcgtcgcactcagatgaagactcaattagagaggcatgagaacgcgttattgagacaagagaacgataagttaagagctgagaacatgtctattcgtgaagcaatgaggaatccaatctgcaccaattgtggtggacctgccatgcttggtgatgtctctcttgaagaacatcatctccgtatcgaaaacgctcgtttaaaagacgagcttgatcgtgtctgtaacctcaccggtaagttccttggccaccaccataatcaccactacaactcctccttagaactcgctgtcggcaccaacaacaacggtggacatttcgctttccctcctgatttcggcggtggtggtggttgcttacctccgcagcagcagcagtcgacggtgattaatgggattgatcagaagtcagttttgctggagctggctttaactgctatggatgagttagtgaagcttgctcagagtgaagaaccgttatgggtcaaaagcttggacggtgagagagacgagcttaaccaagatgagtacatgagaacattttcatctactaaaccaaccggtttagctactgaagcttctagaacctctggtatggtcatcatcaatagcttagctctcgtcgagactttaatggactccaatcggtggacggagatgttcccgtgtaacgtcgcaagagctacaaccaccgacgttatatccggtgggatggctggaacaataaatggtgcacttcaactgatgaatgcagagctacaagttttgtctccactggttccggttcgtaatgttaatttcctccggttctgcaaacagcacgcggagggtgtgtgggcggtggtggatgtatcaattgatcctgtcagggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatttcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcagggtgtctctctgctccgctccaatgcaatgaacgcgaatcagagtagtatgctaattcttcaggagacatgcattgacgcatctggagcgcttgtagtatacgcgcctgtcgacattcccgccatgcatgtggtgatgaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcgtgccgctttacaatgcgaaagctga

SEQ ID NO: 330 - protein, 802 aa, Arabidopsis thaliana
  G386,HB domain coordinates 133-193
MNFGSLFDNTPGGGSTGARLLSGLSYGNHTAATNVLPGGAMAQAAAAASLFSPPLTKSVYASSGLSLALEQPERGTNRGEASMRNNNNVGGGGDTFDGSVNRRSREEEHESRSGSDNVEGISGEDQDAADKPPRKKRYHRHTPQQIQELESMFKECPHPDEKQRLELSKRLCLETRQVKFWFQNRRTQMKTQLERHENALLRQENDKLRAENMSIREAMRNPICTNCGGPAMLGDVSLEEHHLRIENARLKDELDRVCNLTGKFLGHHHNHHYNSSLELAVGTNNNGGHFAFPPDFGGGGGCLPPQQQQSTVINGIDQKSVLLELALTAMDELVKLAQSEEPLWVKSLDGERDELNQDEYMRTFSSTKPTGLATEASRTSGMVIINSLALVETLMDSNRWTEMFPCNVARATTTDVISGGMAGTINGALQLMNAELQVLSPLVPVRNVNFLRFCKQHAEGVWAVVDVSIDPVRENSGGAPVIRRLPSGCVVQDVSNGYSKVTWVEHAEYDENQIHQLYRPLLRSGLGFGSQRWLATLQRQCECLAILISSSVTSHDNTSITPGGRKSMLKLAQRMTFNFCSGISAPSVHNWSKLTVGNVDPDVRVMTRKSVDDPGEPPGIVLSAATSVWLPAAPQRLYDFLRNERMRCEWDILSNGGPMQEMAHITKGQDQGVSLLRSNAMNANQSSMLILQETCIDASGALVVYAPVDIPAMHVVMNGGDSSYVALLPSGFAVLPDGGIDGGGSGDGDQRPVGGGSLLTVAFQILVNNLPTAKLTVESVETVNNLISCTVQKIRAALQCES

SEQ ID NO: 331 - DNA, 2238 bp, Arabidopsis thaliana
  G388,family:HB
atggccgtcgacatgtcttccaaacaacccaccaaagactttttctcctctccagccctctctctatctctcgctgggatattccggaatgcatcctccggcagcaccaaccctgaggaggatttcctgggcagaagagtagttgacgatgaggatcgcactgtggagatgagcagcgagaactcaggacccacgagatccagatcagaggaggatttggagggtgaggatcacgacgatgaggaggaggaagaggaggacggcgcagctggaaacaagggcactaataagagaaagaggaagaagtatcatcgtcacaccaccgatcagatcagacacatggaagcgctattcaaagagacaccacatccggacgagaagcaaagacagcagctgagcaagcaactagggctggcccctcgccaggtcaagttctggttccaaaaccgccgcacacagatcaaggctattcaagaacggcacgagaactccctgctcaaggcggaactagagaagctgcgagaggaaaacaaagccatgagggagtctttttccaaggctaattcctcctgccccaactgcggaggaggccccgatgatctccacctcgaaaactccaaactgaaagccgagctcgataagcttcgtgcagctcttggacgcactccctatcccctgcaggcttcatgctccgacgatcaagaacaccgtctcggctctctcgatttctacacgggcgtctttgccctcgagaagtcccgtattgccgagatttctaaccgagccacccttgaactccagaagatggccacctcaggcgaacctatgtggctccgcagcgttgagactggccgtgagattctcaactacgatgagtacctcaaggagtttccccaagcgcaagcctcttcgtttcctggaaggaaaaccatcgaagcatctagagatgcggggattgtgtttatggacgcacataaacttgcccagagtttcatggacgtgggacaatggaaagagacatttgcatgcttgatctcaaaggctgcaacggtcgatgttatccggcaaggcgaagggccttcacggatcgacggggctattcagctgatgttcggagagatgcagctgctcactccggtcgtccccacaagagaagtgtacttcgtgagaagctgccggcagctgagccctgagaaatgggcaatagtggacgtctcggtctccgtggaggacagcaacacggagaaggaggcttctcttctgaaatgtcgaaaactcccctccggttgcatcatcgaggacacctccaacggtcactccaaggtcacctgggtggagcacctcgacgtgtctgcatccacagttcagcctctcttccgctccttagtcaacaccggtttggcctttggggctcgacactgggtcgccacccttcagctccattgcgaacgccttgtcttcttcatggctaccaacgtccccaccaaagactctctcggagttacaactcttgccgggagaaagagtgtgctgaagatggctcagagaatgacacaaagcttctaccgcgccattgctgcatcaagctaccatcaatggaccaaaatcaccaccaaaactggacaagacatgcgggtttcttccaggaagaaccttcatgatcctggcgagcccacgggagtcattgtctgcgcttcttcttcgctgtggttacctgtttctccagctcttctcttcgatttctttagagatgaagctcgtcggcatgagtgggatgctttgtcaaacggagctcatgttcagtctattgcaaacttatccaagggacaagacagaggcaactcagtggcaatccagacagtgaaatcgagagaaaagagcatatgggtgctgcaagacagcagcactaactcgtatgagtcggtggtggtatacgctcccgtagatataaacacgacacagctggtgctcgcgggacatgatccaagcaacatccaaatcctcccctctggattctcaatcatacctgatggagtagagtcacggccactggtaataacgtctacacaagacgacagaaacagccaaggagggtcgctcctgacactcgccctccaaaccctcatcaacccttctcctgcagcaaagctgaatatggagtctgtggaatccgtgacaaacctcgtctcagtcacactacacaacattaagagaagtctacaaatcgaagattgctga

SEQ ID NO: 332 - protein, 745 aa, Arabidopsis thaliana
  G388,HB domain coordinates 98-158
MAVDMSSKQPTKDFFSSPALSLSLAGIFRNASSGSTNPEEDFLGRRVVDDEDRTVEMSSENSGPTRSRSEEDLEGEDHDDEEEEEEDGAAGNKGTNKRKRKKYHRHTTDQIRHMEALFKETPHPDEKQRQQLSKQLGLAPRQVKFWFQNRRTQIKAIQERHENSLLKAELEKLREENKAMRESFSKANSSCPNCGGGPDDLHLENSKLKAELDKLRAALGRTPYPLQASCSDDQEHRLGSLDFYTGVFALEKSRIAEISNRATLELQKMATSGEPMWLRSVETGREILNYDEYLKEFPQAQASSFPGRKTIEASRDAGIVFMDAHKLAQSFMDVGQWKETFACLISKAATVDVIRQGEGPSRIDGAIQLMFGEMQLLTPVVPTREVYFVRSCRQLSPEKWAIVDVSVSVEDSNTEKEASLLKCRKLPSGCIIEDTSNGHSKVTWVEHLDVSASTVQPLFRSLVNTGLAFGARHWVATLQLHCERLVFFMATNVPTKDSLGVTTLAGRKSVLKMAQRMTQSFYRAIAASSYHQWTKITTKTGQDMRVSSRKNLHDPGEPTGVIVCASSSLWLPVSPALLFDFFRDEARRHEWDALSNGAHVQSIANLSKGQDRGNSVAIQTVKSREKSIWVLQDSSTNSYESVVVYAPVDINTTQLVLAGHDPSNIQILPSGFSIIPDGVESRPLVITSTQDDRNSQGGSLLTLALQTLINPSPAAKLNMESVESVTNLVSVTLHNIKRSLQIEDC

SEQ ID NO: 333 - DNA, 2526 bp, Arabidopsis thaliana
  G390,family:HB
atgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgcttctgggacgaccacagacaacagctgtgagtctgtggtcgtgagtggtcagcaacgtcagcagcaaaacccaacacatcagcatcctcagcgtgatgttaacaacccagctaatcttctctcgattgcggaggagaccttggcggagttcctttgcaaggctacaggaactgctgtcgactgggtccagatgattgggatgaagcctggtccggattctattggtatcgtagctgtttcacgcaactgcagtggaatagcagcacgtgcctgtggcctcgtgagtttagaacccatgaaggtcgctgaaatcctcaaagatcgtccatcttggttccgtgactgtcgatgtgtcgagactctgaatgttatacccactggaaatggtggtactatcgagcttgtcaacactcagatttatgctcctacaacattagcagcagctcgtgacttttggacgctgagatatagtacaagtctagaagatggaagctatgtggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtctcaagtgttcctgaagtcctcaggcctctttatgagtcttccaaaatccttgctcaaaaaatgactgtcgctgctctgagacatgtgcgccaaattgctcaagagactagtggagaagtccagtatagtggtggacgccagcctgcagttttaaggactttcagccagagactctgccggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagagtttctcgaagtggttagacttggaggtcatgcttactcacctgaagacatgggcttatcccgggatatgtatttactgcagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccgaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacagtattcatacaggtgcagatctgtttggagctgattctcagtcctgtggaggagacacattgcttaagcaactctgggaccatagtgatgccatattgtgctgctccctgaaaactaatgcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttga

SEQ ID NO: 334 - protein, 841 aa, Arabidopsis thaliana
  G390,HB domain coordinates 18-81
MMAHHSMDDRDSPDKGFDSGKYVRYTPEQVEALERVYAECPKPSSLRRQQLIRECPILCNIEPRQIKVWFQNRRCREKQRKESARLQTVNRKLSAMNKLLMEENDRLQKQVSNLVYENGFMKHRIHTASGTTTDNSCESVVVSGQQRQQQNPTHQHPQRDVNNPANLLSIAEETLAEFLCKATGTAVDWVQMIGMKPGPDSIGIVAVSRNCSGIAARACGLVSLEPMKVAEILKDRPSWFRDCRCVETLNVIPTGNGGTIELVNTQIYAPTTLAAARDFWTLRYSTSLEDGSYVVCERSLTSATGGPNGPLSSSFVRAKMLSSGFLIRPCDGGGSIIHIVDHVDLDVSSVPEVLRPLYESSKILAQKMTVAALRHVRQIAQETSGEVQYSGGRQPAVLRTFSQRLCRGFNDAVNGFVDDGWSPMSSDGGEDITIMINSSSAKFAGSQYGSSFLPSFGSGVLCAKASMLLQNVPPLVLIRFLREHRAEWADYGVDAYSAASLRATPYAVPCVRTGGFPSNQVILPLAQTLEHEEFLEVVRLGGHAYSPEDMGLSRDMYLLQLCSGVDENVVGGCAQLVFAPIDESFADDAPLLPSGFRVIPLDQKTNPNDHQSASRTRDLASSLDGSTKTDSETNSRLVLTIAFQFTFDNHSRDNVATMARQYVRNVVGSIQRVALAITPRPGSMQLPTSPEALTLVRWITRSYSIHTGADLFGADSQSCGGDTLLKQLWDHSDAILCCSLKTNASPVFTFANQAGLDMLETTLVALQDIMLDKTLDDSGRRALCSEFAKIMQQGYANLPAGICVSSMGRPVSYEQATVWKVVDDNESNHCLAFTLVSWSFV

SEQ ID NO: 335 - DNA, 2559 bp, Arabidopsis thaliana
  G391,family:HB
atgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttga

SEQ ID NO: 336 - protein, 852 aa, Arabidopsis thaliana
  G391,HB domain coordinates 25-85
MMMVHSMSRDMMNRESPDKGLDSGKYVRYTPEQVEALERVYTECPKPSSLRRQQLIRECPILSNIEPKQIKVWFQNRRCREKQRKEAARLQTVNRKLNAMNKLLMEENDRLQKQVSNLVYENGHMKHQLHTASGTTTDNSCESVVVSGQQHQQQNPNPQHQQRDANNPAGLLSIAEEALAEFLSKATGTAVDWVQMIGMKPGPDSIGIVAISRNCSGIAARACGLVSLEPMKVAEILKDRPSWLRDCRSVDTLSVIPAGNGGTIELIYTQMYAPTTLAAARDFWTLRYSTCLEDGSYVVCERSLTSATGGPTGPPSSNFVRAEMKPSGFLIRPCDGGGSILHIVDHVDLDAWSVPEVMRPLYESSKILAQKMTVAALRHVRQIAQETSGEVQYGGGRQPAVLRTFSQRLCRGFNDAVNGFVDDGWSPMGSDGAEDVTVMINLSPGKFGGSQYGNSFLPSFGSGVLCAKASMLLQNVPPAVLVRFLREHRSEWADYGVDAYAAASLRASPFAVPCARAGGFPSNQVILPLAQTVEHEESLEVVRLEGHAYSPEDMGLARDMYLLQLCSGVDENVVGGCAQLVFAPIDESFADDAPLLPSGFRIIPLEQKSTPNGASANRTLDLASALEGSTRQAGEADPNGCNFRSVLTIAFQFTFDNHSRDSVASMARQYVRSIVGSIQRVALAIAPRPGSNISPISVPTSPEALTLVRWISRSYSLHTGADLFGSDSQTSGDTLLHQLWNHSDAILCCSLKTNASPVFTFANQTGLDMLETTLVALQDIMLDKTLDEPGRKALCSEFPKIMQQGYAHLPAGVCASSMGRMVSYEQATVWKVLEDDESNHCLAFMFVNWSFV

SEQ ID NO: 337 - DNA, 1249 bp, Arabidopsis thaliana
  G394,family:HB
gaaattcttaacaaacaattttcttcataatattaattctcaagatcttaaagattatattaatacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccaagcaaaaacaagctcttgcgagacagctgaatctaaggcctagacaagttgaagtgtggttccaaaacaggagagctagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagttacttattagttatttaattctttttgttggttttttttttgtttcttaaatcaaattaggaattagttagaagataaatcccagggaaaaaatattacgttgaaattggggggaaatggggtatagtctttatagataagactcttcaacgattccactttatttttcggtgggattgttggttgatgaagaaaaaaaaatagtttgtaattacaggtttaaatatgtagagaaaaaatgacgaatatgtattatcttgtttttttttccttcgaatatgtattacggtaatataaatttgcttgtaaaaataataaatatattatttg

SEQ ID NO: 338 - protein, 278 aa, Arabidopsis thaliana
  G394,HB domain coordinates 121-182
MGLDDSCNTGLVLGLGLSPTPNNYNHAIKKSSSTVDHRFIRLDPSLTLSLSGESYKIKTGAGAGDQICRQTSSHSGISSFSSGRVKREREISGGDGEEEAEETTERVVCSRVSDDHDDEEGVSARKKLRLTKQQSALLEDNFKLHSTLNPKQKQALARQLNLRPRQVEVWFQNRRARTKLKQTEVDCEFLKKCCETLTDENRRLQKELQDLKALKLSQPFYMHMPAATLTMCPSCERLGGGGVGGDTTAVDEETAKGAFSIVTKPRFYNPFTNPSAAC

SEQ ID NO: 339 - DNA, 1302 bp, Arabidopsis thaliana
  G409,family:HB
tgtctctctctctggctctctttctcttaacgtgatcataacgtgattcgaaaattggatatagataggtttcttgttggatcttgatccctctggaaaaggaggggagaatagcagttcatgatgggattttgtatctgcccgttggagtcacctgcgagattactatggagtacaagcttcttccgccataagatcatgatcttctaatccttcctacttcttcccatctttttaatcatcttctcgctatctctgcttcctctttctctctgtttcctctttctcagaactcagaagtagttgttgttttatttctgttgatcaaaaatggaatccaattcgtttttcttcgatccatctgcttcacacggcaacagcatgttcttccttgggaatctcaatcccgtcgtccaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttgttgtttccatgttgacgataattgttgactcgtggaataattccgctgttcaacggtatttttatcagttgcattatatgcttttatgaaaaaaaaaa

SEQ ID NO: 340 - protein, 272 aa, Arabidopsis thaliana
  G409,HB domain coordinates 64-124
MESNSFFFDPSASHGNSMFFLGNLNPVVQGGGARSMMNMEETSKRRPFFSSPEDLYDDDFYDDQLPEKKRRLTTEQVHLLEKSFETENKLEPERKTQLAKKLGLQPRQVAVWFQNRRARWKTKQLERDYDLLKSTYDQLLSNYDSIVMDNDKLRSEVTSLTEKLQGKQETANEPPGQVPEPNQLDPVYINAAAIKTEDRLSSGSVGSAVLDDDAPQLLDSCDSYFPSIVPIQDNSNASDHDNDRSCFADVFVPTTSPSHDHHGESLAFWGWP

SEQ ID NO: 341 - DNA, 2388 bp, Arabidopsis thaliana
  G416,family:HB
atggaggagagtgaaacaaaggggagaatcagtcaagaaactgataaggcttgtgtttcagttgagagaattgggtctactttactctcatcatttgtgaagaaaggtaaagaagtatcaaataagagaaattctaagcagaataagcgaaaagcggaagaagaactctgttcgaaatcaagaaccaagaagtactctcggggatgggtccgttgtgaggaaatggaggaggagaaggttaagaaaacaagaaagaggaaaagtaagagacagcaaaaggataataaggttgaggttgatgattctttaaggttgcaaaggaggacaaggtatttgctcattaagatgaagatgcagcagaatcttatcgatgcatacgcaactgaaggttggaaaggtcagagccgggaaaagataagaccagacaaggagcttgagagagcccggaaagagatcttaaactgcaagcttggactacgcgacgccattcgccaactggatctgcttagttctgtgggaagcatggaagagaaagtgatagcttcagatggatctattcatcatgatcatatattttgtgcagaatgcaattctcgagaagcttttccagacaatgatataatactttgtgatggaacgtgtaatcgagcatttcaccagaaatgccttgaccctcctttggaaacagaaagcatacctcccggagatcagggctggttttgcaaattttgtgattgcaaaattgaaattatcgacacaatgaatgcacaaattggaactcatttccctgtggacagcaactggcaggatatcttcaatgaagaagctagtcttcctattggatctgaagctacagttaacaatgaagcagattggccttcggatgactccaaggatgatgattatgaccctgaaatgagggaaaacggtggaggaaacagcagcaacgttagtggtgatggtggtggtgataacgatgaagaaagcatttcaactagcttgagcttatcatctgatggtgttgccctttcaacgggatcatgggaaggccatagactcagcaatatggtggagcagtgcgaaacaagtaatgaagaaactgtatgtgggccaagacagcgaaggactgttgactatacacagttgtactatgaaatgtttggaaaggatgcagttttgcaagagcaaggtagtgaagatgaagactggggtccgaatgacagaaggaagagaaaaagggaatctgatgcaggaagcacacttgtaactatgtgtgaaagcagtaagaaagatcaagatgttgtagaaacgctagaacagagtgagagagattctgtctctgtggaaaataaaggaggtcgaaggcggatgttcagactcccaagaaatgcagttgagctacgtcaagtatttgcagagactgagcttccctcaaaagctgtgagggatcgtcttgcaaaagagctgagtcttgatccagagaaggtcaataaatggtttaaaaatactcggtatatggcactgcggaataggaagactgagagcgtgaaacaacctggggattctaagacagtctctggaggagattctggaccagaagcagtcatggagaacaacactgaaacaaatgaagttcaagatactttggatgacactgttccacccggatttgacgctacaaatcaaaacatactctccccatgtaataacaaccaggaggaatttcaacaggaaaatgtctcttttccttcacccacagatgaaagtcaacagtatctggaacaaaacgattcttctttcgttctagtgccacatgaaaagcaaagcagcgaaattagcttaaagacggctgtagaggagaatgagacagaaagcaagatgatgaaagagccacatgaagagctaagcagtgaaatgagcctaaagacggctgctgaggagaaggagacagagagcaagatgatagaagagccacatgaagagctaagcagagaaatgagcttaaagacggctgtagaggagaaggagacagagagcaagatgatggaagagccacatgatgagctaaacagcgaaatgagcttaagtacagcggtagaggagaaggagacagggagcaagatgacggaagagtcacatgaagagctaagcaacgaaatgagcttagaagagaaggagacggggagaaagatgacggaagaggaagaattggaagcagtaatggagatgctttgtagaacagaaaacaagttactggacgtgacgcagaggcttgatagatttaaaacaccaaaaggccgaaaaaagttaggcaattcttcttctcctttacttgaagaagactcagtagtgtatgttccaatagcagagatcaaggagaaaaggtaa

SEQ ID NO: 342 - protein, 795 aa, Arabidopsis thaliana
  G416,HB domain coordinates 451-511
MEESETKGRISQETDKACVSVERIGSTLLSSFVKKGKEVSNKRNSKQNKRKAEEELCSKSRTKKYSRGWVRCEEMEEEKVKKTRKRKSKRQQKDNKVEVDDSLRLQRRTRYLLIKMKMQQNLIDAYATEGWKGQSREKIRPDKELERARKEILNCKLGLRDAIRQLDLLSSVGSMEEKVIASDGSIHHDHIFCAECNSREAFPDNDIILCDGTCNRAFHQKCLDPPLETESIPPGDQGWFCKFCDCKIEIIDTMNAQIGTHFPVDSNWQDIFNEEASLPIGSEATVNNEADWPSDDSKDDDYDPEMRENGGGNSSNVSGDGGGDNDEESISTSLSLSSDGVALSTGSWEGHRLSNMVEQCETSNEETVCGPRQRRTVDYTQLYYEMFGKDAVLQEQGSEDEDWGPNDRRKRKRESDAGSTLVTMCESSKKDQDVVETLEQSERDSVSVENKGGRRRMFRLPRNAVELRQVFAETELPSKAVRDRLAKELSLDPEKVNKWFKNTRYMALRNRKTESVKQPGDSKTVSGGDSGPEAVMENNTETNEVQDTLDDTVPPGFDATNQNILSPCNNNQEEFQQENVSFPSPTDESQQYLEQNDSSFVLVPHEKQSSEISLKTAVEENETESKMMKEPHEELSSEMSLKTAAEEKETESKMIEEPHEELSREMSLKTAVEEKETESKMMEEPHDELNSEMSLSTAVEEKETGSKMTEESHEELSNEMSLEEKETGRKMTEEEELEAVMEMLCRTENKLLDVTQRLDRFKTPKGRKKLGNSSSPLLEEDSVVYVPIAEIKEKR

SEQ ID NO: 343 - DNA, 2545 bp, Arabidopsis thaliana
  G418,family:HB
acatatgttttaaattctttgtctgaatcttacaggatccgagagagagagctctggaacgatattaacatatatcatgaagaaaaagattgaagtattgatatgggaataactaaaacttctcctaatactacaattctcttgaagacttttcacaataattctatgtcccaagattatcatcatcatcatcatcataatcaacaccaaggaggtatcttcaacttctctaatggattcgaccgatcagattctcccaatttaacaactcagcagaagcaagagcatcaaagggtagagatggacgaggaatcttcagtcgccggaggtaggattccggtctacgaatcagccggtatgttatccgaaatgtttaatttccccggaagcagcggtggaggaagagatctcgacctcggccaatctttccggtcaaataggcagttgcttgaggagcaacatcagaatattccggctatgaatgctacggattcagccaccgccaccgcagccgccatgcagttattcttgatgaatccaccgccaccgcaacaaccaccgtctccgtcatccacaacttccccaaggagccaccacaattcttcaactcttcacatgttacttccaagtccatccaccaacacaactcaccatcagaactacactaatcatatgtctatgcatcagcttccacatcagcatcaccaacagatatcgacgtggcagtcttctcccgatcatcatcatcatcatcacaacagccaaacggagattgggaccgtccacgtggaaaacagcggaggacacggaggacaaggcttgtccttatctctctcatcgtctttagaggctgcagcaaaagcggaagagtatagaaacatttactacggagccaattcttctaacgcatcacctcatcatcaatacaatcaattcaagactcttcttgctaattcttctcaacatcaccatcaagtattaaaccaattccgatcatctccggctgcttcttcctcttccatggcagcggtcaatatcttaagaaactcgaggtacacaacggccgcgcaagagttgttggaagagttttgtagtgttggaagaggatttttgaagaagaacaaacttgggaacagctcaaaccctaatacttgcggtggtgatggtggtggcagctctccttcgtcggccggagcaaacaaggagcatcctcctttatcggcgtctgatcggattgagcatcaaagaaggaaagtgaaactactcaccatgcttgaagaggtggaccgacggtacaaccattactgcgagcaaatgcagatggttgtgaactctttcgacatagtaatgggccacggtgcggcattaccgtacaccgcattggctcaaaaagctatgtcaagacattttagatgccttaaagatgcagttgcggctcagcttaagcagagttgcgaacttcttggggacaaagatgcagcgggaatctcttcttccgggttaacaaaaggtgaaactccgcgtttgcgtttgctagagcaaagtttgcgtcagcaacgtgcgtttcatcaaatgggtatgatggaacaagaagcttggcggccacaacgcggtttgcctgaacgctccgtcaatatacttagagcttggctcttcgaacatttccttcacccgtatccaagtgatgcagataaacacctattggctcgacagactggtttatccagaaatcaggtatcaaattggttcataaatgctagggttcgtttatggaaaccaatggtggaagaaatgtaccaacaagaatcaaaagaaagagaaagagaagaggaattagaagagaacgaagaagatcaagaaacaaaaaacagcaacgacgacaagagcacaaaatccaacaacaatgaaagcaacttcactgccgttcggaccacttcacaaactccaacgacaaccgcaccagacgcatcagacgcagacgcagcagtagcgacaggccaccgtctaagatccaacattaatgcttacgaaaacgacgcttcatcacttctactcccttcctcttattccaacgccgccgctcctgccgctgtttctgacgacttgaattctcgttacggtggctcagacgcgttttccgccgttgccacgtgtcaacaaagtgtaggtgggttcgatgatgctgacatggatggtgttaacgttataaggtttgggacaaaccctactggtgacgtgtctctcacgcttggtttacgccacgctggaaacatgcctgacaaagacgcttctttctgcgttagagagtttgggggtttttagtttgcttttgtcactccatttaattaattaattatagttttccattcttacttattttaattgaaaatctatttttgtctcttaaaagtccaaacaatacattagtctagccctcctctgcttttttttttctatctcgtgaagagaagaaaacgatacgtaaatcccttcgaaaactaatgtacgttgtacgacttattgttttcataaaaaaaaaaaaaaa

SEQ ID NO: 344 - protein, 739 aa, Arabidopsis thaliana
  G418,HB domain coordinates 500-560
MGITKTSPNTTILLKTFHNNSMSQDYHHHHHHNQHQGGIFNFSNGFDRSDSPNLTTQQKQEHQRVEMDEESSVAGGRIPVYESAGMLSEMFNFPGSSGGGRDLDLGQSFRSNRQLLEEQHQNIPAMNATDSATATAAAMQLFLMNPPPPQQPPSPSSTTSPRSHHNSSTLHMLLPSPSTNTTHHQNYTNHMSMHQLPHQHHQQISTWQSSPDHHHHHHNSQTEIGTVHVENSGGHGGQGLSLSLSSSLEAAAKAEEYRNIYYGANSSNASPHHQYNQFKTLLANSSQHHHQVLNQFRSSPAASSSSMAAVNILRNSRYTTAAQELLEEFCSVGRGFLKKNKLGNSSNPNTCGGDGGGSSPSSAGANKEHPPLSASDRIEHQRRKVKLLTMLEEVDRRYNHYCEQMQMVVNSFDIVMGHGAALPYTALAQKAMSRHFRCLKDAVAAQLKQSCELLGDKDAAGISSSGLTKGETPRLRLLEQSLRQQRAFHQMGMMEQEAWRPQRGLPERSVNILRAWLFEHFLHPYPSDADKHLLARQTGLSRNQVSNWFINARVRLWKPMVEEMYQQESKEREREEELEENEEDQETKNSNDDKSTKSNNNESNFTAVRTTSQTPTTTAPDASDADAAVATGHRLRSNINAYENDASSLLLPSSYSNAAAPAAVSDDLNSRYGGSDAFSAVATCQQSVGGFDDADMDGVNVIRFGTNPTGDVSLTLGLRHAGNMPDKDASFCVREFGGF

SEQ ID NO: 345 - DNA, 2405 bp, Arabidopsis thaliana
  G419,family:HB
aagccacacaatctcttttcttctctctctctctgttatatctcttctgtttaattcttttattcttcttcgtctatcttctcctataatctcttctctctccctcttcacctaaagaataagaagaaaaataattcacatctttatgcaaactactttcttgtagggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccatatccgagcgatgttgataagcatatattggcccgacaaactggtttatcaagaagtcaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttgagattaaaagattaggaccaaagttatcgatacatattttccaaaaccgattcggttatgtaacggtttagttagataaaaaccaaattagatatttatatataccgttgtctgattggattggaggattggtggacaaggagatattattaatgtatgagttagttggttcgtcaaaaaaaaaaaaaaaaaa

SEQ ID NO: 346 - protein, 610 aa, Arabidopsis thaliana
  G419,HB domain coordinates 392-452
MARDQFYGHNNHHHQEQQHQMINQIQGFDETNQNPTDHHHYNHQIFGSNSNMGMMIDFSKQQQIRMTSGSDHHHHHHQTSGGTDQNQLLEDSSSAMRLCNVNNDFPSEVNDERPPQRPSQGLSLSLSSSNPTSISLQSFELRPQQQQQGYSGNKSTQHQNLQHTQMMMMMMNSHHQNNNNNNHQHHNHHQFQIGSSKYLSPAQELLSEFCSLGVKESDEEVMMMKHKKKQKGKQQEEWDTSHHSNNDQHDQSATTSSKKHVPPLHSLEFMELQKRKAKLLSMLEELKRRYGHYREQMRVAAAAFEAAVGLGGAEIYTALASRAMSRHFRCLKDGLVGQIQATSQALGEREEDNRAVSIAARGETPRLRLLDQALRQQKSYRQMTLVDAHPWRPQRGLPERAVTTLRAWLFEHFLHPYPSDVDKHILARQTGLSRSQVSNWFINARVRLWKPMIEEMYCEETRSEQMEITNPMMIDTKPDPDQLIRVEPESLSSIVTNPTSKSGHNSTHGTMSLGSTFDFSLYGNQAVTYAGEGGPRGDVSLTLGLQRNDGNGGVSLALSPVTAQGGQLFYGRDHIEEGPVQYSASMLDDDQVQNLPYRNLMGAQLLHDIV

SEQ ID NO: 347 - DNA, 1501 bp, Arabidopsis thaliana
  G427,family:HB
tttccctctccgaaacagaaattcaaaaacaaattcaacacgaaaacgatggcgtttcataacaatcactttaatcatttcaccgaccaacaacaacatcagcctcctcctccgccgcaacagcagcagcaacaacattttcaagaatcagcaccccctaattggctcctccgctccgacaacaacttcctcaatctccacacagctgccacagccgccgctacaagctccgattctccttcttccgccgccgctaaccagtggctctcacgatcctcatccttcctccaacgaggcaacaccgcaaacaacaacaacaacgaaacatccggtgacgtcatcgaagacgttcccggcggagaggagtcaatgatcggagagaagaaggaggcggagaggtggcagaatgcgagacacaaggcggagatactgtctcatccactatacgagcaacttttgtcggcacacgtggcgtgcctgaggatcgcaacgccggtggatcagcttccgaggatagacgcacagcttgctcagtctcaaaacgtcgtggctaagtactcaactttagaagccgctcaaggactcctcgccggcgatgacaaggagcttgaccacttcatgacgcattatgtactattgctttgctctttcaaagaacaactgcaacagcatgttcgtgttcatgcaatggaagctgttatggcctgttgggagattgaacagtcgcttcaaagttttacaggagtatctcctggtgaaggcacaggagcaacaatgtctgaggatgaagatgagcaagtagagagtgatgctcatttgtttgatggaagcttagatgggttagggtttggtcctctagttcccactgagagcgagagatctttgatggaacgagtcagacaagaactcaaacatgaactcaagcagggttacaaggagaaaattgtggacataagagaggagatactgaggaagagaagagctggaaaattaccaggagacaccacctctgttctcaaatcatggtggcaatctcattctaagtggccttaccctactgaggaagataaggcgaggttggtgcaggagacgggtttgcagctcaaacagataaacaattggttcatcaatcaaagaaagaggaattggcatagcaatccatcttcttctaccgtctcaaagaataaacgccgaagcaatgcaggtgaaaacagcggaagagaccgttgagatcaagcttgcatgtagagatccaaaagctttatagaaaggtggaggcatgaagacaaagaattcttacacaacaaacgtaggacgtaattttgtgccagtacatggtatggctttcatatttggtaatgattagggccacacaaaattaaaccccaaagcatgatttgtaatatgaggttttagatggactttatgataggatcgtcagtcttcactgccatctccattctccaccatcaatccatcattatatcttgtgaaaaaaaaa

SEQ ID NO: 348 - protein, 393 aa, Arabidopsis thaliana
  G427,HB domain coordinates 307-370
MAFHNNHFNHFTDQQQHQPPPPPQQQQQQHFQESAPPNWLLRSDNNFLNLHTAATAAATSSDSPSSAAANQWLSRSSSFLQRGNTANNNNNETSGDVIEDVPGGEESMIGEKKEAERWQNARHKAEILSHPLYEQLLSAHVACLRIATPVDQLPRIDAQLAQSQNVVAKYSTLEAAQGLLAGDDKELDHFMTHYVLLLCSFKEQLQQHVRVHAMEAVMACWEIEQSLQSFTGVSPGEGTGATMSEDEDEQVESDAHLFDGSLDGLGFGPLVPTESERSLMERVRQELKHELKQGYKEKIVDIREEILRKRRAGKLPGDTTSVLKSWWQSHSKWPYPTEEDKARLVQETGLQLKQINNWFINQRKRNWHSNPSSSTVSKNKRRSNAGENSGRDR

SEQ ID NO: 349 - DNA, 1379 bp, Arabidopsis thaliana
  G428,family:HB
ttacttttgtgtttcttcatattcttcagaagcaagcacaaggctagggatcgaagaagcggcgatcactgatcgtatctcactacgatcacattaatggatagaatgtgtggtttccgctcgacggaagactattcggagaaagcgacgttgatgatgccgtccgattatcagtctttgatttgttcaaccaccggagacaatcaaagactgtttggatccgacgaactcgctaccgctttgtcctcggagttgcttccgcgtattcgaaaagctgaggataatttctctcttagtgtcatcaaatccaaaatcgcttctcatcctttgtatcctcgcttactccaaacctacatcgattgccaaaaggtgggagcgcctatggaaatagcgtgtatattggaagagattcagcgagagaaccatgtgtacaagagagatgttgctccattatcttgctttggagctgatcctgagcttgatgaattcatggaaacctactgtgatatattggttaaatacaaaaccgatcttgcgaggccgttcgacgaggctacaactttcataaacaagattgaaatgcagcttcagaacttgtgcactggtccagcgtctgctacagctctttcagatgatggtgcggtttcatctgacgaggaactgagagaagatgatgacatagcagcggatgacagccaacaaagaagcaatgaccgcgatctgaaggaccagctactacgcaaatttggtagccatatcagttcattgaaactcgagttctctaaaaagaagaagaaagggaagctaccaagagaagcaagacaagcgttgctcgattggtggaatgttcataataaatggccttaccctactgaaggcgacaaaatagctctggctgaagaaacaggtttggatcaaaaacaaatcaacaattggtttataaaccaaaggaaacgccattggaagccttcggagaacatgccgtttgatatgatggacgattctaatgaaacattctttaccgaggaatgaaaagagagacatgggattgtgcattgtataatttttacactgttttcccaagaaaagaaaacagtaaaaagcttttggtaaatgggacatcatcgcgaatgaatggaaccagttagccaaaacggtcaagggcgtggcgtaacgagacattgtattggaaatagtggcaatattatgtcactaatcttccaatggtccaaaatgatagatttcttatttgtattgaaccttacttagatagctgatgtgtcaactaaataatttattttcatccttatactacttgtatcaatgtctctaattgatcaattgttgcttgctattcaaaaaaaaaaaaaaaaaaaaaa

SEQ ID NO: 350 - protein, 311 aa, Arabidopsis thaliana
  G428,HB domain coordinates 229-292
MDRMCGFRSTEDYSEKATLMMPSDYQSLICSTTGDNQRLFGSDELATALSSELLPRIRKAEDNFSLSVIKSKIASHPLYPRLLQTYIDCQKVGAPMEIACILEEIQRENHVYKRDVAPLSCFGADPELDEFMETYCDILVKYKTDLARPFDEATTFINKIEMQLQNLCTGPASATALSDDGAVSSDEELREDDDIAADDSQQRSNDRDLKDQLLRKFGSHISSLKLEFSKKKKKGKLPREARQALLDWWNVHNKWPYPTEGDKIALAEETGLDQKQINNWFINQRKRHWKPSENMPFDMMDDSNETFFTEE

SEQ ID NO: 351 - DNA, 1149 bp, Arabidopsis thaliana
  G431,family:HB
atggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctctttctcttcttcagcctctgtcaaggccaagatcatggctcatcctcactaccaccgcctcttggccgcttatgtcaattgtcagaaggttggagcaccaccggaggttgtggcgaggctggaggaggcatgctcgtctgccgcagccgcagccgcatctatggggccaacagggtgtcttggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttggacaatcctttcccaatggatcacatctcctccaccatgctttga

SEQ ID NO: 352 - protein, 382 aa, Arabidopsis thaliana
  G431,HB domain coordinates 286-335
MESGSNSTSCPMAFAGDNSDGPMCPMMMMMPPIMTSHQHHGHDHQHQQQEHDGYAYQSHHQQSSSLFLQSLAPPQGTKNKVASSSSPSSCAPAYSLMEIHHNEIVAGGINPCSSFSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLDNPFPMDHISSTML

SEQ ID NO: 353 - DNA, 2061 bp, Arabidopsis thaliana
  G434,family:HB
atgaatggacaaggtgatttggatgcggttggaaacattccaaaaccaggtgaagctgaaggcgatgagattgatatgattaatgatatgtctggtgttaatgatcaagatggtggaaggatgagaagaacccataggcgcactgcttatcaaactcaagaacttgaaaatttctacatggaaaatcctcatcccactgaagaacagaggtacgagcttggacaaaggcttaatatgggtgtcaatcaagtcaagaattggttccagaataaaagaaatctcgagaagatcaataatgaccaccttgagaatgtaactcttagagaagagcatgacagattgctagcaactcaggatcagcttagaagcgcaatgctacgtagtttatgcaacatttgtggtaaggcaactaattgtggagacactgaatatgaggtgcaaaaacttatggctgagaatgctaacttggagcgggagatagaccagttcaattccagatacctttctcatcccaaacaaaggatggtcagtacatccgaacaggcgccttcttcttcctctaatccaggaataaatgcaacaccagtacttgattttagtggtggaactaggacgtctgagaaggagacatcaatttttctgaatcttgccattacggctttgagagagttgattacattgggagaagtggactgtccattttggatgatagatccaatcgttagatccaaaggagtatcaaagatctatgagaagtatagaagttctttcaacaatgtcacaaaacctcccgggcaaattgtggaggcttcaagagctaaaggtttagttcccatgacttgcgtgactctggtcaagactcttatggacacaggcaaatgggtcaacgtgtttgcacctatagtccctgtggcatcaacccataaagtgctatctaccggttctggtggaaccaaaagtggctcactccaacagattcaagcagaatttcaagtaatttctccgctggtaccaaagagaaaagtaacgtttattagatactgcaaagagatcagacagggcttatgggtggtcgtcgacgttactcctactcaaaatccgactttgctgccctatggttgttctaagaggctaccctcaggccttatcatagacgacctgtccaatgggtactcccaggttacatggattgaacaagcggaatataatgagagtcacatccaccaactctaccagcctttgattggctatgggatcgggctaggtgcaaagagatggctcgcgacgctgcagagacactgcgaaagcctctcgaccctttcatctaccaacttgactgaaattagtccaggattgtctgcaaaaggtgcaactgaaatagtgaagctagcacagcgaatgactctcaactactacagaggtattacgagtccttcggtggacaagtggcagaaaattcaggtggagaatgtggcacaaaacatgagtttcatgatccgaaagaacgtgaatgagcctggtgagctaactgggattgtgctgagtgcatccacttctgtttggctcccagtgaaccagcatacactctttgctttcattagccacctgagtttcagacacgagtgggatatcttgaccaatgatactaccatggaagaaacaatccggattcaaaaagcaaaacgccatggaaacatcatctctcttctgaaaatcgttaataatggtatgctggttctgcaagagatttggaatgatgcatcaggtgcaatggtggtgtatgcaccagtggaaaccaattctattgagctggtcaagagaggtgaaaattcagattctgtgaagtttcttccttcgggattttcgatagtgccagatggagtaaatgggtcatatcatagaggcaatactggtggaggatgtctactgacatttggacttcagatcttggtgggcatcaatccaactgctgcactcattcaaggtactgtcaaaagtgtcgagacactcatggctcatactattgtcaagatcaaatccgcgttagatttacagacgtaa

SEQ ID NO: 354 - protein, 686 aa, Arabidopsis thaliana
  G434,HB domain coordinates 39-99
MNGQGDLDAVGNIPKPGEAEGDEIDMINDMSGVNDQDGGRMRRTHRRTAYQTQELENFYMENPHPTEEQRYELGQRLNMGVNQVKNWFQNKRNLEKINNDHLENVTLREEHDRLLATQDQLRSAMLRSLCNICGKATNCGDTEYEVQKLMAENANLEREIDQFNSRYLSHPKQRMVSTSEQAPSSSSNPGINATPVLDFSGGTRTSEKETSIFLNLAITALRELITLGEVDCPFWMIDPIVRSKGVSKIYEKYRSSFNNVTKPPGQIVEASRAKGLVPMTCVTLVKTLMDTGKWVNVFAPIVPVASTHKVLSTGSGGTKSGSLQQIQAEFQVISPLVPKRKVTFIRYCKEIRQGLWVVVDVTPTQNPTLLPYGCSKRLPSGLIIDDLSNGYSQVTWIEQAEYNESHIHQLYQPLIGYGIGLGAKRWLATLQRHCESLSTLSSTNLTEISPGLSAKGATEIVKLAQRMTLNYYRGITSPSVDKWQKIQVENVAQNMSFMIRKNVNEPGELTGIVLSASTSVWLPVNQHTLFAFISHLSFRHEWDILTNDTTMEETIRIQKAKRHGNIISLLKIVNNGMLVLQEIWNDASGAMVVYAPVETNSIELVKRGENSDSVKFLPSGFSIVPDGVNGSYHRGNTGGGCLLTFGLQILVGINPTAALIQGTVKSVETLMAHTIVKIKSALDLQT

SEQ ID NO: 355 - DNA, 627 bp, Arabidopsis thaliana
  G435,family:HB
aacaaaagaaaaaacaaaaaagaagagaaaaatggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtctgattctgtttcgacgcagacaagattccaatatatatagtcttgtctctgttttgtttcgtttgatctgtttctctttgtctgaatagatttaaaatttgtaattaaagtcattcagacattcacta

SEQ ID NO: 356 - protein, 156 aa, Arabidopsis thaliana
  G435,HB domain coordinates 4-67
MENSQSQGKNKKKRLTQDQVRQLEKCFTMNKKLEPDLKLQLSNQLGLPQRQVAVWFQNKRARFKTQSLEVQHCTLQSKHEAALSDKAKLEHQVQFLQDELKRARNQLALFTNQDSPVDNSNLGSCDEDHDDQVVVFDELYACFVSNGHGSSSTSWV

SEQ ID NO: 357 - DNA, 2821 bp, Arabidopsis thaliana
  G438,family:HB
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgttttttaaaattattttgatcaaa

SEQ ID NO: 358 - protein, 842 aa, Arabidopsis thaliana
  G438,HB domain coordinates 22-85
MEMAVANHRERSSDSMNRHLDSSGKYVRYTAEQVEALERVYAECPKPSSLRRQQLIRECSILANIEPKQIKVWFQNRRCRDKQRKEASRLQSVNRKLSAMNKLLMEENDRLQKQVSQLVCENGYMKQQLTTVVNDPSCESVVTTPQHSLRDANSPAGLLSIAEETLAEFLSKATGTAVDWVQMPGMKPGPDSVGIFAISQRCNGVAARACGLVSLEPMKIAEILKDRPSWFRDCRSLEVFTMFPAGNGGTIELVYMQTYAPTTLAPARDFWTLRYTTSLDNGSFVVCERSLSGSGAGPNAASASQFVRAEMLSSGYLIRPCDGGGSIIHIVDHLNLEAWSVPDVLRPLYESSKVVAQKMTISALRYIRQLAQESNGEVVYGLGRQPAVLRTFSQRLSRGFNDAVNGFGDDGWSTMHCDGAEDIIVAINSTKHLNNISNSLSFLGGVLCAKASMLLQNVPPAVLIRFLREHRSEWADFNVDAYSAATLKAGSFAYPGMRPTRFTGSQIIMPLGHTIEHEEMLEVVRLEGHSLAQEDAFMSRDVHLLQICTGIDENAVGACSELIFAPINEMFPDDAPLVPSGFRVIPVDAKTGDVQDLLTANHRTLDLTSSLEVGPSPENASGNSFSSSSSRCILTIAFQFPFENNLQENVAGMACQYVRSVISSVQRVAMAISPSGISPSLGSKLSPGSPEAVTLAQWISQSYSHHLGSELLTIDSLGSDDSVLKLLWDHQDAILCCSLKPQPVFMFANQAGLDMLETTLVALQDITLEKIFDESGRKAICSDFAKLMQQGFACLPSGICVSTMGRHVSYEQAVAWKVFAASEENNNNLHCLAFSFVNWSFV

SEQ ID NO: 359 - DNA, 1507 bp, Arabidopsis thaliana
  G440,family:AP2
aaaaaatcactgtttcataacacgtttttctctctcacccaccaaaaaaaaatcttttgttcttgttaccaaaaaatctcgtgataaatctcttcaaactttgttttattttcttcttgattctctcgaaatctctctcaacaaacccagaaactttccttgattcgcaagcttttcttccttttatattcttcattttgatgcgaatatagagagagtccataaaagaaacagtaatggacgaatatattgatttccgaccattgaagtacacagagcacaagacttcaatgactaaatacaccaaaaagtcatcggaaaaactttccggtggtaagtcattgaaaaaggttagtatttgttatactgatcctgacgcaacagattcatcaagtgacgaagacgaagaagatttcttgtttcctcgccggagagtcaaaagattcgttaacgagatcactgttgagcctagctgtaacaacgtcgtcaccggagtttcgatgaaagatagaaagagactctcttcttcctccgatgaaactcaatctccggcgtcgagtcgtcaacgtcctaataacaaagtttcagtctccggtcagataaagaagttccgtggtgttagacaacggccatgggggaaatgggcggcggagattagagatccggagcaacgtcggaggatttggctcgggacttttgagacggcggaggaagctgccgtggtttatgataacgccgctataagactccgtggaccggacgctttaactaatttctccataccgcctcaagaagaggaagaagaagaagaaccggaaccggttattgaggagaaaccggttattatgacgacgccaacaccaacaacatcgagttctgaatcaactgaagaagatttacaacatctctcatctcctacttcggttctcaatcaccggtcagaagagattcaacaagtacaacaaccgtttaaatcagctaaacccgaaccgggggtttcaaatgcaccatggtggcataccgggtttaataccggtttaggtgaatcagacgattcatttcctttggatactccgtttcttgacaactatttcaatgaatcaccaccagagatgtcaatatttgaccaaccaatggatcaaattttctgtgaaaatgatgatatcttcaatgatatgttgttcttgggtggtgaaactatgaacattgaagatgagttaacaagttctagtatcaaagatatgggttcaacgtttagtgattttgatgattcattgatatcagatctattagttgcttaatatgatgatgagagtgaagaagaaaccatcaagcaaatatctatggtgtgactgaaaaattttggtgttacttttttttctttcataagttcatgagcttttttgtttcttttttttaataatttatttagttttgtcaggagcttgtaaaacagttttggagaaatagtggaaaaatagtttaattaaaaaaaaaaaaaaaaaaa

SEQ ID NO: 360 - protein, 354 aa, Arabidopsis thaliana
  G440,AP2 domain coordinates 122-184
MDEYIDFRPLKYTEHKTSMTKYTKKSSEKLSGGKSLKKVSICYTDPDATDSSSDEDEEDFLFPRRRVKRFVNEITVEPSCNNVVTGVSMKDRKRLSSSSDETQSPASSRQRPNNKVSVSGQIKKFRGVRQRPWGKWAAEIRDPEQRRRIWLGTFETAEEAAVVYDNAAIRLRGPDALTNFSIPPQEEEEEEEPEPVIEEKPVIMTTPTPTTSSSESTEEDLQHLSSPTSVLNHRSEEIQQVQQPFKSAKPEPGVSNAPWWHTGFNTGLGESDDSFPLDTPFLDNYFNESPPEMSIFDQPMDQIFCENDDIFNDMLFLGGETMNIEDELTSSSIKDMGSTFSDFDDSLISDLLVA

SEQ ID NO: 361 - DNA, 1080 bp, Arabidopsis thaliana
  G442,family:AP2
caccacgtgtcttgtagccgtacatttaattgtcgtaagcaccacgcgtgttctcttagacggtatctagacatgtgttcccaccttaatttctgaaggctctggtgaattctaggacaatctatgcagacaaaaatttatagtttattgtttggttttatgttcgaaatttaatagtgattgtactgcgctccgtaatattttctacagtttgtacgtgttgtgtttttccaatggaaaaggaagataacggatcgaaacagagctcctctgcttctgttgtatcctcgagaagacgaagaagagtggttgagccagtggaagcgacgttacagagatgggaggaagaaggattggcgagagctcgtagggttcaagccaaaggttcgaagaaaggttgtatgagaggaaaaggtggaccagagaatcctgtttgtcggtttagaggtgttcgacaaagggtttgggggaaatgggttgctgagatacgtgaaccagtgagtcaccgtggtgcaaactctagtcgtagtaaacggctttggcttggcacgtttgctactgcagctgaagctgctttggcttacgacagagctgctagtgtcatgtacggaccctatgccaggttaaatttcccggaagatttgggtgggggaaggaagaaggacgaggaggcggaaagttcgggaggctattggttggaaactaacaaagccggtaatggcgtgattgaaacggaaggtggaaaagactatgtagtctacaatgaagacgctattgagcttggccatgacaagactcagaatcctatgactgataatgaaatagtgaacccagcagtgaaatcagaggaaggttacagctatgatcgattcaaattggataacggattgttgtataatgaacctcaaagctccagttatcaccagggaggtggattcgattcatattttgagtatttcagattctagcttaggatttatgctgcatcaatatactatgactatgagactatgttttttacattgttagtttactccattttcatttatcttaaaaaaaaaaaaaaaaaaaaaaaaaaaa

SEQ ID NO: 362 - protein, 244 aa, Arabidopsis thaliana
  G442,AP2 domain coordinates 66-138
MEKEDNGSKQSSSASVVSSRRRRRVVEPVEATLQRWEEEGLARARRVQAKGSKKGCMRGKGGPENPVCRFRGVRQRVWGKWVAEIREPVSHRGANSSRSKRLWLGTFATAAEAALAYDRAASVMYGPYARLNFPEDLGGGRKKDEEAESSGGYWLETNKAGNGVIETEGGKDYVVYNEDAIELGHDKTQNPMTDNEIVNPAVKSEEGYSYDRFKLDNGLLYNEPQSSSYHQGGGFDSYFEYFRF

SEQ ID NO: 363 - DNA, 2779 bp, Arabidopsis thaliana
  G446,family:ARF
gcctagttagtgttgagtgtgggagagacaaaacagaacattgaaaaatctctctgtatgatggcttcattgtcttgtgttgaagacaagatgaaaacaagttgtttggttaatggtggaggaactataacaacaacaacatctcaatctaccttgcttgaagagatgaagctgttgaaagaccagtcaggtacaagaaagccggtaataaactcggagctatggcacgcttgtgcaggccctttggtgtgtctccctcaagttgggagcttagtgtattacttctcacaaggtcatagcgagcaggttgctgtttcaaccagaagatcagcaacaacacaagttcctaattatccgaaccttccatctcagttgatgtgtcaagtccataatgttactcttcatgctgacaaagacagtgacgaaatctatgctcagatgagtcttcaacctgttcactctgagagagatgtgttccctgtaccagactttggaatgctgagaggaagtaagcacccgactgagtttttctgcaaaacacttactgcaagtgacacaagcacacatggaggtttctcagtgccacgtagagctgcagagaagctatttccaccattggactactcagcacagccgccaacgcaagagcttgtagttcgagatcttcatgagaatacttggacatttcgccatatctaccgagggcaaccaaagagacatctcctaactacaggatggagtttgttcgttggatcgaagagattgagagctggggattctgttttgttcatcagggatgagaagtcacaacttatggtcggtgttaggcgtgccaatcgccaacaaacagcacttccttcatcagttctctcagcggatagtatgcacatcggtgttcttgctgctgctgctcacgcaaccgccaaccgtactccttttttgatattctataatccaagagcttgtccagcagagttcgtgatccctctagctaagtaccgtaaggcgatatgcgggtctcagctctcagttggtatgagatttggaatgatgtttgaaactgaagattccgggaaacgaaggtacatgggaactattgttggaatcagcgatttggatccgttgagatggcctggttctaagtggcgtaaccttcaggtagaatgggatgagcctggatgtaatgataaacctactcgggtcagtccatgggatatcgaaacacctgaaagtctcttcatttttccttctctgacctcaggactcaaacgtcagctccatccatcttactttgctggtgaaactgaatggggtagcttgataaaacggccacttatacgtgttcctgattccgcgaatgggattatgccatatgcatctttccctagtatggcttcggagcagcttatgaaaatgatgatgaggcctcacaacaaccaaaatgtaccatctttcatgtctgagatgcagcagaatattgtaatggggaatggaggtttgctaggagatatgaagatgcagcaacccctgatgatgaaccagaaatctgagatggtgcagccacaaaacaagctaacagtgaacccatctgcttctaatacgagtggccaagaacagaatctttcacagagtatgagtgctcctgctaaacctgagaactctacactctctggttgcagctctggtagagtccaacatggacttgagcagtcaatggaacaggcaagccaggttactacatccacagtgtgtaatgaggaaaaggttaatcagctacttcagaaaccgggtgcttcgtcgcctgtacaagctgatcaatgtcttgacattactcatcagatttaccaaccacagtctgatccaataaatggattctctttcctggaaactgatgagctgacatcacaagtctcttccttccagtctcttgccggatcatacaagcaaccattcattctatcctcccaggattcttcagctgttgtgttaccggattccacaaactcaccgctgtttcatgatgtgtgggacactcagttgaacggtctcaagtttgaccagttcagtcccttgatgcagcaggacctttatgctagtcagaatatctgtatgagtaatagcacaaccagtaacattctagatcctccactctcaaacacagtccttgatgacttctgtgccatcaaagacactgatttccagaaccacccttctggttgtttggttggaaacaacaacactagctttgctcaagatgtccagtcgcagatcacatcagctagctttgcagactcacaggccttctctcgccaagattttccagataattctggaggcactggtacatcttcaagcaatgttgattttgatgattgtagtctgcggcaaaatagtaaaggctcatcatggcagaaaattgcgacaccccgcgtccgaacctacactaaggttcaaaaaaccgggtcagtcgggagatcaattgatgtcacaagctttaaagactacgaggagctaaaatctgctatcgaatgcatgtttggattggaaggactactaactcacccacaaagctcgggttggaagcttgtatatgttgattatgagagtgatgttctgcttgtaggagatgatccatgggaagagtttgtgggatgcgtaaggtgcataaggatattgtcgccaactgaggtccagcagatgagtgaagaagggatgaagcttttgaacagcgcaggcattaacgatcttaagacttctgtttcataaatgtaacaatata

SEQ ID NO: 364 - protein, 902 aa, Arabidopsis thaliana
  G446,ARF domain coordinates 53-389
MMASLSCVEDKMKTSCLVNGGGTITTTTSQSTLLEEMKLLKDQSGTRKPVINSELWHACAGPLVCLPQVGSLVYYFSQGHSEQVAVSTRRSATTQVPNYPNLPSQLMCQVHNVTLHADKDSDEIYAQMSLQPVHSERDVFPVPDFGMLRGSKHPTEFFCKTLTASDTSTHGGFSVPRRAAEKLFPPLDYSAQPPTQELVVRDLHENTWTFRHIYRGQPKRHLLTTGWSLFVGSKRLRAGDSVLFIRDEKSQLMVGVRRANRQQTALPSSVLSADSMHIGVLAAAAHATANRTPFLIFYNPRACPAEFVIPLAKYRKAICGSQLSVGMRFGMMFETEDSGKRRYMGTIVGISDLDPLRWPGSKWRNLQVEWDEPGCNDKPTRVSPWDIETPESLFIFPSLTSGLKRQLHPSYFAGETEWGSLIKRPLIRVPDSANGIMPYASFPSMASEQLMKMMMRPHNNQNVPSFMSEMQQNIVMGNGGLLGDMKMQQPLMMNQKSEMVQPQNKLTVNPSASNTSGQEQNLSQSMSAPAKPENSTLSGCSSGRVQHGLEQSMEQASQVTTSTVCNEEKVNQLLQKPGASSPVQADQCLDITHQIYQPQSDPINGFSFLETDELTSQVSSFQSLAGSYKQPFILSSQDSSAVVLPDSTNSPLFHDVWDTQLNGLKFDQFSPLMQQDLYASQNICMSNSTTSNILDPPLSNTVLDDFCAIKDTDFQNHPSGCLVGNNNTSFAQDVQSQITSASFADSQAFSRQDFPDNSGGTGTSSSNVDFDDCSLRQNSKGSSWQKIATPRVRTYTKVQKTGSVGRSIDVTSFKDYEELKSAIECMFGLEGLLTHPQSSGWKLVYVDYESDVLLVGDDPWEEFVGCVRCIRILSPTEVQQMSEEGMKLLNSAGINDLKTSVS

SEQ ID NO: 365 - DNA, 3829 bp, Arabidopsis thaliana
  G447,family:ARF
ctttttaagagcttaaaaatttgctttgaagcttcaaatattcttatgaactaaaaagaagaaaaaagcttttgtttctttttccttagcagcagaatgatttttgtttccaaaattattactatttagtttctctcgtgctcttctcttgagcaaatacagattcgttaattttgctgaagaagaagaactctgtttcttccctgcaccaaaccaattttttcgttctttctataaaccatgaaagctccatcaaatggatttcttccaagttccaacgaaggagagaagaagccaatcaattctcaactatggcacgcttgtgcagggcctttagtttcattacctcctgtgggaagtcttgtggtttacttccctcaaggacacagcgagcaagttgcagcatcgatgcagaagcaaacagattttataccaaattacccaaatcttccttctaagctgatttgcttgcttcacagtgttacattacatgctgataccgaaacagatgaagtctatgcacaaatgactcttcaacctgtgaataagtatgatagagaagcattgctagcttctgatatgggcttgaagctaaacagacaacctactgagtttttttgcaagactcttactgcaagtgacacaagcactcatggtggattctctgtaccgcgtcgtgcagctgagaaaatattccctcctcttgatttctcgatgcaaccgcctgcgcaagagattgtagctaaagatttacatgatactacatggactttcagacatatctatcgaggccaaccaaaaagacacttgcttaccacaggttggagcgtttttgttagcacaaagagactatttgcgggtgattcagttttgtttgtaagagatgagaaatcacagctgatgttgggtataagacgtgcaaatagacaaactccgactctttcctcatcggtcatatccagcgacagtatgcacattgggatacttgcagctgcagctcatgctaatgccaatagtagcccttttaccatcttcttcaatccaagggcaagtccttcagagtttgtagttcctttagccaaatacaacaaagccttatacgctcaagtatctctaggaatgagattccggatgatgtttgagactgaggattgtggggttcgtagatatatgggtacagtcacaggtattagtgatcttgaccctgtaagatggaaaggctcacaatggcgtaatcttcaggtaggatgggatgaatcaacagctggagataggccaagccgagtatccatatgggaaatcgaacccgtcataactcctttttacatatgtcctcctccatttttcagacctaagtacccgaggcaacccgggatgccagatgatgagttagacatggaaaatgctttcaaaagagcaatgccttggatgggagaagactttgggatgaaggacgcacagagttcgatgttccctggtttaagtctagttcaatggatgagtatgcagcaaaacaatccattgtcaggttctgctactcctcagctcccgtccgcgctctcatcttttaacctaccaaacaattttgcttccaacgacccttccaagctgttgaacttccaatccccaaacctctcttccgcaaattcccaattcaacaaaccgaacacggttaaccatatcagccaacagatgcaagcacaaccagccatggtgaaatctcaacaacaacaacaacaacaacaacaacaacaccaacaccaacaacaacaactgcaacaacaacaacaactacagatgtcacagcaacaggtgcagcaacaagggatttataacaatggtacgattgctgttgctaaccaagtctcttgtcaaagtccaaaccaacctactggattctctcagtctcagcttcagcagcagtcaatgctccctactggtgctaaaatgacacaccagaacataaattctatggggaataaaggcttgtctcaaatgacatcgtttgcgcaagaaatgcagtttcagcagcaactggaaatgcataacagtagccagttattaagaaaccagcaagaacagtcctctctccattcattacaacaaaatctgtcccaaaatcctcagcaactccaaatgcaacaacaatcatcaaaaccaagtccttcacaacagcttcagttgcagctactgcagaagctacagcagcagcaacagcagcagtcgattcctccagtaagctcatccttacagccacaattatcagcgttgcagcagacacaaagccatcaattgcaacaacttctgtcgtctcaaaatcaacagcccttggcacatggtaataacagcttcccagcttcaactttcatgcagcctccacagattcaggtgagtcctcagcagcaaggacagatgagtaacaaaaatcttgtagccgctggaagatcacattctggccacacagatggagaagctccttcttgttcaacctcaccttccgccaataacacgggacatgataatgtttcaccgacaaatttcctgagcagaaatcaacagcaaggacaagctgcatctgtatctgcatctgattcagtctttgagcgcgcaagcaatccggtccaagagctttatacaaaaactgagagccggatcagtcaaggcatgatgaatatgaagagtgctggtgaacatttcagatttaaaagcgcggtaacagatcaaatcgatgtatccacagcgggaacgacgtactgtcctgatgttgttggccctgtacagcagcaacaaactttcccactaccatcatttggttttgatggagactgccaatctcatcatccaagaaacaacttagctttccctggtaatctcgaagccgtaacttctgatccactctattctcaaaaggactttcaaaacttggttcccaactatggcaacacaccaagagacattgagacggagctgtccagtgctgcaatcagttctcagtcatttggtattcccagcattccctttaagcccggatgttcaaatgaggttggcggcatcaatgattcaggaatcatgaatggtggaggactgtggcccaatcagactcaacgaatgcgaacatatacaaaggttcaaaaacgagggtcagtaggtagatcaatagatgttacccgttatagcggctatgatgaacttaggcatgacttagcgagaatgtttggcatcgaaggacagctcgaagatccgctaacctctgattggaaactcgtctacaccgatcacgaaaacgatattttactagttggtgatgatccttgggaagagtttgtgaactgcgtgcagaacataaagatactatcatcagtagaagttcagcaaatgagcttagacggagatcttgcagctatcccaaccacaaaccaagcctgcagcgaaacagacagcggaaatgcttggaaagtacactatgaagacacttctgctgcagcttctttcaacagatagaaataaaaagatgcaaatataccaagtcaacttacattatcattcgaggccatcgcaaagtacatgtttttttttgtgtgtatgtactgcaaacaacaaactgagaagaagaagatactgcacggtatataaacatttttataggacagtgatttgatttttcattctaacttgatgttgttgtactttcttgtttccatatttgtataacaagtataatgcttgacaagtctatgaggagcatatcttatacagagatactaagatgtaatgttaatgtaactaaacaattaccttcattaatcatgaatcctttggtcgtttaaaa

SEQ ID NO: 366 - protein, 1086 aa, Arabidopsis thaliana
  G447,ARF domain coordinates 22-356
MKAPSNGFLPSSNEGEKKPINSQLWHACAGPLVSLPPVGSLVVYFPQGHSEQVAASMQKQTDFIPNYPNLPSKLICLLHSVTLHADTETDEVYAQMTLQPVNKYDREALLASDMGLKLNRQPTEFFCKTLTASDTSTHGGFSVPRRAAEKIFPPLDFSMQPPAQEIVAKDLHDTTWTFRHIYRGQPKRHLLTTGWSVFVSTKRLFAGDSVLFVRDEKSQLMLGIRRANRQTPTLSSSVISSDSMHIGILAAAAHANANSSPFTIFFNPRASPSEFVVPLAKYNKALYAQVSLGMRFRMMFETEDCGVRRYMGTVTGISDLDPVRWKGSQWRNLQVGWDESTAGDRPSRVSIWEIEPVITPFYICPPPFFRPKYPRQPGMPDDELDMENAFKRAMPWMGEDFGMKDAQSSMFPGLSLVQWMSMQQNNPLSGSATPQLPSALSSFNLPNNFASNDPSKLLNFQSPNLSSANSQFNKPNTVNHISQQMQAQPAMVKSQQQQQQQQQQHQHQQQQLQQQQQLQMSQQQVQQQGIYNNGTIAVANQVSCQSPNQPTGFSQSQLQQQSMLPTGAKMTHQNINSMGNKGLSQMTSFAQEMQFQQQLEMHNSSQLLRNQQEQSSLHSLQQNLSQNPQQLQMQQQSSKPSPSQQLQLQLLQKLQQQQQQQSIPPVSSSLQPQLSALQQTQSHQLQQLLSSQNQQPLAHGNNSFPASTFMQPPQIQVSPQQQGQMSNKNLVAAGRSHSGHTDGEAPSCSTSPSANNTGHDNVSPTNFLSRNQQQGQAASVSASDSVFERASNPVQELYTKTESRISQGMMNMKSAGEHFRFKSAVTDQIDVSTAGTTYCPDVVGPVQQQQTFPLPSFGFDGDCQSHHPRNNLAFPGNLEAVTSDPLYSQKDFQNLVPNYGNTPRDIETELSSAAISSQSFGIPSIPFKPGCSNEVGGINDSGIMNGGGLWPNQTQRMRTYTKVQKRGSVGRSIDVTRYSGYDELRHDLARMFGIEGQLEDPLTSDWKLVYTDHENDILLVGDDPWEEFVNCVQNIKILSSVEVQQMSLDGDLAAIPTTNQACSETDSGNAWKVHYEDTSAAASFNR

SEQ ID NO: 367 - DNA, 988 bp, Arabidopsis thaliana
  G450,family:IAA
gagttatcgagagagagagaaaacatattctgatttaagacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgttttaatttaaaatataggaaggatataggaaaatataattgtttacaaaaaaataactttaaatatgtcttttttttttttttgaaattagtctgtgtttttgttttcatctcttaattagtagaaatcattttttaatatgtaattgtgatagtaaatctatagagttcgta

SEQ ID NO: 368 - protein, 228 aa, Arabidopsis thaliana
  G450,IAA domain coordinates 6-14,78-89,112-128,180-217
MNLKETELCLGLPGGTETVESPAKSGVGNKRGFSETVDLKLNLQSNKQGHVDLNTNGAPKEKTFLKDPSKPPAKAQVVGWPPVRNYRKNVMANQKSGEAEEAMSSGGGTVAFVKVSMDGAPYLRKVDLKMYTSYKDLSDALAKMFSSFTMGSYGAQGMIDFMNESKVMDLLNSSEYVPSYEDKDGDWMLVGDVPWPMFVESCKRLRIMKGSEAIGLAPRAMEKFKNRS

SEQ ID NO: 369 - DNA, 697 bp, Arabidopsis thaliana
  G451,family:IAA
tcaagaattaaggaagagagcttcttcgttaaagtatagtgagagaatatggaagtcaccaatgggcttaaccttaaggacacagagcttcgtttgggattacccggagcacaagaagaacaacaactagaactttcttgcgtcagaagcaacaacaagcgcaagaacaacgactcaacagaagaatctgctcctcctcctgcaaaaacacaaatcgttggatggcctccagtgagatctaaccgtaagaacaacaacaacaaaaacgtgagttatgtgaaagtgagtatggacggagctccatatctccgtaagatagatctcaagatgtacaaaaactatccagagcttctcaaagcactagagaacatgttcaagttcacagtaggtgaatattccgagagagaaggctacaaaggatctggatttgtacctacttatgaagacaaagatggagattggatgttggtcggtgatgttccatgggacatgttctcttcatcttgtcaaaaactcagaatcatgaaaggatccgaagctcctactgccttatgatccattgtctcaaaacaccttttggtcgaggcaaaaacaaattctactttgtttagataaaaaaaagtttggtgtaaagaaagaaaaagcaatagggttacaaatacgttatatagatgtaaactagctttggttaattctg

SEQ ID NO: 370 - protein, 168 aa, Arabidopsis thaliana
  G451,IAA domain coordinates 12-20,57-68,76-92,131-164
MEVTNGLNLKDTELRLGLPGAQEEQQLELSCVRSNNKRKNNDSTEESAPPPAKTQIVGWPPVRSNRKNNNNKNVSYVKVSMDGAPYLRKIDLKMYKNYPELLKALENMFKFTVGEYSEREGYKGSGFVPTYEDKDGDWMLVGDVPWDMFSSSCQKLRIMKGSEAPTAL

SEQ ID NO: 371 - DNA, 1169 bp, Arabidopsis thaliana
  G456,family:IAA
cacacatctcacatccccctatctctctctctcttcaaacgttttagttccccaaaaaaatatcaaaagaactaaaagaaaaaccctagaagccgaagaatctcctactcgttgtcgatcggatcacctaactaattactcgttgataatcattatatcgagaaatatgattaattttgaggccacggagctgagattagggctaccgggtgggaatcacggaggagaaatggctggaaaaaataatggtaaaagaggattttctgagactgttgatctcaaactgaatctttcatcgacggctatggattcagtttccaaagtcgatttagagaatatgaaggagaaggtcgtaaaaccaccagccaaggcacaagttgtgggatggccaccggtacgatctttccgcaagaacgtcatgtccggccaaaaaccgaccaccggagatgccaccgaaggaaacgataagacttctggcagcagtggagccacctcatccgcctccgcatgtgccaccgtggcttatgtgaaggttagcatggacggtgcaccgtacctacggaaaattgacttgaaactctacaaaacttaccaagatctctccaacgccttaagcaaaatgtttagctcttttaccataggcaactatggaccacaaggaatgaaagatttcatgaatgagagtaaattgatcgatcttctaaacggatcagattatgttccaacatatgaagataaagatggcgactggatgcttgtaggagacgtaccgtgggagatgtttgttgattcatgcaaacgtatacgaataatgaagggatcagaagcaatcggacttgctccaagggcattagaaaagtgcaagaacagaagttgagttctcgacgacatttcgtgttcttacctaaaaaaggaagaaagcctgtttcgatcggttggatatctcgaaccgagaaagctaaaccggctcgaaactattgttccgagcaaggagtttgcttataatattaattaataataatattaatattgtggtgtattacattttaaaaaattaaatcgtttttgttatatgtattatatacatatattaatatgtatatttaattaggttgcatctatttccgttaaaaccaacttttgtttttacgcaaaaaaaaagagttcac

SEQ ID NO: 372 - protein, 236 aa, Arabidopsis thaliana
  G456,IAA domain coordinates 7-14,71-81,120-153,185-221
MINFEATELRLGLPGGNHGGEMAGKNNGKRGFSETVDLKLNLSSTAMDSVSKVDLENMKEKVVKPPAKAQVVGWPPVRSFRKNVMSGQKPTTGDATEGNDKTSGSSGATSSASACATVAYVKVSMDGAPYLRKIDLKLYKTYQDLSNALSKMFSSFTIGNYGPQGMKDFMNESKLIDLLNGSDYVPTYEDKDGDWMLVGDVPWEMFVDSCKRIRIMKGSEAIGLAPRALEKCKNRS

SEQ ID NO: 373 - DNA, 829 bp, Arabidopsis thaliana
  G461,family:IAA
aacaagagaagtgcttgagagaaaaaaaaagtatcaaaacttcatatagccaaatttaaacaaaaagaaaaaagagaagaaataaatggcaaaggaaggtctagcactcgagatcacagagcttcgattgggtcttccaggagataattatagcgaaatatcagtatgcggatcgagtaagaagaagaagagggtgctctcggatatgatgacctcatcagcgttagatactgagaatgaaaacagcgtcgtttcatcagttgaagatgaatcactgccggttgtgaagagtcaagcggtgggatggccacctgtgtgttcttacaggagaaagaagaacaatgaggaagcatcgaaagctataggctacgtgaaagtgagcatggatggtgtgccatacatgaggaagattgaccttggttcgagcaacagttatattaatctagtcacggttcttgagaatctcttcggctgtcttggcataggagtggcgaaggagggtaagaagtgtgaatacattattatatacgaagacaaggatagagactggatgctcgtcggagatgtaccttggcagatgtttaaagaatcatgcaagaggctgaggatcgtgaagagatcagatgcaactggttttggtctccagcaagattaatcatactagctagtgttgatcatctttaattaaccataaagtttgaaaaccgttgagtaattttttttcattataatcatttttcaaattgtaaaatttatatgataatgatgatatatacgttttcttcaaatgtatttccttactggtcgtatcatactttaatgttttatg

SEQ ID NO: 374 - protein, 189 aa, Arabidopsis thaliana
  G461,IAA domain coordinates 11-19,70-82,95-111,148-181
MAKEGLALEITELRLGLPGDNYSEISVCGSSKKKKRVLSDMMTSSALDTENENSVVSSVEDESLPVVKSQAVGWPPVCSYRRKKNNEEASKAIGYVKVSMDGVPYMRKIDLGSSNSYINLVTVLENLFGCLGIGVAKEGKKCEYIIIYEDKDRDWMLVGDVPWQMFKESCKRLRIVKRSDATGFGLQQD

SEQ ID NO: 375 - DNA, 779 bp, Arabidopsis thaliana
  G462,family:IAA
ggaaaaaaagaagttcaagaaatggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtggggttagggtatgtgaaagtgagcatggatggtgtgccttatttgaggaagatggatcttggttcgagccaaggctatgatgatctagcctttgctcttgataagctcttcggtttccgtggcatcggtgtggccttgaaagatggtgacaactgcgaatacgttaccatatacgaagacaaagatggagactggatgctcgccggtgatgtaccttgggggatgtttctagagtcatgcaagaggttgagaataatgaaaagatcggatgctaccgggtttgggctgcagcctagaggagtagacgagtgatgatgacttgaacaagaagcaaggagctggttcattaatttaatcttaaacttgatcatcaagatcctttagaacatttttcctattcatgttatataaatatatatgttatagtatattattttgcaacaaaatttcatgttaaaaaaaaaaaaaaaaaaaaa

SEQ ID NO: 376 - protein, 197 aa, Arabidopsis thaliana
  G462,IAA domain coordinates 11-19,70-82,98-114,152-185
MEKEGLGLEITELRLGLPGRDVAEKMMKKRAFTEMNMTSSGSNSDQCESGVVSSGGDAEKVNDSPAAKSQVVGWPPVCSYRKKNSCKEASTTKVGLGYVKVSMDGVPYLRKMDLGSSQGYDDLAFALDKLFGFRGIGVALKDGDNCEYVTIYEDKDGDWMLAGDVPWGMFLESCKRLRIMKRSDATGFGLQPRGVDE

SEQ ID NO: 377 - DNA, 992 bp, Arabidopsis thaliana
  G464,family:IAA
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatgatgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaaaggttaaacctttaaggcttttagatggatcatcagactttgtactcacttatgaagataaggaaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctctt

SEQ ID NO: 378 - protein, 239 aa, Arabidopsis thaliana
  G464,IAA domain coordinates 20-28,71-82,126-142,187-224
MRGVSELEVGKSNLPAESELELGLGLSLGGGAWKERGRILTAKDFPSVGSKRSAESSSHQGASPPRSSQVVGWPPIGLHRMNSLVNNQAMKAARAEEGDGEKKVVKNDELKDVSMKVNPKVQGLGFVKVNMDGVGIGRKVDMRAHSSYENLAQTLEEMFFGMTGTTCREKVKPLRLLDGSSDFVLTYEDKEGDWMLVGDVPWRMFINSVKRLRIMGTSEASGLAPRRQEQKDRQRNNPV

SEQ ID NO: 379 - DNA, 733 bp, Arabidopsis thaliana
  G468,family:IAA
ttactcatttgtcttaacctaaaattattataaaaaggatagagagagagagagagagctagagatatgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactgatatataagtctacgtacttgttgtgtttaaatcgaagtaatgccaagaaaaaagtttttgcctgatgtaaatcaatggtcggatatttataatattattttcatttttctttaaaaaaaaaaaaaaaaaaaaaaaaaaa

SEQ ID NO: 380 - protein, 175 aa, Arabidopsis thaliana
  G468,IAA domain coordinates 86-102,141-171
MGRGRSSSSSSIESSSKSNPFGASSSTRNLSTDLRLGLSFGTSSGTQYFNGGYGYSVAAPAVEDAEYVAAVEEEEENECNSVGSFYVKVNMEGVPIGRKIDLMSLNGYRDLIRTLDFMFNASILWAEEEDMCNEKSHVLTYADKEGDWMMVGDVPWEMFLSTVRRLKISRANYHY

SEQ ID NO: 381 - DNA, 2580 bp, Arabidopsis thaliana
  G470,family:ARF
atggcgagttcggaggtttcaatgaaaggtaatcgtggaggagataacttctcctcctctggttttagtgaccctaaggagactagaaatgtctccgtcgccggcgaggggcaaaaaagtaattctacccgatccgctgcggctgagcgtgctttggaccctgaggctgctctttacagagagctatggcacgcttgtgctggtccgcttgtgacggttcctagacaagacgaccgagtcttctattttcctcaaggacacatcgagcaggtggaggcttcgacgaaccaggcggcagaacaacagatgcctctctatgatcttccgtcaaagcttctctgtcgagttattaatgtagatttaaaggcagaggcagatacagatgaagtttatgcgcagattactcttcttcctgaggctaatcaagacgagaatgcaattgagaaagaagcgcctcttcctccacctccgaggttccaggtgcattcgttctgcaaaaccttgactgcatccgacacaagtacacatggtggattttctgttcttaggcgacatgcggatgaatgtctcccacctctggatatgtctcgacagcctcccactcaagagttagttgcaaaggatttgcatgcaaatgagtggcgattcagacatatattccggggtcaaccacggaggcatttgctacagagtgggtggagtgtgtttgttagctccaaaaggctagttgcaggcgatgcgtttatatttctaaggggcgagaatggagaattaagagttggtgtaaggcgtgcgatgcgacaacaaggaaacgtgccgtcttctgttatatctagccatagcatgcatcttggagtactggccaccgcatggcatgccatttcaacagggactatgtttacagtctactacaaacccaggacgagcccatctgagtttattgttccgttcgatcagtatatggagtctgttaagaataactactctattggcatgagattcaaaatgagatttgaaggcgaagaggctcctgagcagaggtttactggcacaatcgttgggattgaagagtctgatcctactaggtggccaaaatcaaagtggagatccctcaaggtgagatgggatgagacttctagtattcctcgacctgatagagtatctccgtggaaagtagagccagctcttgctcctcctgctttgagtcctgttccaatgcctaggcctaagaggcccagatcaaatatagcaccttcatctcctgactcttcgatgcttaccagagaaggtacaactaaggcaaacatggaccctttaccagcaagcggactttcaagggtcttgcaaggtcaagaatactcgaccttgaggacgaaacatactgagagtgtagagtgtgatgctcctgagaattctgttgtctggcaatcttcagcggatgatgataaggttgacgtggtttcgggttctagaagatatggatctgagaactggatgtcctcagccaggcatgaacctacttacacagatttgctctccggctttgggactaacatagatccatcccatggtcagcggatacctttttatgaccattcatcatcaccttctatgcctgcaaagagaatcttgagtgattcagaaggcaagttcgattatcttgctaaccagtggcagatgatacactctggtctctccctgaagttacatgaatctcctaaggtacctgcagcaactgatgcgtctctccaagggcgatgcaatgttaaatacagcgaatatcctgttcttaatggtctatcgactgagaatgctggtggtaactggccaatacgtccacgtgctttgaattattatgaggaagtggtcaatgctcaagcgcaagctcaggctagggagcaagtaacaaaacaacccttcacgatacaagaggagacagcaaagtcaagagaagggaactgcaggctctttggcattcctctgaccaacaacatgaatgggacagactcaaccatgtctcagagaaacaacttgaatgatgctgcggggcttacacagatagcatcaccaaaggttcaggacctttcagatcagtcaaaagggtcaaaatcaacaaacgatcatcgtgaacagggaagaccattccagactaataatcctcatccgaaggatgctcaaacgaaaaccaactcaagtaggagttgcacaaaggttcacaagcagggaattgcacttggccgttcagtggatctttcaaagttccaaaactatgaggagttagtcgctgagctggacaggctgtttgagttcaatggagagttgatggctcctaagaaagattggttgatagtttacacagatgaagagaatgatatgatgcttgttggtgacgatccttggcaggagttttgttgcatggttcgcaaaatcttcatatacacgaaagaggaagtgaggaagatgaacccggggactttaagctgtaggagcgaggaagaagcagttgttggggaaggatcagatgcaaaggacgccaagtctgcatcaaatccttcattgtccagcgctgggaactcttaa

SEQ ID NO: 382 - protein, 859 aa, Arabidopsis thaliana
  G470,ARF domain coordinates 61-393
MASSEVSMKGNRGGDNFSSSGFSDPKETRNVSVAGEGQKSNSTRSAAAERALDPEAALYRELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVEPALAPPALSPVPMPRPKRPRSNIAPSSPDSSMLTREGTTKANMDPLPASGLSRVLQGQEYSTLRTKHTESVECDAPENSVVWQSSADDDKVDVVSGSRRYGSENWMSSARHEPTYTDLLSGFGTNIDPSHGQRIPFYDHSSSPSMPAKRILSDSEGKFDYLANQWQMIHSGLSLKLHESPKVPAATDASLQGRCNVKYSEYPVLNGLSTENAGGNWPIRPRALNYYEEVVNAQAQAQAREQVTKQPFTIQEETAKSREGNCRLFGIPLTNNMNGTDSTMSQRNNLNDAAGLTQIASPKVQDLSDQSKGSKSTNDHREQGRPFQTNNPHPKDAQTKTNSSRSCTKVHKQGIALGRSVDLSKFQNYEELVAELDRLFEFNGELMAPKKDWLIVYTDEENDMMLVGDDPWQEFCCMVRKIFIYTKEEVRKMNPGTLSCRSEEEAVVGEGSDAKDAKSASNPSLSSAGNS

SEQ ID NO: 383 - DNA, 624 bp, Arabidopsis thaliana
  G475,family:SBP
gagagagagagttgaattttgcagatgagtatgagaagaagcaaagcggaagggaagaggagcttacgagaactgagtgaggaagaggaagaagaagaagaaactgaagatgaagatacttttgaagaagaagaggctttggagaagaagcagaaaggtaaagctacaagtagtagtggagtttgtcaggtcgagagttgtaccgcggatatgagcaaagccaaacagtaccacaaacgacacaaagtctgccagtttcatgccaaagctcctcatgttcggatctctggtcttcaccaacgtttctgccaacaatgcagcaggtttcacgcgctcagtgagtttgatgaagccaagcggagttgcaggagacgcttagctggacacaacgagagaaggcggaaaagcacaactgactaaagacggtgaaacgtgtgagatcccggtttgaaggttaatgaaacaggctttgcttactctcttctgtcagtctcttttagctccttgtaatcctctgtgtctctgtctgtttctccatattacctgtaatcaaagctatctgctaaacctacgacatggttaaataaatgcattgagacttagtaaaaaaaaaaaaaaaaaaaa

SEQ ID NO: 384 - protein, 131 aa, Arabidopsis thaliana
  G475,SBP domain coordinates 53-127
MSMRRSKAEGKRSLRELSEEEEEEEETEDEDTFEEEEALEKKQKGKATSSSGVCQVESCTADMSKAKQYHKRHKVCQFHAKAPHVRISGLHQRFCQQCSRFHALSEFDEAKRSCRRRLAGHNERRRKSTTD

SEQ ID NO: 385 - DNA, 1218 bp, Arabidopsis thaliana
  G477,family:SBP
atggattcttggagctacgggagaagcgttttcatgtcaaatgaaactcttttaccttgtgatacttttgctaagaatagaagatttgaacagagactctctaataatgatgatgtgttgatttctgacatggctggtaactccaatggattcagtgctgtttctattactaaagttgttcctgaagaggaagatgaggagaacatatcttcttcttcaaagttctctagtcaggaattgaataggatagatttcaaacttaggagctttttggatttaggaaatgatgatgatgatacatcctctagaggttttgctctgccatctaaaaagtctcgagcttcaaacttgtgctctcagaatcccttgtgtcaagtttatgggtgtagtaaggatctgagctcttcgaaagattaccacaaaaggcatagagtttgcgaggctcattcgaaaacttctgtggtcatagttaatggtcttgaacagaggttttgtcaacagtgcagcaggtttcatttcctctcagagtttgatgatggcaaaagaagttgcagaaggcgattagccggtcacaatgaacgaagaaggaaacctgcattctatttcctaccgggtaagcgccataagcttcttcgcacctctcaagatgtagtaggcaacaagtttctggagaattcatcattggtattgccagagtcatttcctggtagtctcttatacagagtaatagatgaagacgaccaccgtacaagtagactcgtgagtttcaaagatgaacctacttgttccatgtttcctactaatgagcaaaacagcagcagaacttatgaatctaaaccagcaatttattccacggaagtatcctccatttgggacttacatgagacggcggcatcacgctctactcgtgctctctctcttctgtcagctcagtcccaacaacacttgtctaagtttccaaacacaacgttctcaatcacccaacccaaccaaaatctcaatcactcatcatcaactgactatcatcagatggaacaaccgttgtggatcgatcctggcaagaccaattctgctggttctagttcttgtaaaggaaaaggaacatccacggttgatctactgcaactgtcatcacatcttcaaagaatcgagcaacagaggaattacactggtgatgtgaagcaggaatataatgagctttatttccctggctcctaa

SEQ ID NO: 386 - protein, 405 aa, Arabidopsis thaliana
  G477,SBP domain coordinates 108-233
MDSWSYGRSVFMSNETLLPCDTFAKNRRFEQRLSNNDDVLISDMAGNSNGFSAVSITKVVPEEEDEENISSSSKFSSQELNRIDFKLRSFLDLGNDDDDTSSRGFALPSKKSRASNLCSQNPLCQVYGCSKDLSSSKDYHKRHRVCEAHSKTSVVIVNGLEQRFCQQCSRFHFLSEFDDGKRSCRRRLAGHNERRRKPAFYFLPGKRHKLLRTSQDVVGNKFLENSSLVLPESFPGSLLYRVIDEDDHRTSRLVSFKDEPTCSMFPTNEQNSSRTYESKPAIYSTEVSSIWDLHETAASRSTRALSLLSAQSQQHLSKFPNTTFSITQPNQNLNHSSSTDYHQMEQPLWIDPGKTNSAGSSSCKGKGTSTVDLLQLSSHLQRIEQQRNYTGDVKQEYNELYFPGS

SEQ ID NO: 387 - DNA, 1002 bp, Arabidopsis thaliana
  G478,family:SBP
atgttggactacgaatgggataatccttcctccatcgttctctccggagatgaaagaaacccggactctgacccgacccggtcatccttctcctttttcgaccccatctcccattacaacaacgaccaccgtcacatcaccatttctcctcccctcctctcttccttctctaaccaacaacaacagcatcacctcaccctctacggtcagaccaacagcaacaaccagtttcttcatcatcaccatcaccaccactccttgtacgggtccaccaccaccaccactccttacggcgcctccgatcccatctaccatccccactcttccgctccgccagcctccttgttctcctacgaccagacaggaccgggctcgggatccggatcttcctacaacttcctcatccccaagacagaagtggatttcacgtccaacaggatcgggctgaacctgggaggccgtacgtacttctcagcggcggacgacgacttcgtgagcaggctatacaggaggtctcgaccaggtgagtcagggatggcgaactcgctgagcacgccgcggtgccaagcagagggatgcaacgcggatctgagccacgcgaaacactaccacagaaggcacaaagtgtgcgaattccactcaaaagcatcgacggttgtagccgccggactaagccaaaggttttgccagcaatgcagcaggttccatttgctgtcggaattcgacaacgggaaacggagctgccgtaagcgacttgctgaccataaccgccgccgccgtaaatgtcaccaatcagcctccgccacccaagacaccggcaccggcaagactactccaaagtcaccgaacgattcgggtgttaaagcgtcatcgtcaccgtcgtccaacgcgccgcctacgatatcactggagtgcttccggcaaaggcagttccaaacgacagcgtcttcatccacgtcagcgtcttcgtcttcaaattcaatgtttttctccagcggatag

SEQ ID NO: 388 - protein, 333 aa, Arabidopsis thaliana
  G478,SBP domain coordinates 186-281
MLDYEWDNPSSIVLSGDERNPDSDPTRSSFSFFDPISHYNNDHRHITISPPLLSSFSNQQQQHHLTLYGQTNSNNQFLHHHHHHHSLYGSTTTTTPYGASDPIYHPHSSAPPASLFSYDQTGPGSGSGSSYNFLIPKTEVDFTSNRIGLNLGGRTYFSAADDDFVSRLYRRSRPGESGMANSLSTPRCQAEGCNADLSHAKHYHRRHKVCEFHSKASTVVAAGLSQRFCQQCSRFHLLSEFDNGKRSCRKRLADHNRRRRKCHQSASATQDTGTGKTTPKSPNDSGVKASSSPSSNAPPTISLECFRQRQFQTTASSSTSASSSSNSMFFSSG

SEQ ID NO: 389 - DNA, 748 bp, Arabidopsis thaliana
  G483,family:CAAT
gagatagcttagcaatggagcagtcagaagagggtcaacagcaacagcaacagggagtgatggattatgtacctcctcatgcttatcagagtgggccagtaaatgcagcttcccatatggcattccaacaagctcaccacttccaccaccaccatcagcagcaacaacagcagcagcttcagatgttctgggctaaccaaatgcaagagatcgagcataccactgatttcaagaaccacacccttcccctagcccgcatcaagaagatcatgaaagctgatgaagatgtgaggatgatctctgcggaggctcctgtgatttttgccaaggcctgtgagatgttcattttggagctcactctacgtgcttggatccacaccgaggagaacaagaggaggaccttgcagaagaacgacatcgccgctgccatttccaggaccgacgtgtttgatttccttgtggacataatcccgagggacgagctgaaagaagaaggtttaggcgtgaccaaagggaccataccatcggtggtgggttccccgccatactattacttgcaacaacaggggatgatgcaacactggccccaggagcaacaccctgatgagtcttaaaacttttcccctttcgtttgtttggttgtatcgtagtaaggtagctctgctctgctgggaaccatttctattgtgttctgtaatgacatgttagtatatccccagtctatatctatggcaatgcagtttctgtt

SEQ ID NO: 390 - protein, 199 aa, Arabidopsis thaliana
  G483,CAAT domain coordinates 64-160
MEQSEEGQQQQQQGVMDYVPPHAYQSGPVNAASHMAFQQAHHFHHHHQQQQQQQLQMFWANQMQEIEHTTDFKNHTLPLARIKKIMKADEDVRMISAEAPVIFAKACEMFILELTLRAWIHTEENKRRTLQKNDIAAAISRTDVFDFLVDIIPRDELKEEGLGVTKGTIPSVVGSPPYYYLQQQGMMQHWPQEQHPDES

SEQ ID NO: 391 - DNA, 922 bp, Arabidopsis thaliana
  G484,family:CAAT
attatattccgtacaatccgatcgatttcccggcgccagatctcaccgcgactcgtctactttccgatttggttcgtgttgactcagttacgattaaactatggatccaatggatatagtcggcaaatccaaggaagacgcttctcttccaaaagctacgatgactaaaattataaaggagatgttaccaccagatgttcgtgttgcaagagatgctcaagatcttctcattgaatgttgtgtagagtttataaatcttgtatcttcagaatctaatgatgtttgtaacaaagaggataaacggacgattgctcctgagcatgttctcaaggcattacaggttcttggttttggagaatacattgaagaagtctatgctgcgtatgagcaacataagtatgaaacaatgcaggacacacagaggagcgtgaaatggaaccctggagctcaaatgactgaggaggaagcagcagctgagcaacaacgtatgtttgcagaagcacgtgcaagaatgaatggaggtgtttcggttcctcaacctgaacatccagaaactgaccagagaagtccgcaaagctaactgaaaccgtaagggtaagtgttaggcaagaaaaaacaacatccttttaacattcccttgtaagttgcaaatgcgtatgttctctgtttatatgctcttagtatgatatatgttagttagtgtttcacgatctaaaaacacttgtgattcagatgtaattagtaagcattccttgttttgtgtttactttgtgtcttgactaagcatggtgggtcaggtctacacaaagcatctgattcgatgacttacaggaatcttaatgtttgtagattggataaatttggtgattggtgtaattgtttttccataaacacaatgcaatcattgtttagtgttgttaac

SEQ ID NO: 392 - protein, 159 aa, Arabidopsis thaliana
  G484,CAAT domain coordinates 11-99
MDPMDIVGKSKEDASLPKATMTKIIKEMLPPDVRVARDAQDLLIECCVEFINLVSSESNDVCNKEDKRTIAPEHVLKALQVLGFGEYIEEVYAAYEQHKYETMQDTQRSVKWNPGAQMTEEEAAAEQQRMFAEARARMNGGVSVPQPEHPETDQRSPQS

SEQ ID NO: 393 - DNA, 684 bp, Arabidopsis thaliana
  G485,family:CAAT
cctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaacagcg

SEQ ID NO: 394 - protein, 161 aa, Arabidopsis thaliana
  G485,CAAT domain coordinates 20-109
MADSDNDSGGHKDGGNASTREQDRFLPIANVSRIMKKALPANAKISKDAKETVQECVSEFISFITGEASDKCQREKRKTINGDDLLWAMTTLGFEDYVEPLKVYLQKYREVEGEKTTTAGRQGDKEGGGGGGGAGSGSGGAPMYGGGMVTTMGHQFSHHFS

SEQ ID NO: 395 - DNA, 476 bp, Arabidopsis thaliana
  G486,family:CAAT
gcgagagctgatagattcactgaaacaaaagagaaaaatgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgttgaactagacatctaagttctg

SEQ ID NO: 396 - protein, 139 aa, Arabidopsis thaliana
  G486,CAAT domain coordinates 3-66
MTDEDRLLPIANVGRLMKQILPSNAKISKEAKQTVQECATEFISFVTCEASEKCHRENRKTVNGDDIWWALSTLGLDNYADAVGRHLHKYREAERERTEHNKGSNDSGNEKETNTRSDVQNQSTKFIRVVEKGSSSSAR

SEQ ID NO: 397 - DNA, 927 bp, Arabidopsis thaliana
  G489,family:CAAT
gaattcggcacgagacccaccaagaggatcaaccagtctcttccccttcagattctcctttccacagtaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaagcacagccttccccttgcgagaatcaagaaaatcatgaaagcggatgaagatgtccgtatgatctcggctgaggcgcctgtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttcccgcttcttttaggcctaccttgtagtcttggggttttgtttctgttttcgaataatggtaacctttgtataacttatttcagtatcgtctcagtttggtactatgtcagttttggtaaaaaaaaaaaaaaaaaaaaaaaaaa

SEQ ID NO: 398 - protein, 231 aa, Arabidopsis thaliana
  G489,CAAT domain coordinates 68-164
MDQQDHGQSGAMNYGTNPYQTNPMSTTAATVAGGAAQPGQLAFHQIHQQQQQQQLAQQLQAFWENQFKEIEKTTDFKKHSLPLARIKKIMKADEDVRMISAEAPVVFARACEMFILELTLRSWNHTEENKRRTLQKNDIAAAVTRTDIFDFLVDIVPREDLRDEVLGSIPRGTVPEAAAAGYPYGYLPAGTAPIGNPGMVMGNPGGAYPPNPYMGQPMWQQQAPDQPDQEN

SEQ ID NO: 399 - DNA, 588 bp, Arabidopsis thaliana
  G490,family:CAAT
atgaggaggccaaagtcatctcacgtcaggatggaacctgttgcgcctcgttcacataacacgatgccaatgcttgatcaatttcgatctaatcatcctgaaacaagcaagatcgagggggtctcttcgttggacacagctctgaaggtgttttggaataatcaaagggagcagctaggaaactttgcaggccaaactcatttgccgctatctagggtcagaaagattttgaaatctgatcctgaagtcaagaagataagctgtgatgttcctgctttgttttcgaaagcctgtgaatacttcattctagaggtaacattacgagcttggatgcatactcaatcatgcactcgtgagaccatccggcgttgtgatatcttccaggccgtaaagaactcaggaacttatgatttcctgattgatcgtgtcccttttggaccgcactgtgtcacccatcagggtgtgcaacctcctgctgaaatgattttgccggatatgaatgttccaatcgatatggaccagattgaggaggagaatatgatggaagagcgctctgtcgggtttgacctcaactgtgatctccagtga

SEQ ID NO: 400 - protein, 195 aa, Arabidopsis thaliana
  G490,CAAT domain coordinates 56-145
MRRPKSSHVRMEPVAPRSHNTMPMLDQFRSNHPETSKIEGVSSLDTALKVFWNNQREQLGNFAGQTHLPLSRVRKILKSDPEVKKISCDVPALFSKACEYFILEVTLRAWMHTQSCTRETIRRCDIFQAVKNSGTYDFLIDRVPFGPHCVTHQGVQPPAEMILPDMNVPIDMDQIEEENMMEERSVGFDLNCDLQ

SEQ ID NO: 401 - DNA, 1281 bp, Arabidopsis thaliana
  G502,family:NAC
aattgattaggataggatcaggatcatcctcaacaacctcctcctaattcctcctccattcatagtaacaataatattaagaaagagggtaaactatgtcagaattattacagttgcctccaggtttccgatttcaccctaccgatgaagagcttgtcatgcactatctctgccgcaaatgtgcctctcagtccatcgccgttccgatcatcgctgagatcgatctctacaaatacgatccatgggagcttcctggtttagccttgtatggtgagaaggaatggtacttcttctctcccagggacagaaaatatcccaacggttcgcgtcctaaccggtccgctggttctggttactggaaagctaccggagctgataaaccgatcggactacctaaaccggtcggaattaagaaagctcttgttttctacgccggcaaagctccaaagggagagaaaaccaattggatcatgcacgagtaccgtctcgccgacgttgaccggtccgttcgcaagaagaagaatagtctcaggctggatgattgggttctctgccggatttacaacaaaaaaggagctaccgagaggcggggaccaccgcctccggttgtttacggcgacgaaatcatggaggagaagccgaaggtgacggagatggttatgcctccgccgccgcaacagacaagtgagttcgcgtatttcgacacgtcggattcggtgccgaagctgcatactacggattcgagttgctcggagcaggtggtgtcgccggagttcacgagcgaggttcagagcgagcccaagtggaaagattggtcggccgtaagtaatgacaataacaatacccttgattttgggtttaattacattgatgccaccgtggataacgcgtttggaggaggagggagtagtaatcagatgtttccgctacaggatatgttcatgtacatgcagaagccttactagaagggaattcctttcctgccgccgaaacgcaacgcaaaacgaccctcgtttttgcgtttatggcaacacgagaccgttttatatggtcaatgagtgtgccgattcggccattagatttctgttcagtcttcgtttattctatagaccgtccgatttcagatcatccctaatcggacggtggtcgttggatgtatcagtagtgtattactgtgttaggtagaagaaaatccacttgttcttaaattggcataaaagtcagaagctaatatttatatgtgccgcaatcaatttaatattttctgtctaaaaaaaaaaa

SEQ ID NO: 402 - protein, 289 aa, Arabidopsis thaliana
  G502,NAC domain coordinates 10-155
MSELLQLPPGFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRIYNKKGATERRGPPPPVVYGDEIMEEKPKVTEMVMPPPPQQTSEFAYFDTSDSVPKLHTTDSSCSEQVVSPEFTSEVQSEPKWKDWSAVSNDNNNTLDFGFNYIDATVDNAFGGGGSSNQMFPLQDMFMYMQKPY

SEQ ID NO: 403 - DNA, 1125 bp, Arabidopsis thaliana
  G504,family:NAC
cgtcgacctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggggcggccgct

SEQ ID NO: 404 - protein, 323 aa, Arabidopsis thaliana
  G504,NAC domain coordinates 16-178
MENMGDSSIGPGHPHLPPGFRFHPTDEELVVHYLKKKADSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKNSSQRPTMERVLLREDLMEGMLSKSSANSSSTSVLDNNDNNNNNNEEHFFDGMVVSSDKRSLCGQYRMGHEASGSSSFGSFLSSKRFHHTGDLNNDNYNVSFVSMLSEIPQSSGFHANGVMDTTSSLADHGVLRQAFQLPNMNWHS

SEQ ID NO: 405 - DNA, 1128 bp, Arabidopsis thaliana
  G505,family:NAC
atggacattccgtattaccactacgaccatggcggagacagccaatatcttccaccgggtttcaggtttcatcccacggacgaagagctcatcactcattaccttctccgcaaagtcctcgacggttgcttctcaagccgtgccatcgcagaagttgatctcaacaagtgtgagccttggcaacttcccgggagagctaagatgggagagaaagaatggtacttctttagcctccgtgaccggaagtatccgacgggactgagaactaacagagcaactgaggctggttactggaaagctaccggaaaagacagagagatctttagttcaaagacttgtgcacttgttgggatgaagaagactcttgtcttttacaaaggaagagctccgaaaggagagaagagtaattgggttatgcatgaatatcgtcttgaaggcaaattctcttaccatttcatctcaagaagctccaaggatgaatgggtgatctctagggttttccagaaaaccactttagctagcaccggagccgtctccgaaggaggaggaggaggaggagcaactgtgagcgtaagcagcggtactggtccatctaaaaagacgaaagtaccctcaacaatctcaagaaactatcaagaacaaccaagctctccttcctccgtctcactcccacctctcctggatccgaccactaccctcggctacaccgacagcagttgctcctacgacagccgtagcaccaacacaaccgtcacagccagcgcaataaccgagcacgtgtcctgtttctccactgtccctactactactacggccttgggcttagacgttaactcattcagccgtcttccaccgccgctagggtttgactttgacccttttcctcgtttcgtttctagaaacgtctcgactcaatctaacttcagatcgttccaagaaaacttcaatcaatttccttactttggatcgtcttctgcatcgactatgacctccgccgttaatctgccttctttccaaggcggcggaggcgtctccgggatgaattactggctaccggcgactgccgaagagaatgagtcaaaggtcggtgtgcttcatgctggacttgactgtatttggaactactga

SEQ ID NO: 406 - protein, 375 aa, Arabidopsis thaliana [sequence omitted]

SEQ ID NO: 407 - DNA, 1454 bp, Arabidopsis thaliana
  G509,family:NAC
cttcctcctttgctaataaacttttctttgaaccttacacgccttgttgatattactctcttaaatatatattttcgtacattaacacagacatatataaagctaaagatttcttcacgtaatgggtttgaaagatattgggtccaaattgccaccggggtttcgatttcatccaagtgatgaagagttggtttgtcattatctttgcaacaagattagggccaaatctgatcatggtgatgttgatgatgatgatgatgatgttgatgaagctttgaagggttctactgatcttgtggagattgacttgcatatctgtgagccatgggagcttcctgatgtggcaaagttaaacgcaaaggaatggtacttcttcagtttccgtgatcgaaagtatgctactggatatcgcacgaacagagcgacagtaagcggatactggaaagcaacaggaaaagatcgaacggtgatggatccacgtacaaggcaattggtagggatgagaaaaacactagtgttctacagaaacagagcaccaaatgggatcaaaactacttggatcatgcacgagttccgtcttgagtgtcctaacatcccacataaggaagactgggtcttgtgcagagtgttcaacaaaggcagagactcatcgctacaagacaataattattataacaatgataatcagacgcaaaggcttgaagttaatgacgctccggatcttaattacaacaatcagttgccacctttgctatcatcccctcctcataatcatcaacatgagaagatgaaaatccaagtttgtgatcagtgggagcagctaatgaagcagccttcaaggaccaccggccacccctatcatcaccattgtcatcatcaaaccatagcatgtggttgggagcagatgatgatcggttcgctgtcatcaccttcgagtcatggccctgatcacgagtcctttgctaaatttgctttaccgtcgacaataacaacagtgtcaacatcagtggtgatcatcatcagaattatgagaagattttgttgtcatcactagacatgacgagtttggatcacgacaagacatgtatgggatcatcatcggatggtggtatggtctctgatcttcacatggaatgtggtggattgagttttgagaccgaaaatatcctcgctttccaatgaacataattcaaggggttcgccaatttgttgattcgtgaattatacaaacattttatctatagatttatcacattatcaaacatgtaagttgtgtggcatttgggtatagggtttgtgtgattctaggtttttaggacgatgtatgttgttatatttagcgtgtttttaggatttattctcattttaaaattatatgaaaacccattactatgaatacaattagttttctttgttgtaaataatattttagattatcaaaaaaaaaaaaaaaa

SEQ ID NO: 408 - protein, 310 aa, Arabidopsis thaliana
  G509,NAC domain coordinates 13-169
MGLKDIGSKLPPGFRFHPSDEELVCHYLCNKIRAKSDHGDVDDDDDDVDEALKGSTDLVEIDLHICEPWELPDVAKLNAKEWYFFSFRDRKYATGYRTNRATVSGYWKATGKDRTVMDPRTRQLVGMRKTLVFYRNRAPNGIKTTWIMHEFRLECPNIPHKEDWVLCRVFNKGRDSSLQDNNYYNNDNQTQRLEVNDAPDLNYNNQLPPLLSSPPHNHQHEKMKIQVCDQWEQLMKQPSRTTGHPYHHHCHHQTIACGWEQMMIGSLSSPSSHGPDHESFAKFALPSTITTVSTSVVIIIRIMRRFCCHH

SEQ ID NO: 409 - DNA, 1462 bp, Arabidopsis thaliana
  G515,family:NAC
caaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagccaagctctaataaccagtattgataccgccgagaagaagaagaatccttatgatgatgcacaagggactgagattggtgagcataaattgggtcaagagacgatcaagaagaaaagagctggtttctttcacaggatgatacaaaaattcgtcaagaaaattcacctatgttcttccatctcaagaacttgataacaataaaagtgatcaataacaccttttctactttccaaattatttacaacagtacaagtgtatgctatgatgtctatcttggtttgtaactttaccatactgtatgtgtgatatgtataaaactggtaaatttgtgaagacaaatttgtatccattgacataataatgtctatcttgttttgttaaaaaaaaaaaaa

SEQ ID NO: 410 - protein, 394 aa, Arabidopsis thaliana
  G515,NAC domain coordinates 6-149
METPVGLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGGMREKSSSSPSSSGVSGIEQSRRDSLIPQLVNNSEGSSLHREDPSQFGDVLQEAPIEDAKLTEELVKWLMNDEDDAQIEDAIPIEEWETWLNDIDDAKEKSIMFMHDNRSDYRPPNSLTGVFSDDVSSDDNDSDLLTPKTNSIQTSSTCDSFGSSNHRIDQIKDLQESPTSTINLVSLTQEVSQALITSIDTAEKKKNPYDDAQGTEIGEHKLGQETIKKKRAGFFHRMIQKFVKKIHLCSSISRT

SEQ ID NO: 411 - DNA, 1053 bp, Arabidopsis thaliana
  G516,family:NAC
atggcgaatccggtgggttttagattccgtccgactgacggggagatcgtcgacatttacctccgaccgaaaaatctcgaaagtaacacgagccatgtcgatgaagtcattagcacagttgatatttgtagcttcgacccttgggacttaccttcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcggtgagaaaagggttttggtgtttaagaatcacggtggttccaagtccgattgggctatgcatgagtatcacgctacgttctcgtctcctaatcagggtgaaaggagagaattttcagttgctactggtagtggaattaagcatactcactctttaatccctcctaccaacaattctggagttttgagtgtagagacagagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactatttccattcaaactttaagcacttgtcctagttttggtagctcaaatcctctataccaaatcactgacttgcaggaatctcctaactcaatcaagttagtgtcattagctcaagaggtgagcaaaacaccgggaaccggtattgataatgatgcacaagggactgagattggtgagcataaattgggtcaagagacgatcaagaacaaaagagctggtttctttcacaggatgatacaaaaattcgtcaagaaaattcacctaagaacatga

SEQ ID NO: 412 - protein, 350 aa, Arabidopsis thaliana
  G516,NAC domain coordinates 6-141
MANPVGFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGERREFSVATGSGIKHTHSLIPPTNNSGVLSVETEGSLFHSQESQNPSQFSGFLDVDALDRDFCNILSDDFKGFFNDDDEQSKIVSMQDDRNNHTPQKPLTGVFSDHSTDGSDSDPISATTISIQTLSTCPSFGSSNPLYQITDLQESPNSIKLVSLAQEVSKTPGTGIDNDAQGTEIGEHKLGQETIKNKRAGFFHRMIQKFVKKIHLRT

SEQ ID NO: 413 - DNA, 1080 bp, Arabidopsis thaliana
  G517,family:NAC
atgatgaatccggtgggtttcagattccgtccaaacgacgaggagatcgtcgaccattacctccggccaaaaaatctcgatagtgacactagccatgtcgatgaagtcattagcacagtcgatatctgtagcttcgagccttgggatttaccttccaagtcgatgatcaaatcgagagatggggtttggtatttctttagtgttaaggagatgaagtataacagaggtgatcaacagagaagaagaacaaactctgggttttggaagaaaactggaaaaacaatgactgtcatgcgcaaaagaggaaatcgtgagaagatcggtgagaaaagggttttggtttttaagaatcgagatggttcaaagaccgactgggttatgcacgagtatcacgctacgtccttgtttcctaatcagatgatgacgtatacagtctgcaaagttgagtttaagggtgaagagacagagatctcttcttcttctactggtagtgaaattgaacagattcactctttaatccctcttgtgaacagttctggaggatctgagggttcgtcgtttcacagccaagaattacagaattcaagtcagtctggtgtctttgctaatgtgcagggagaatctcaaatcgatgatgcaactacaccgattgaggaggaatggaaaacatggttgaataatgatggtgatgagcagaggaatatcatgtttatgcaagatcatcgcagcgattacacacctctaaagtcgttaactggtgtcttcagtgatgatagcagtgatgataatgattctgatttgatatctcctaaaacaaattctattggaacttcgagcacttgtgctagttttgctagctcaaatcatcagatagaccaaactcaacattctcctgactcaacagtccagctagtgtcattaactcaagaggtgagccaaggtccgggtcaagtgactgtgattcgagagcataaattgggtgaagagtctgtcaagaagaaaagagctagtttcgtttacaggatgatacacagattagtcaagaaaattcaccaatgttattctatctcaagaacatga

SEQ ID NO: 414 - protein, 359 aa, Arabidopsis thaliana
  G517,NAC domain coordinates 6-153
MMNPVGFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGEETEISSSSTGSEIEQIHSLIPLVNSSGGSEGSSFHSQELQNSSQSGVFANVQGESQIDDATTPIEEEWKTWLNNDGDEQRNIMFMQDHRSDYTPLKSLTGVFSDDSSDDNDSDLISPKTNSIGTSSTCASFASSNHQIDQTQHSPDSTVQLVSLTQEVSQGPGQVTVIREHKLGEESVKKKRASFVYRMIHRLVKKIHQCYSISRT

SEQ ID NO: 415 - DNA, 1254 bp, Arabidopsis thaliana
  G519,family:NAC
cacaaagatcctccgattcgaaggtttataaaaactcaaaatcgaatcttatccacaagaaaacaacaaggtacttttccaaaaatgaaggcggagttgaatttgccggcgggattccgatttcatccgacggacgaagagcttgtcaagttctatctttgccggagatgtgcgtcagaaccgattaacgttccggttatcgcagagattgacttgtacaaattcaatccatgggagcttccagaaatggcgttgtacggtgagaaagaatggtacttcttctcgcatagagaccggaaatacccaaacgggtcgagaccaaaccgggcagctggaaccggttattggaaagcgactggagctgataaaccgatcggaaaaccgaagacgttagggattaagaaagcactcgtcttctacgcaggaaaagctccgaaagggattaaaacgaattggattatgcacgagtatcgtctcgctaatgtcgatcgatctgcttctaccaacaagaagaacaacttaagacttgatgattgggttttgtgtcggatatacaataagaaaggaacaatggagaagtatttaccggcggcggctgagaaaccgacggaaaagatgagtacgtcggactcaagatgctcaagtcacgtgatttcaccggacgtcacgtgttctgataactgggaggttgagagtgagcccaaatggattaatctggaagacgcgttagaggcatttaatgatgacacgtccatgtttagttccattggtttgttgcaaaatgacgcctttgttcctcagtttcagtaccagtcctccgatttcgtcgattcgtttcaggacccgttcgagcagaaaccgttcttgaattggaattttgctcctcaagggtaaaaataatcggcaaaaagttgaagcttttcagagtcttcgatcaccggcattgtgtcggatcctgacccggagaccaagtcgggtcatacgattacataatcgggttattgagatttccacatttggatttccgagactaaccaacttaacggattctggggtaattggggggttttgcacaggtgaatcacactgagtcagcaagtttcgattttttggttttgttttgtaatgattgattaaatgtctaaagatatcacgaagtagattcagaagaactgtaaaagcaattgtgaccacccgttatgaatcataaatatattcaatgaagcatgagcttattttttttttaaaaaaaaa

SEQ ID NO: 416 - protein, 269 aa, Arabidopsis thaliana
  G519,NAC domain coordinates 10-131
MKAELNLPAGFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRLANVDRSASTNKKNNLRLDDWVLCRIYNKKGTMEKYLPAAAEKPTEKMSTSDSRCSSHVISPDVTCSDNWEVESEPKWINLEDALEAFNDDTSMFSSIGLLQNDAFVPQFQYQSSDFVDSFQDPFEQKPFLNWNFAPQG

SEQ ID NO: 417 - DNA, 1071 bp, Arabidopsis thaliana
  G521,family:NAC
atggggaaaactaacttggcacctggttttcggtttcatccgactgatgttgaacttgtgagatactacttgaagaggaaagttatgggaaaaaagttccaagttgatgccattgctgaggtcgacatttacaagttcgaacctcctgatttacccgacaaatcatgtctagggactggagatcttaagtggtacttcttctgtccaagagaaaagaagtatcccaaaggcggtaaggcaaaccgctctactgaatgtggttactggaagaccacagggagagacagagatgtttcttataatgacgaagtcactgggaagataagaactctgatttatcactacgggaaaatacctcgcggtgatcggactgattgggtcatacatgaatatagacttgaagacaaagtactggctcaaaagaatgttcctcaggatacttatgtgctttgcgttctctttaagaaaaatggacttggaccaagacatggatctcaatatggtgctccatttaaggaagaggattggagtgataaggaagaagaatatactcagaatcatcttgtagctggtcctagtaaagaaaccagtctagctgctaaggcctcacactcgtacgctcctaaggatggtttgacaggagtgatctcagaatcttgcgtctctgatgtgccgccactaactgccacagtgcttccacctctaacaagtgatgttatagcttacaatcccttttcttcttcacctcttcttgaggttcctcaagtatctctcgatggtggcgagttaaattcgatgcttgatctcttttctgttgacaatgacgactgtttacttttcgacgatttcgactaccataatgaggtaagacatcctgatggttttgtaaacaaggaagctccggtgttcttaggagatggcaatttcagtggaatgtttgacctgagcaatgaccaagtcgtagagctacaggatctgatacagtcacccactcctcatcctccttctcctccagctcaagctagtattcctgatgactcaagaagcaacggtcagactaaggacgattaa

SEQ ID NO: 418 - protein, 356 aa, Arabidopsis thaliana
  G521,NAC domain coordinates 7-156
MGKTNLAPGFRFHPTDVELVRYYLKRKVMGKKFQVDAIAEVDIYKFEPPDLPDKSCLGTGDLKWYFFCPREKKYPKGGKANRSTECGYWKTTGRDRDVSYNDEVTGKIRTLIYHYGKIPRGDRTDWVIHEYRLEDKVLAQKNVPQDTYVLCVLFKKNGLGPRHGSQYGAPFKEEDWSDKEEEYTQNHLVAGPSKETSLAAKASHSYAPKDGLTGVISESCVSDVPPLTATVLPPLTSDVIAYNPFSSSPLLEVPQVSLDGGELNSMLDLFSVDNDDCLLFDDFDYHNEVRHPDGFVNKEAPVFLGDGNFSGMFDLSNDQVVELQDLIQSPTPHPPSPPAQASIPDDSRSNGQTKDD

SEQ ID NO: 419 - DNA, 1250 bp, Arabidopsis thaliana
  G522,family:NAC
cgtcgacgtgtcctatacacatatctataattccacaggttgaagaaaagaaataatggaatcggtggatcaatcatgtagtgttcctccgggattcagattccatccaacagatgaagagctcgttggttactatttaaggaaaaaagttgcatcgcaaaagatcgatcttgatgtcataagagatattgatctctacagaatcgaaccatgggatttacaagagagctgccgaatcggatatgaggaaagaaatgaatggtatttcttcagccacaaagataagaaatatccaacaggaacaagaacaaacagagcgaccatggctgggttttggaaagccacgggccgagacaaggctgtttacgacaagtcaaaactgattggtatgagaaaaacacttgtgttctacaaaggaagagcccctaatggccaaaaaaccgattggatcatgcatgaataccggctagagtcagatgagaatgcacctcctcaggaagaagggtgggtggtttgtagagcgttcaagaaaaagccaatgaccgggcaagccaagaacacagaaacttggagctcaagttacttttacgacgaattaccgagtggagtacgctcagttacggagcctcttaactacgtatctaagcagaaacaaaacgtttttgcacaagatttaatgttcaagcaagaactagaaggatcagatatcggtttaaacttcatccactgcgatcaattcattcaacttccgcagcttgaaagcccttcactccctcttaccaaaagaccagtgagcttgacgtcaattacatcattggagaagaataaaaatatctacaaaagacatttaatagaagaggatgtgagcttcaatgcgctaataagtagtggaaataaagataagaagaagaagaaaacatcagtgatgacgacggattggagagcactcgataaatttgttgcttctcaacttatgagccaagaagatggagtttcgggttttggaggtcatcatgaagaagataacaataaaatcggtcattacaataacgaagagagcaataacaagggatcagtagagactgcttcttccacgttattgagtgatagagaagaagagaacagattcatcagtggattattgtgttccaacttggactatgacttatatagggatttacatgtttgataaaagataacactataatatggtgcgtaacgtttgctatataggtaccgtagaatttagc

SEQ ID NO: 420 - protein, 377 aa, Arabidopsis thaliana
  G522,NAC domain coordinates 10-165
MESVDQSCSVPPGFRFHPTDEELVGYYLRKKVASQKIDLDVIRDIDLYRIEPWDLQESCRIGYEERNEWYFFSHKDKKYPTGTRTNRATMAGFWKATGRDKAVYDKSKLIGMRKTLVFYKGRAPNGQKTDWIMHEYRLESDENAPPQEEGWVVCRAFKKKPMTGQAKNTETWSSSYFYDELPSGVRSVTEPLNYVSKQKQNVFAQDLMFKQELEGSDIGLNFIHCDQFIQLPQLESPSLPLTKRPVSLTSITSLEKNKNIYKRHLIEEDVSFNALISSGNKDKKKKKTSVMTTDWRALDKFVASQLMSQEDGVSGFGGHHEEDNNKIGHYNNEESNNKGSVETASSTLLSDREEENRFISGLLCSNLDYDLYRDLHV

SEQ ID NO: 421 - DNA, 1179 bp, Arabidopsis thaliana
  G525,family:NAC
cttctctcttctcaaaaacccttccctcttcgtctccaaacaacaacaaacacaacaacaacaaaaatcttacaagaagatcatttttagaaaccctattaggataaaatggattacgaggcatcaagaatcgtcgaaatggtagaagatgaagaacatatagatctaccaccaggattcagatttcaccctactgatgaagaactcataactcactacctcaaaccaaaggttttcaacactttcttctctgctactgccattggtgaagttgatctcaacaagattgagccttgggacttaccatggaaggctaagatgggagaaaaagaatggtatttcttctgtgtgagagaccggaaatacccgaccggtttaaggacaaaccgggcgacagaagccggttattggaaagccacaggaaaagacaaagagatattcaagggaaaatcacttgtgggtatgaagaaaactttggttttctataaaggaagagctcctaaaggagttaaaaccaattgggttatgcatgaatatcgtttagaaggcaaatattgtattgaaaatcttccccaaacagctaagaacgaatgggttatatgtcgtgttttccaaaaacgtgccgatggtacaaaggttccaatgtcaatgcttgatccacacattaaccgaatggaaccagccggtttaccttcgttaatggattgttctcaacgagactccttcaccggttcgtcgtctcacgtgacctgcttctccgaccaagaaaccgaagacaaaagacttgtccacgagtccaaagacggttttggttctctgttttactcggatcctctgtttttacaagacaattattcgctaatgaagctgttgcttgacggtcaagaaactcaattctccggcaaacctttcgacggtcgtgattcgtccggtacagaagaattggattgcgtttggaatttctgagttgtataagttatgttgtagacttgtagtagtcatgtgttcgtgtgtgtgaatgaatattcttgttacatttttttgtaaaaaaggagaaaaaaatatgctagaaagtcaattgcttttgttatgtagcattagtgttttttatgtactcaatagacttcctaattaaataaaaatcttaatttatttgccaaaaaaaaaaaaaaaaaaaaa

SEQ ID NO: 422 - protein, 285 aa, Arabidopsis thaliana
  G525,NAC domain coordinates 23-167
MDYEASRIVEMVEDEEHIDLPPGFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRVFQKRADGTKVPMSMLDPHINRMEPAGLPSLMDCSQRDSFTGSSSHVTCFSDQETEDKRLVHESKDGFGSLFYSDPLFLQDNYSLMKLLLDGQETQFSGKPFDGRDSSGTEELDCVWNF

SEQ ID NO: 423 - DNA, 1481 bp, Arabidopsis thaliana
  G526,family:NAC
cgacccacgcgtccgagattctctcccagctagctttctcaattcatttttctttcttcatcttcttcttgtgtgatctctctttccaaataagcttatcattcttacaaaaatatttctgggtttctgatattgttcttgttctcttgaatctttattacttgaaaaacatataaagtgatggcggttgtggttgaagaaggtgtggtgttgaatcatggaggtgaagagcttgtggatttgccacctggtttcaggtttcatccaacagacgaagagatcataacatgttaccttaaggagaaggttttaaacagccgattcacggctgtggccatgggagaagctgatctcaacaagtgtgagccttgggatttgccaaagagggcaaagatgggggagaaagagttctacttcttctgtcaaagggacaggaagtatccgactgggatgaggacgaaccgtgcgacggagtcaggatactggaaagccaccgggaaggataaggagatcttcaaaggcaaaggttgtctcgttgggatgaagaaaacacttgtgttttatagaggaagagctccaaaaggtgaaaagactaattgggtcatgcatgaatatcgtcttgaaggcaaatattcgtattacaatctcccaaaatctgcaagggacgaatgggtcgtgtgtagggtttttcacaagaacaatccttctaccacaacccaaccaatgacgagaatacccgttgaagatttcacaaggatggattctctagagaacattgatcatctcctagacttctcatctcttcctcctctcatagacccgagtttcatgagtcaaaccgaacaaccaaacttcaaacccatcaaccctccaacttacgatatctcatcaccaatccaaccccatcatttcaattcttaccaatcaatctttaaccaccaggtttttggttctgcttcgggctctacgtacaacaacaacaacgagatgatcaagatggagcaatcacttgttagtgtatctcaagaaacatgcctaagctcagatgtgaacgcgaacatgactacaaccacggaggtatcttcgggtcctgtaatgaaacaagaaatggggatgatgggaatggtgaatggtagcaagtcgtatgaagatctatgtgacttgaggggggacttgtgggacttctaattaatcatttgactgtggtgaaagagtatatttgttgggatttaaatcatgttagttaatacatatacatataggatttactagaggcttaatcctagttaactattttcacttcattgatattatttaattagttgattgtttaattagtttatactttatagtgtggttaaaaaagaaaagaaaggattgtgataatttgggattttagtgcataagttatatctcaatgtaaactgtatttgtatccaaaaaaaaaaaaaaaaaaaaaaaaaaaaaaaaaaaaaaaaaaa

SEQ ID NO: 424 - protein, 335 aa, Arabidopsis thaliana
  G526,NAC domain coordinates 21-149
MAVVVEEGVVLNHGGEELVDLPPGFRFHPTDEEIITCYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPKGEKTNWVMHEYRLEGKYSYYNLPKSARDEWVVCRVFHKNNPSTTTQPMTRIPVEDFTRMDSLENIDHLLDFSSLPPLIDPSFMSQTEQPNFKPINPPTYDISSPIQPHHFNSYQSIFNHQVFGSASGSTYNNNNEMIKMEQSLVSVSQETCLSSDVNANMTTTTEVSSGPVMKQEMGMMGMVNGSKSYEDLCDLRGDLWDF

SEQ ID NO: 425 - DNA, 768 bp, Arabidopsis thaliana
  G536,family:GF14
atgtcgacaagggaagagaatgtttacatggcgaaattagccgaacaagctgaacgttacgaagaaatggttgaattcatggagaaagttgcgaaaactgttgatgttgaggaactttcagttgaagagaggaatcttctctctgttgcttacaagaacgtgattggagcgagaagagcttcgtggagaatcatttcttcgattgagcagaaagaagagagcaaagggaacgaagatcatgttgctattatcaaggattacagaggagagattgaatccgagcttagcaaaatctgtgatgggattttgaatgttcttgaagctcatcttattccttctgcttcaccagctgaatctaaagtgttttatcttaagatgaagggtgattatcataggtatcttgctgagtttaaggctggtgctgaaaggaaagaagctgctgaaagcactttggttgcttacaagtctgcttccgacattgccactgctgagttagctcctactcacccgataaggcttggtcttgcactcaacttctctgtgttttactatgaaatcctcaactcgcctgatcgtgcttgcagcctcgcaaagcaggcgtttgatgatgcaatcgctgagttagatacattgggtgaggaatcatacaaggacagtacactgattatgcagcttcttagagacaatctcactctctggacttcagatatgactgacgaagcaggagatgagattaaggaggcatcaaagcccgatggtgccgagtaa

SEQ ID NO: 426 - protein, 255 aa, Arabidopsis thaliana
  G536,GF14 domain coordinates 226-233
MSTREENVYMAKLAEQAERYEEMVEFMEKVAKTVDVEELSVEERNLLSVAYKNVIGARRASWRIISSIEQKEESKGNEDHVAIIKDYRGEIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTDEAGDEIKEASKPDGAE

SEQ ID NO: 427 - DNA, 890 bp, Arabidopsis thaliana
  G545,family:Z-C2H2
gcaaccttcaaactaaaactcgagagacaagaaatcctcagaatctttaacttaatggcgctcgaggctcttacatcaccaagattagcttctccgattcctcctttgttcgaagattcttcagtcttccatggagtcgagcactggacaaagggtaagcgatctaagagatcaagatccgatttccaccaccaaaacctcactgaggaagagtatctagctttttgcctcatgcttctcgctcgcgacaaccgtcagcctcctcctcctccggcggtggagaagttgagctacaagtgtagcgtctgcgacaagacgttctcttcttaccaagctctcggtggtcacaaggcaagccaccgtaagaacttatcacagactctctccggcggaggagatgatcattcaacctcgtcggcgacaaccacatccgccgtgactactggaagtgggaaatcacacgtttgcaccatctgtaacaagtcttttccttccggtcaagctctcggcggacacaagcggtgccactacgaaggaaacaacaacatcaacactagtagcgtgtccaactccgaaggtgcggggtccactagccacgttagcagtagccaccgtgggtttgacctcaacatccctccgatccctgaattctcgatggtcaacggagacgacgaagtcatgagccctatgccggcgaagaagcctcggtttgactttccggtcaaacttcaactttaaggaaatttacttagacgataagatttcgtttgtatactgttgagagttgtgtaggaatttgttgactgtacataccaaattggactttgactgattccaattcttcttgttctttcattttaaaaattattaaaccgattctttaccacaaa

SEQ ID NO: 428 - protein, 227 aa, Arabidopsis thaliana
  G545,Z-C2H2 domain coordinates 82-102,136-154
MALEALTSPRLASPIPPLFEDSSVFHGVEHWTKGKRSKRSRSDFHHQNLTEEEYLAFCLMLLARDNRQPPPPPAVEKLSYKCSVCDKTFSSYQALGGHKASHRKNLSQTLSGGGDDHSTSSATTTSAVTTGSGKSHVCTICNKSFPSGQALGGHKRCHYEGNNNINTSSVSNSEGAGSTSHVSSSHRGFDLNIPPIPEFSMVNGDDEVMSPMPAKKPRFDFPVKLQL

SEQ ID NO: 429 - DNA, 558 bp, Arabidopsis thaliana
  G546,family:RING/C3H2C3
atgactcgaccgtcaagattacttgagacggcggcgccaccaccacaaccgtcggaggagatgatcgcagcggaatccgacatggtggtgatcttgtcggctcttctttgcgctcttatctgcgttgctggtctcgccgccgtcgtacgatgcgcttggctccggcggtttacagccggaggagattcgccgtcaccgaacaaaggcttgaaaaagaaagctcttcagtctcttccaagatccactttcaccgccgcggaatcaacctccggcgccgccgctgaagagggagactcgacggaatgtgctatttgcctcactgacttcgccgacggtgaagaaataagagtgcttcctctttgtggtcattctttccacgtggagtgtattgacaaatggctagtttctaggtcttcttgtccttcttgtcgcaggattcttacgccggtgagatgtgaccggtgtggtcatgcttctacggcggagatgaaagatcaagctcatcgtcatcaacatcaccaacactcttctactaccattcctacgtttcttccttaa

SEQ ID NO: 430 - protein, 185 aa, Arabidopsis thaliana
  G546,RING/C3H2C3 domain coordinates 114-155
MTRPSRLLETAAPPPQPSEEMIAAESDMVVILSALLCALICVAGLAAVVRCAWLRRFTAGGDSPSPNKGLKKKALQSLPRSTFTAAESTSGAAAEEGDSTECAICLTDFADGEEIRVLPLCGHSFHVECIDKWLVSRSSCPSCRRILTPVRCDRCGHASTAEMKDQAHRHQHHQHSSTTIPTFLP

SEQ ID NO: 431 - DNA, 1275 bp, Arabidopsis thaliana
  G549,family:MISC
atggatcctgaaggtttcacgagtggcttattccggtggaacccaacgagagcattggttcaagcaccacctccggttccacctccgctgcagcaacagccggtgacaccgcagacggctgcttttgggatgcgacttggtggtttagagggactattcggtccgtacggtatacgtttctacacggcggcgaagatagcggagttaggttttacggcgagcacgcttgtgggtatgaaggacgaggagcttgaagagatgatgaatagtctctctcatatctttcgttgggagcttcttgttggtgaacggtacggtatcaaagctgccgttagagctgaacggagacgattgcaagaagaggaggaagaggaatcttctagacgccgtcatttgctactctccgccgctggtgattccggtactcatcacgctcttgatgctctctcccaagaagatgattggacagggttatctgaggaaccggtgcagcaacaagaccagactgatgcggcggggaataacggcggaggaggaagtggttactgggacgcaggtcaaggaaagatgaagaagcaacagcagcagagacggagaaagaaaccaatgctgacgtcagtggaaaccgacgaagacgtcaacgaaggtgaggatgacgacgggatggataacggcaacggaggtagtggtttggggacagagagacagagggagcatccgtttatcgtaacggagcctggggaagtggcacgtggcaaaaagaacggcttagattatctgttccacttgtacgaacaatgccgtgagttccttcttcaggtccagacaattgctaaagaccgtggcgaaaaatgccccaccaaggtgacgaaccaagtattcaggtacgcgaagaaatcaggagcgagttacataaacaagcctaaaatgcgacactacgttcactgttacgctctccactgcctagacgaagaagcttcaaatgctctcagaagagcgtttaaagaacgcggtgagaacgttggctcatggcgtcaggcttgttacaagccacttgtgaacatcgcttgtcgtcatggctgggatatagacgccgtctttaacgctcatcctcgtctctctatttggtatgttccaacaaagctgcgtcagctttgccatttggagcggaacaatgcggttgctgcggctgcggctttagttggcggtattagctgtaccggatcgtcgacgtctggacgtggtggatgcggcggcgacgacttgcgtttctag

SEQ ID NO: 432 - protein, 424 aa, Arabidopsis thaliana
  G549,MISC domain coordinates 1-395
MDPEGFTSGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSGTHHALDALSQEDDWTGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVAAAAALVGGISCTGSSTSGRGGCGGDDLRF

SEQ ID NO: 433 - DNA, 1374 bp, Arabidopsis thaliana
  G550,family:Z-Dof
atggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatag

SEQ ID NO: 434 - protein, 457 aa, Arabidopsis thaliana
  G550,Z-Dof domain coordinates 134-180
MADPAIKLFGKTIPLPELGVVDSSSSYTGFLTETQIPVRLSDSCTGDDDDEEMGDSGLGREEGDDVGDGGGESETDKKEEKDSECQEESLRNESNDVTTTTSGITEKTETTKAAKTNEESGGTACSQEGKLKKPDKILPCPRCNSMETKFCYYNNYNVNQPRHFCKKCQRYWTAGGTMRNVPVGAGRRKNKSPASHYNRHVSITSAEAMQKVARTDLQHPNGANLLTFGSDSVLCESMASGLNLVEKSLLKTQTVLQEPNEGLKITVPLNQTNEEAGTVSPLPKVPCFPGPPPTWPYAWNGVSWTILPFYPPPAYWSCPGVSPGAWNSFTWMPQPNSPSGSNPNSPTLGKHSRDENAAEPGTAFDETESLGREKSKPERCLWVPKTLRIDDPEEAAKSSIWETLGIKKDENADTFGAFRSSTKEKSSLSEGRLPGRRPELQANPAALSRSANFHESS

SEQ ID NO: 435 - DNA, 708 bp, Arabidopsis thaliana
  G551,family:HB
atggagtggtcaacaacgagcaacgtagaaaacgtgagagtagctttcatgccaccgccatggccggagtctagttcctttaactcgctccacagcttcaactttgatccttacgcaggaaattcatatacgcctggcgatacacaaaccggaccggttatctctgtaccggaatcagaaaagatcatgaatgcgtaccgatttccgaacaacaacaatgagatgataaaaaagaagagactaacgagtggacaattagcttcacttgagcgaagttttcaagaagagatcaaattagattcagacaggaaggtgaagctgtcgagagagctcggtctgcagccacgtcagatagcagtttggttccaaaaccgccgtgcacggtggaaggcgaagcagcttgagcagttgtacgactcgcttagacaagagtacgacgtcgtttctagggagaaacaaatgttacacgatgaggtgaagaagctgagagctttactaagagaccagggtttgatcaagaagcaaatctctgccgggaccatcaaagtttccggtgaggaagacacggtggagatttcatcggtggtggtagctcatccaagaacggagaatatgaacgcaaatcaaatcaccggagggaatcaagtttacggtcaatacaacaatccgatgctggttgcttcctctggctggccgtcatacccctga

SEQ ID NO: 436 - protein, 235 aa, Arabidopsis thaliana
  G551,HB domain coordinates 73-133
MEWSTTSNVENVRVAFMPPPWPESSSFNSLHSFNFDPYAGNSYTPGDTQTGPVISVPESEKIMNAYRFPNNNNEMIKKKRLTSGQLASLERSFQEEIKLDSDRKVKLSRELGLQPRQIAVWFQNRRARWKAKQLEQLYDSLRQEYDVVSREKQMLHDEVKKLRALLRDQGLIKKQISAGTIKVSGEEDTVEISSVVVAHPRTENMNANQITGGNQVYGQYNNPMLVASSGWPSYP

SEQ ID NO: 437 - DNA, 842 bp, Arabidopsis thaliana
  G557,family:bZIP
cagagatctgacggcggtagcagagtaatctattccttcccaaaatgtctcgcaattagattctttccaagttcttctgtaaatcccaagtcccgctcttttcctctttatccttttcaccagcttcgctactaagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgttaaaattatatgggatgtgagagctaatattgcaattgtagaccaagttctcttaaaaaaaaaaaaaaaaaaa

SEQ ID NO: 438 - protein, 168 aa, Arabidopsis thaliana
  G557,bZIP domain coordinates 90-150
MQEQATSSLAASSLPSSSERSSSSAPHLEIKEGIESDEEIRRVPEFGGEAVGKETSGRESGSATGQERTQATVGESQRKRGRTPAEKENKRLKRLLRNRVSAQQARERKKAYLSELENRVKDLENKNSELEERLSTLQNENQMLRHILKNTTGNKRGGGGGSNADASL

SEQ ID NO: 439 - DNA, 1638 bp, Arabidopsis thaliana
  G558,family:bZIP
ggaatttcggatcgtgtctctctctgtttctttgtttcaatccgatttcgaatcaagccctttacttgtgcaccttcaagatttcgttttttccagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatcagtttttaatttagcatttgaaaagttcaatgttgtttatatagcatcttcgattatcttagaaaggttattgaattttgtttttttttgttacttttgtgtgtggtaaaggtgttttaaccttgcaacttctgtactgtaatcatttaacaatattaagatgttctatttgagttttgt

SEQ ID NO: 440 - protein, 330 aa, Arabidopsis thaliana
  G558,bZIP domain coordinates 45-105
MADTSPRTDVSTDDDTDHPDLGSEGALVNTAASDSSDRSKGKMDQKTLRRLAQNREAARKSRLRKKAYVQQLENSRLKLTQLEQELQRARQQGVFISGTGDQAHSTGGNGALAFDAEHSRWLEEKNKQMNELRSALNAHAGDSELRIIVDGVMAHYEELFRIKSNAAKNDVFHLLSGMWKTPAERCFLWLGGFRSSELLKLLANQLEPMTERQLMGINNLQQTSQQAEDALSQGMESLQQSLADTLSSGTLGSSSSGNVASYMGQMAMAMGKLGTLEGFIRQADNLRLQTLQQMIRVLTTRQSARALLAIHDYFSRLRALSSLWLARPRE

SEQ ID NO: 441 - DNA, 1407 bp, Arabidopsis thaliana
  G559,family:bZIP
aaagttgctagctttaatttgccaacttactattcttatgtgtaataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggatatgggcaaacaggcagtccgcagcacgatcaaaagaaaggaagacgagatacatatttgagcttgagagaaaagtacagactttgcaaacagaggctacaactctctcagcccagttgaccctcttacagagagacacaaatggcttgactgttgaaaacaatgagctgaagctgcggttacaaacaatggagcagcaggttcacttgcaggatgaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggattttagggttttagctaacaca

SEQ ID NO: 442 - protein, 398 aa, Arabidopsis thaliana
  G559,bZIP domain coordinates 203-264
MDKEKSPAPPCGGLPPPSPSGRCSAFSEAGPIGHGSDANRMSHDISRMLDNPPKKIGHRRAHSEILTLPDDLSFDSDLGVVGNAADGASFSDETEEDLLSMYLDMDKFNSSATSSAQVGEPSGTAWKNETMMQTGTGSTSNPQNTVNSLGERPRIRHQHSQSMDGSMNINEMLMSGNEDDSAIDAKKSMSATKLAELALIDPKRAKRIWANRQSAARSKERKTRYIFELERKVQTLQTEATTLSAQLTLLQRDTNGLTVENNELKLRLQTMEQQVHLQDELNEALKEEIQHLKVLTGQVAPSALNYGSFGSNQQQFYSNNQSMQTILAAKQFQQLQIHSQKQQQQQQQQQQQHQQQQQQQQQYQFQQQQMQQLMQQRLQQQEQQNGVRLKPSQAQKEN

SEQ ID NO: 443 - DNA, 1413 bp, Arabidopsis thaliana
  G561,family:bZIP
aatttgtttttttttcttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattgatgtaatatggtttaagagattcggtgttctctggtgtgtgctgcaaccacataattggtgatagataggtttagttatataagcaaatgtattagagataaggggagacatatttgatggtcttt

SEQ ID NO: 444 - protein, 360 aa, Arabidopsis thaliana
  G561,bZIP domain coordinates 248-308
MGSNEEGNPTNNSDKPSQAAAPEQSNVHVYHHDWAAMQAYYGPRVGIPQYYNSNLAPGHAPPPYMWASPSPMMAPYGAPYPPFCPPGGVYAHPGVQMGSQPQGPVSQSASGVTTPLTIDAPANSAGNSDHGFMKKLKEFDGLAMSISNNKVGSAEHSSSEHRSSQSSENDGSSNGSDGNTTGGEQSRRKRRQQRSPSTGERPSSQNSLPLRGENEKPDVTMGTPVMPTAMSFQNSAGMNGVPQPWNEKEVKREKRKQSNRESARRSRLRKQAETEQLSVKVDALVAENMSLRSKLGQLNNESEKLRLENEAILDQLKAQATGKTENLISRVDKNNSVSGSKTVQHQLLNASPITDPVAAS

SEQ ID NO: 445 - DNA, 1554 bp, Arabidopsis thaliana
  G562,family:bZIP
atttgaatttctgggtttctctctgtttaagcttcttcttcttcatcttctgcttacgtttcttcttcaaggagctttcggattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttggtgttatggtttgttactgttaatatagagaggcttttctttttttataaaatggcttcctttgttgca

SEQ ID NO: 446 - protein, 382 aa, Arabidopsis thaliana
  G562,bZIP domain coordinates 253-315
MGNSSEEPKPPTKSDKPSSPPVDQTNVHVYPDWAAMQAYYGPRVAMPPYYNSAMAASGHPPPPYMWNPQHMMSPSGAPYAAVYPHGGGVYAHPGIPMGSLPQGQKDPPLTTPGTLLSIDTPTKSTGNTDNGLMKKLKEFDGLAMSLGNGNPENGADEHKRSRNSSETDGSTDGSDGNTTGADEPKLKRSREGTPTKDGKQLVQASSFHSVSPSSGDTGVKLIQGSGAILSPGVSANSNPFMSQSLAMVPPETWLQNERELKRERRKQSNRESARRSRLRKQAETEELARKVEALTAENMALRSELNQLNEKSDKLRGANATLLDKLKCSEPEKRVPANMLSRVKNSGAGDKNKNQGDNDSNSTSKFHQLLDTKPRAKAVAAG

SEQ ID NO: 447 - DNA, 1274 bp, Arabidopsis thaliana
  G565,family:bZIP
cgacagataacagagggcgcgaaacagagagaaaataagaagaagaaggacgatccagatatggaggatccttctaacccacgaccaaaccagagcaatctctcgcaatgcccgcctttagccacagctccgacacctgcgccagttcgtggtccgtaccaccggagagcacattcggaggtccaattccgtctccctgaagatctggatctctctgaaccattcggaggattcgatgagcttggatccgaagatgatctcttttgctcatacatggacattgagaaacttggatccggatccggatccgcatccgattcggctggtccttctgctcctaggtctgataacccgttttccgctgagaatggaggtgcggaggctgggaattcgggacctcgacacaggcatagcctctccgttgatggctcttcgactttggagtcaattgaggctaagaaagctatggctcctgataagctcgctgagctttgggtcgtcgaccctaaaagagctaaaaggataattgctaatcgacagtctgctgctcgttcgaaagagaggaaggctcggtatatcttggagctcgagaggaaagttcagaccttgcaaactgaagctactaccctttcagcacagttgtctttgttccagagagacacaactggtttgtcatctgagaatacagagctcaagcttcgtttacaggtcatggaacaacaagctaagttgcgagatgcactgaacgagcaactgaaaaaggaagttgagaggctgaaattcgccacgggagaagtctcacccgcggatgcttataacctcggaatggcacacatgcaatatcagcaacaaccacaacaatccttctttcaacatcatcatcagcaacaaaccgatgctcaaaacctgcaacaaatgactcatcagtttcatctcttccagcctaacaacaaccagaaccaatcttctcgcacaaaccctcccaccgctcatcagcttatgcatcacgctacttctaatgccccggctcaatctcattcctattcagaggcaatgcatgaagaccatcttggccggttacaggggcttgacattagcagctgtggcagaggctcaaactttggtaggtctgacaccgtcagtgaaagcagcagcactatgtgaggctgcctttcccagattcccctttgtcgataaacctattctttcgccctcccttgaaatctttagctaaaaagtaatatcttcgtgacagtcggattcagcggccgctc

SEQ ID NO: 448 - protein, 367 aa, Arabidopsis thaliana
  G565,bZIP domain coordinates NA
MEDPSNPRPNQSNLSQCPPLATAPTPAPVRGPYHRRAHSEVQFRLPEDLDLSEPFGGFDELGSEDDLFCSYMDIEKLGSGSGSASDSAGPSAPRSDNPFSAENGGAEAGNSGPRHRHSLSVDGSSTLESIEAKKAMAPDKLAELWVVDPKRAKRIIANRQSAARSKERKARYILELERKVQTLQTEATTLSAQLSLFQRDTTGLSSENTELKLRLQVMEQQAKLRDALNEQLKKEVERLKFATGEVSPADAYNLGMAHMQYQQQPQQSFFQHHHQQQTDAQNLQQMTHQFHLFQPNNNQNQSSRTNPPTAHQLMHHATSNAPAQSHSYSEAMHEDHLGRLQGLDISSCGRGSNFGRSDTVSESSSTM

SEQ ID NO: 449 - DNA, 1479 bp, Arabidopsis thaliana
  G567,family:bZIP
aaaaagaagaatcagaaagtgaaaaagagagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtgaaaatacagtctcatggcttatatatatatataagctctgtcttataacattacaagattcttatttgagaatcgtctttctatttatagctaataaaaaaaaaaaaaaaaa

SEQ ID NO: 450 - protein, 411 aa, Arabidopsis thaliana
  G567,bZIP domain coordinates 210-270
MNSIFSIDDFSDPFWETPPIPLNPDSSKPVTADEVSQSQPEWTFEMFLEEISSSAVSSEPLGNNNNAIVGVSSAQSLPSVSGQNDFEDDSRFRDRDSGNLDCAAPMTTKTVNVDSDDYRRVLKNKLEAECATGVSLRVGSVKPEDSTSSPETQLQPVQSSPLTQGELGVTSSLPAEVKKTGVSMKQVTSGSSREYSDDEDLDEENETTGSLKPEDVKKSRRMLSNRESARRSRRRKQEQTSDLETQVNDLKGEHSSLLKQLSNMNHKYDEAAVGNRILKADIETLRAKVKMAEETVKRVTGMNPMLLGRSSGHNNNNRMPITGNNRMDSSSIIPAYQPHSNLNHMSNQNIGIPTILPPRLGNNFAAPPSQTSSPLQRIRNGQNHHVTPSANPYGWNTEPQNDSAWPKKCVD

SEQ ID NO: 451 - DNA, 1294 bp, Arabidopsis thaliana
  G568,family:bZIP
gaccggctaaagtcaagaacctctctctgagctctcaccactttctctctctactccctctctgcgtgtaggatactactagacaattgacaaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcaaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtactaacttatacttgtattcttg

SEQ ID NO: 452 - protein, 284 aa, Arabidopsis thaliana
  G568,bZIP domain coordinates 215-265
MLSSAKHQRNHRLSATNKNQTLTKVSSISSSSPSSSSSSSSTSSSSPLPSQDSQAQKRSLVTMEEVWNDINLASIHHLNRHSPHPQHNHEPRFRGQNHHNQNPNSIFQDFLKGSLNQEPAPTSQTTGSAPNGDSTTVTVLYSSPFPPPATVLSLNSGAGFEFLDNQDPLVTSNSNLHTHHHLSNAHAFNTSFEALVPSSSFGKKRGQDSNEGSGNRRHKRMIKNRESAARSRARKQAYTNELELEVAHLQAENARLKRQQDQKMAAAIQQPKKNTLQRSSTAPF

SEQ ID NO: 453 - DNA, 1888 bp, Arabidopsis thaliana
  G571,family:bZIP
tagccgacctctcttctctcttctgaaaaaaacaccaaaggagctttaaatgctccgttacataatctctatctctttccaagaatatagagaaaggaaaataatatacaagaattaaaagaaggtatatcatcatctctctagctagtgatcaaagcaccgtcatcatcatcatatatcatcagcttgcctcagaggagaagaccaacataagagagatcgaagatcaaaatctatctctcttcatcatcttctgctgttactatcatatcacacgctctctcaaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaaccaaaaacaaaaacaagagaataggttgattagttagccgccagcttgacctctttatcatatatatcgtctctctactcaaatacagtgcaattagggaaaattgtttggcttctttttggtatatgattcttactattatgtttttaatcaaga

SEQ ID NO: 454 - protein, 460 aa, Arabidopsis thaliana
  G571,bZIP domain coordinates 160-220,441-452
MQGHHQNHHQHLSSSSATSSHGNFMNKDGYDIGEIDPSLFLYLDGQGHHDPPSTAPSPLHHHHTTQNLAMRPPTSTLNIFPSQPMHIEPPPSSTHNTDNTRLVPAAQPSGSTRPASDPSMDLTNHSQFHQPPQGSKSIKKEGNRKGLASSDHDIPKSSDPKTLRRLAQNREAARKSRLRKKAYVQQLESCRIKLTQLEQEIQRARSQGVFFGGSLIGGDQQQGGLPIGPGNISSEAAVFDMEYARWLEEQQRLLNELRVATQEHLSENELRMFVDTCLAHYDHLINLKAMVAKTDVFHLISGAWKTPAERCFLWMGGFRPSEIIKVIVNQIEPLTEQQIVGICGLQQSTQEAEEALSQGLEALNQSLSDSIVSDSLPPASAPLPPHLSNFMSHMSLALNKLSALEGFVLQADNLRHQTIHRLNQLLTTRQEARCLLAVAEYFHRLQALSSLWLARPRQDG

SEQ ID NO: 455 - DNA, 978 bp, Arabidopsis thaliana
  G578,family:bZIP
atgcatagtttgaatgaaacagtaattcctgatgttgattacatgcagtctgatagagggcatatgcatgctgctgcctctgattccagtgatcgatcaaaggataagttggatcaaaagacccttcgtaggcttgctcaaaatcgtgaggcagcaagaaaaagcagattgaggaagaaggcgtatgttcagcagctggaagatagtcgattaaagctgactcaagttgagcaggagctgcaaagagcaagacagcagggagttttcatctcaagttcaggagaccaagctcattctactggtggcaatggtggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcatctaagaatgatgtcttccacttgttatctggaatgtggaaaacaccagctgagcgatgtttcttgtggcttggcgggttcccgtcatccgaacttctcaagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatgggcaagttaggcaccctcgaaggattcatacgccaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtga

SEQ ID NO: 456 - protein, 325 aa, Arabidopsis thaliana
  G578,bZIP domain coordinates 36-96
MHSLNETVIPDVDYMQSDRGHMHAAASDSSDRSKDKLDQKTLRRLAQNREAARKSRLRKKAYVQQLEDSRLKLTQVEQELQRARQQGVFISSSGDQAHSTGGNGGALAFDAEHSRWLEEKNRQMNELRSALNAHAGDTELRIIVDGVMAHYEELFRIKSNASKNDVFHLLSGMWKTPAERCFLWLGGFPSSELLKLLANQLEPMTERQVMGINSLQQTSQQAEDALSQGMESLQQSLADTLSSGTLGSSSSDNVASYMGQMAMAMGKLGTLEGFIRQADNLRLQTLQQMLRVLTTRQSARALLAIHDYSSRLRALSSLWLARPRE

SEQ ID NO: 457 - DNA, 1054 bp, Arabidopsis thaliana
  G580,family:bZIP
ccaaaaaacaaagcattctatgctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcaactcttttgacttttgtactttttttcttctctacttaacctctattattgtaatgccaagtcaagtccttatctagctagtacatgagtttctgttttcactggttaagccat

SEQ ID NO: 458 - protein, 234 aa, Arabidopsis thaliana
  G580,bZIP domain coordinates 162-218
MLSSAKHNKINNHSAFSISSSSSSLSTSSSLGHNKSQVTMEEVWKEINLGSLHYHRQLNIGHEPMLKNQNPNNSIFQDFLNMPLNQPPPPPPPPSSSTIVTALYGSLPLPPPATVLSLNSGVGFEFLDTTENLLASNPRSFEESAKFGCLGKKRGQDSDDTRGDRRYKRMIKNRESAARSRARKQAYTNELELEIAHLQTENARLKIQQEQLKIAEATQNQVKKTLQRSSTAPF

SEQ ID NO: 459 - DNA, 1921 bp, Arabidopsis thaliana
  G581,family:HLH/MYC
ccaagatcatgacccaagtcaaccactctctctcataattcagacacagtactcaactttaaagacactcttttaagactttccatcaggaccaagctgagaaagagaaagcaataaagaaagaaagaaaaggaaataaagcttcaataccaaacccttctttaataaattttgccttttggttgtctcctctttatcaatcactttggttccatacttttaaattcagttcttcacgatatctagatatgtctttgacaatggctgatggtgtagaagctgcagcaggaagaagtaaaagacaaaacagcttattaagaaaacaacttgctttagctgtaagaagtgttcaatggagctacgcaatcttctggtcgtcttcacttactcaacctggggttttggagtggggagaaggatgttacaatggagatatgaagaagaggaagaagagttatgaatctcattataaatatgggttgcaaaaaagcaaggagcttcggaaactttatttgtctatgcttgaaggagacagtggtactactgttagtactactcatgataatctcaatgatgatgatgataattgtcacagtacaagtatgatgctgtcaccagatgacctctctgatgaagagtggtactatttagtctccatgtcctatgtcttctctccttcacaatgtttgcctggaagagcttcagcgacgggtgagaccatatggctctgcaacgctcaatatgcggagaacaagctcttctctcgttctttgttagcaagaagcgcatcaattcagactgttgtgtgtttcccttacttgggcggagtcattgagctgggcgtcactgaattgatttcagaagaccataacctgcttcgaaacatcaaatcttgcttgatggaaatatctgcacaccaagacaacgatgacgagaagaagatggagattaagatcagtgaagagaagcatcagcttccattaggtatttctgatgaagacttgcattacaaaagaaccatttcaacagtactcaactactccgcagatagatcaggtaagaacgataagaacattcgtcatcgtcagccaaatattgttacttctgaacctggctcaagtttcttgcggtggaagcaatgtgagcagcaagtctcgggttttgttcagaaaaaaaagtcacagaatgtgttgcggaagatattgcatgatgtccctttgatgcacacaaagagaatgttcccaagtcagaactctggtctgaatcaagatgatccttcagatagaagaaaagagaacgaaaagttcagtgtccttagaactatggttcccactgtcaacgaggttgataaagaatcgatactaaacaacacaatcaagtacctgcaagaactggaggcaagagtagaagagctagaatcttgtatgggatcagttaattttgtagaaagacaaagaaagacgacagagaaccttaacgactctgtgttgatcgaagagacatcagggaactacgatgatagcacgaagatcgatgacaattcaggagaaaccgaacaagtcactgttttcagagataagacacatttgagagttaaactcaaagaaacagaagttgtgatcgaagtaagatgttcttacagagactacatagttgcggacatcatggaaactctgagcaatcttcacatggatgctttctctgttagatctcacacgctcaataagttcctcacattgaatctcaaggccaagtttcgcggggctgcagttgcgtccgtaggaatgattaagcgagagctgagaagagtcattggtgatttgttttaatgttcttcttagtaaaaattcttatattttcttaaacttttgatgaaatgttatatttatctagactttcgtgaaccgatatgcgatgtgcc

SEQ ID NO: 460 - protein, 526 aa, Arabidopsis thaliana
  G581,HLH/MYC domain coordinates 330-387
MSLTMADGVEAAAGRSKRQNSLLRKQLALAVRSVQWSYAIFWSSSLTQPGVLEWGEGCYNGDMKKRKKSYESHYKYGLQKSKELRKLYLSMLEGDSGTTVSTTHDNLNDDDDNCHSTSMMLSPDDLSDEEWYYLVSMSYVFSPSQCLPGRASATGETIWLCNAQYAENKLFSRSLLARSASIQTVVCFPYLGGVIELGVTELISEDHNLLRNIKSCLMEISAHQDNDDEKKMEIKISEEKHQLPLGISDEDLHYKRTISTVLNYSADRSGKNDKNIRHRQPNIVTSEPGSSFLRWKQCEQQVSGFVQKKKSQNVLRKILHDVPLMHTKRMFPSQNSGLNQDDPSDRRKENEKFSVLRTMVPTVNEVDKESILNNTIKYLQELEARVEELESCMGSVNFVERQRKTTENLNDSVLIEETSGNYDDSTKIDDNSGETEQVTVFRDKTHLRVKLKETEVVIEVRCSYRDYIVADIMETLSNLHMDAFSVRSHTLNKFLTLNLKAKFRGAAVASVGMIKRELRRVIGDLF

SEQ ID NO: 461 - DNA, 2164 bp, Arabidopsis thaliana
  G583,family:HLH/MYC
ctatctctctctctctcattaaaaacgtgtttttttttaccggtcaccggtttatggaatgactgattaccggctacaaccaacgatgaatctttggaccaccgacgacaacgcttctatgatggaagctttcatgagctcttccgatatctcaactttatggcctccggcgtcgacgacaaccacgacggcgacgactgaaacaactccgacgccggcgatggagattccggcacaggcgggatttaatcaagagactcttcagcaacgtttacaagctttgattgaaggaacacacgaaggttggacctacgctatattctggcaaccgtcgtatgatttctccggcgcctccgtgctcggatggggagatggttattacaaaggtgaagaagataaagcaaacccgagacggagatcgagttcgccgccgttttctactccggcggatcaggagtacaggaaaaaagtgttgagagagcttaactcgttgatctccggtggtgttgctccgtcggatgacgctgttgatgaggaggtgacggatacggaatggtttttcttggtttcgatgacgcagagcttcgcttgcggtgcgggattagctggtaaagcgtttgcaacgggtaacgcggtttgggtttccgggtcagatcaattatccgggtcgggttgtgaacgggctaagcaaggaggagtgtttgggatgcatactattgcgtgtattccttcggcgaacggagttgtggaagtcgggtcaacggagccgatccgacagagttcggaccttattaacaaggttcgaattcttttcaatttcgacggcggagctggagatttatcgggtcttaattggaatcttgacccggatcaaggtgagaacgacccgtctatgtggattaatgacccgattggaacacctggatctaacgaaccgggtaacggagctccaagttctagctcccagcttttttcaaagtctattcagtttgagaacggtagctcaagcacaataaccgaaaacccgaatctggatccgactccgagtccggttcattctcagacccagaatccgaaattcaataacactttctcccgagaacttaatttttcgacgtcaagttctactttagtgaaaccaagatccggcgagatattaaacttcggcgatgaaggtaaacgaagctccggaaacccggatccaagttcttattcgggtcaaacacaattcgaaaacaaaagaaagaggtcgatggttttgaacgaagataaagttctatcattcggagataaaaccgccggagaatcagatcactccgatctagaagcttccgtcgtgaaagaagtagcagtagagaaacgtccaaagaaacgaggaagaaagccagcaaacggtagagaagagccactaaaccacgtcgaagcagagagacaaagacgcgagaaactaaaccaaagattctacgcgttacgagcggttgtaccaaacgtttcaaaaatggataaagcttcgttactcggtgacgcaatcgcttacatcaacgagcttaaatccaaagtagtcaaaacagagtcagagaaactccaaatcaagaaccagctcgaggaagtgaaactcgagctcgccggaagaaaagcgagtgctagtggaggagatatgtcgtcttcgtgttcttcgattaaaccggtggggatggagattgaagtgaagataattggttgggacgcaatgattagagttgaatctagtaagaggaatcatccggcggcgaggttgatgtcggcgttgatggatttggagttggaagtgaatcacgcgagtatgtcggtggttaacgatttgatgattcaacaagcgacggtgaagatgggttttaggatctatacgcaagaacagctcagagcaagtttgatttcaaaaatcggttaaaagggtgtgttttgggaagtttagaaagttatggggtcaaatcataattaattcgttttagtggcttcagtaattttgtagattttagttttgtaagaaaaaaatcttaaaatagagcgacaagtttcttcttttgctctatgtttgagtctgtatcgttttattgttgtatctcctcaatgagtaaacttgtatatattgatatgagtaatatgagttagttactgaaaaaaa

SEQ ID NO: 462 - protein, 623 aa, Arabidopsis thaliana
  G583,HLH/MYC domain coordinates 445-502
MTDYRLQPTMNLWTTDDNASMMEAFMSSSDISTLWPPASTTTTTATTETTPTPAMEIPAQAGFNQETLQQRLQALIEGTHEGWTYAIFWQPSYDFSGASVLGWGDGYYKGEEDKANPRRRSSSPPFSTPADQEYRKKVLRELNSLISGGVAPSDDAVDEEVTDTEWFFLVSMTQSFACGAGLAGKAFATGNAVWVSGSDQLSGSGCERAKQGGVFGMHTIACIPSANGVVEVGSTEPIRQSSDLINKVRILFNFDGGAGDLSGLNWNLDPDQGENDPSMWINDPIGTPGSNEPGNGAPSSSSQLFSKSIQFENGSSSTITENPNLDPTPSPVHSQTQNPKFNNTFSRELNFSTSSSTLVKPRSGEILNFGDEGKRSSGNPDPSSYSGQTQFENKRKRSMVLNEDKVLSFGDKTAGESDHSDLEASVVKEVAVEKRPKKRGRKPANGREEPLNHVEAERQRREKLNQRFYALRAVVPNVSKMDKASLLGDAIAYINELKSKVVKTESEKLQIKNQLEEVKLELAGRKASASGGDMSSSCSSIKPVGMEIEVKIIGWDAMIRVESSKRNHPAARLMSALMDLELEVNHASMSVVNDLMIQQATVKMGFRIYTQEQLRASLISKIG

SEQ ID NO: 463 - DNA, 2162 bp, Arabidopsis thaliana
  G584,family:HLH/MYC
aaaaagtcttctcttttataactacgtcagagaactgttatgtctccgacgaatgttcaagtaaccgattaccatctcaaccaatcaaaaacggatacaacaaatctctggtcaaccgacgacgatgcatcggtaatggaagctttcatcggcggcggctccgatcattcttctctttttcctccacttcctcctcctcctcttcctcaagtcaacgaagataatctccagcaacgtctccaagctttaatcgaaggagcaaacgagaactggacttacgccgtgttctggcaatcatctcacggtttcgccggagaagacaacaacaacaacaacacagtgttgttaggttggggagatggttattacaaaggagaagaagagaagtctagaaagaagaaatcaaatccagctagtgcagctgaacaagagcatcgtaagagagtgattagagagctcaactctttaatctccggtggtgtaggaggaggagatgaagctggagatgaagaagttacagatactgaatggttcttcttagtttcaatgacacagagctttgtcaagggtactggtttacctggtcaagctttctcaaattcagacacgatttggttatctggttctaatgctttagctggatcaagttgtgagagagctcgtcaaggtcagatttatgggttacaaacaatggtgtgtgtagcgacagagaatggtgtcgttgagcttggttcgtcggagattattcatcaaagttcagatcttgttgataaagttgacacctttttcaattttaacaatggtggtggtgaatttggttcttgggcgtttaatttgaatccagatcaaggagagaatgatccaggtttgtggattagtgaacctaatggtgttgactctggtcttgtagctgctccggtgatgaataatggtggaaatgactcaacttctaattctgattctcaaccaatttctaagctttgtaatggaagctctgttgaaaaccctaaccctaaagttctgaaatcttgtgaaatggtgaatttcaagaatgggattgagaatggtcaagaagaagatagtagtaataagaagagatcaccggtttcgaataatgaagaagggatgctttcttttacctctgttcttccatgtgactcgaatcactctgatcttgaagcttcagtggctaaagaagctgagagtaacagagttgtggttgaaccggagaagaaaccgaggaaacgagggagaaaaccggcgaatggaagagaagagcctttgaatcatgtagaggcagagagacagagaagagagaagttgaatcagagattctattctttaagagctgtggttcctaatgtgtctaagatggataaagcttctctattaggagatgctatttcgtatatcagtgagcttaagtctaagttgcaaaaggctgaatctgataaagaagagttgcagaagcagattgatgtgatgaataaagaagcgggaaatgcgaaaagttcggtaaaagatcgaaaatgtttgaatcaagaatcgagtgtgttgatagagatggaggttgatgtgaagattattggttgggatgcaatgataaggattcaatgtagtaagaggaatcatcctggtgctaagttcatggaagcacttaaggagttggatttggaagtgaatcatgcgagtttatcggtagtgaatgatcttatgatccaacaagcgactgtgaaaatggggaatcagtttttcacgcaagatcaactcaaggttgctctaacggagaaagttggagaatgtccatgaattgaagtcagcatctttagggctaatacaccggagaatactgcgaaaagtcgaaaacaacgatcatagtataagccgcggtaaaaagtgttaaacctttcacacaagtttctctagtgaatgtagttgtaaactctattgtgtaagggtaattttgtagtacccacttgttgctattgaatgcttgttagagaggattcttagtgtagtatatgattaggttggggtttgttgtttcatgagataaataaatgtgtttgatcaatggttaagtctttggtttgttggtgtatgtatgtaaataaggcttttgttagaaataagacaaatgggactgaagttggagtttaaaa

SEQ ID NO: 464 - protein, 589 aa, Arabidopsis thaliana
  G584,HLH/MYC domain coordinates 409-466
MSPTNVQVTDYHLNQSKTDTTNLWSTDDDASVMEAFIGGGSDHSSLFPPLPPPPLPQVNEDNLQQRLQALIEGANENWTYAVFWQSSHGFAGEDNNNNNTVLLGWGDGYYKGEEEKSRKKKSNPASAAEQEHRKRVIRELNSLISGGVGGGDEAGDEEVTDTEWFFLVSMTQSFVKGTGLPGQAFSNSDTIWLSGSNALAGSSCERARQGQIYGLQTMVCVATENGVVELGSSEIIHQSSDLVDKVDTFFNFNNGGGEFGSWAFNLNPDQGENDPGLWISEPNGVDSGLVAAPVMNNGGNDSTSNSDSQPISKLCNGSSVENPNPKVLKSCEMVNFKNGIENGQEEDSSNKKRSPVSNNEEGMLSFTSVLPCDSNHSDLEASVAKEAESNRVVVEPEKKPRKRGRKPANGREEPLNHVEAERQRREKLNQRFYSLRAVVPNVSKMDKASLLGDAISYISELKSKLQKAESDKEELQKQIDVMNKEAGNAKSSVKDRKCLNQESSVLIEMEVDVKIIGWDAMIRIQCSKRNHPGAKFMEALKELDLEVNHASLSVVNDLMIQQATVKMGNQFFTQDQLKVALTEKVGECP

SEQ ID NO: 465 - DNA, 2299 bp, Arabidopsis thaliana
  G585,family:HLH/MYC
ctctcaaacatttctctgtttgttccggcgaaaacggcaactgtttcatcaaatgacaaacacaaaaaccttaacatctagtttgtatcctctctgatacttcaaaaaaaatggatgaagaaacaatggctaccggacaaaacagaacaactgtgccagagaatctgaagaaacacctcgcagtttcagttcgaaacattcaatggagttatggtatcttttggtctgtctctgcttctcagtctggagttttagaatggggagatggatactataatggagatatcaaaacgaggaagacgattcaagcttcggagatcaaagctgatcagcttggtctacggaggagcgagcagcttagcgagctttacgagtctctctccgtcgctgaatcttcttcttcaggcgttgctgccggatctcaagtcaccagacgagcttccgccgccgcactttcaccggaagatctcgccgacaccgagtggtactatttggtttgtatgtctttcgtcttcaacattggtgaaggaatgcctggacggacgtttgcaaacggtgaaccgatatggttgtgcaacgctcatacggcggatagtaaagtgtttagccgttctcttctagcaaaaagtgctgcggttaagacagtggtttgcttcccgttccttggaggagtcgttgagattggtaccacagaacatattacggaagacatgaatgtaatacaatgcgtgaagacatcattcctcgaagcccctgatccgtacgctacaatattaccagcaagatccgattatcacatcgacaacgttcttgatccgcaacagattctaggcgacgagatttacgcgcctatgttcagtacggagccttttccaacagcttctccgagcagaactaccaacggtttcgatcaagaacatgaacaagtagcagatgatcatgattctttcatgaccgaaagaatcactggaggagcttctcaggtgcaaagctggcagctcatggacgacgagcttagtaactgcgttcaccagtcgctaaattccagcgattgcgtctctcaaacgtttgttgaaggggcggctggacgggttgcttacggtgcaagaaagagtagagttcaaagactagggcaaattcaagagcaacagagaaatgtgaagacattgtcatttgatccaagaaacgacgacgttcattaccaaagtgtgatctcaacgatttttaagaccaaccatcagttaattctcggaccgcagtttcgaaactgcgataaacagtcaagcttcactaggtggaagaaatcatcgtcatcatcatcaggaaccgccacggtcacggcaccatcacaaggaatgttaaagaaaattattttcgatgttccgcgagtgcaccagaaagagaagttaatgttggactcaccagaagccagagatgaaactgggaaccatgcggttttagagaagaagcgccgcgagaaattgaacgaacggttcatgaccttgagaaaaatcattccgtcaatcaacaagatcgataaagtatcgattcttgacgatacgatagagtatcttcaagaactcgagagacgggttcaagaactagaatcttgcagagaatcaaccgatacagagactcgtgggacgatgacgatgaagaggaagaaaccatgcgacgcaggagaaagaacatcagctaattgcgcaaataatgaaacaggaaatgggaagaaggtgtcggttaacaatgttggtgaagccgagccagcagataccggttttactggtttaaccgataatttaaggatcggttcgtttggtaatgaggtggttattgagcttagatgtgcttggagagaaggagtattgcttgagataatggatgtgattagtgatctccatttggattctcattcggttcaatcctcgaccggagacggtttgctctgcttaaccgtcaattgcaagcacaaggggtcaaaaatagcgacaccaggaatgatcaaagaagcacttcaaagggttgcatggatctgttgaagactacttagttaaaattgacagcaaagaaaaaacattcccggtttggtttctattctttggttttcttctaaccgggttttaggaattaatgttatgtttatcatttgttttttgttttttttttgtgtctttttttccgttgcttaacgtaggtgaagaggaacatacactatgcgtattttgtttgaggtagattattttaagggtattagtaatagtaatagccagtttagatgattttgtgttcttttgttgtt

SEQ ID NO: 466 - protein, 642 aa, Arabidopsis thaliana
  G585,HLH/MYC domain coordinates 439-496
MDEETMATGQNRTTVPENLKKHLAVSVRNIQWSYGIFWSVSASQSGVLEWGDGYYNGDIKTRKTIQASEIKADQLGLRRSEQLSELYESLSVAESSSSGVAAGSQVTRRASAAALSPEDLADTEWYYLVCMSFVFNIGEGMPGRTFANGEPIWLCNAHTADSKVFSRSLLAKSAAVKTVVCFPFLGGVVEIGTTEHITEDMNVIQCVKTSFLEAPDPYATILPARSDYHIDNVLDPQQILGDEIYAPMFSTEPFPTASPSRTTNGFDQEHEQVADDHDSFMTERITGGASQVQSWQLMDDELSNCVHQSLNSSDCVSQTFVEGAAGRVAYGARKSRVQRLGQIQEQQRNVKTLSFDPRNDDVHYQSVISTIFKTNHQLILGPQFRNCDKQSSFTRWKKSSSSSSGTATVTAPSQGMLKKIIFDVPRVHQKEKLMLDSPEARDETGNHAVLEKKRREKLNERFMTLRKIIPSINKIDKVSILDDTIEYLQELERRVQELESCRESTDTETRGTMTMKRKKPCDAGERTSANCANNETGNGKKVSVNNVGEAEPADTGFTGLTDNLRIGSFGNEVVIELRCAWREGVLLEIMDVISDLHLDSHSVQSSTGDGLLCLTVNCKHKGSKIATPGMIKEALQRVAWIC

SEQ ID NO: 467 - DNA, 1292 bp, Arabidopsis thaliana
  G590,family:HLH/MYC
tcgacagacactctccctctctccatgcccataaaatctcaaagactgtttaaaaaaaaaaatgttttagctttaactgctttttttttgttgttggtgtaatgatatcacagagagaagaaagagaagagaagaagcagagagtgatgggagataagaaattgatttcatcttcttcttcttcctcggtttacgatactcgtatcaatcatcatcttcatcatcctccgtcttcttccgacgaaatctctcagtttctccggcatattttcgaccgttcttctcctttaccttcttactactccccggcgacgactacaacgacggcgtctttgattggtgtgcacgggagcggtgacccacatgcagataactcgagaagtctcgtttctcatcatccaccgtcagattctgtgcttatgtcgaaacgtgtcggagatttctctgaggttttaatcggcggaggatcaggctcagccgccgcgtgttttggtttctccggtggtggtaataataacaacgttcaaggaaatagctctgggactcgagtatcgtcttcttccgttggagctagtggcaacgagacagatgagtatgactgtgaaagcgaggaaggaggagaagctgtagttgatgaagctccctcttccaagtcaggtccttcttctcgtagttcatctaaaagatgcagagctgctgaagttcataatctctctgagaagaggaggagaagtagaattaatgaaaaaatgaaagctttacaaagtctcatccctaattcaaataagacggataaggcttcaatgcttgatgaagccattgagtatctgaaacagcttcagctccaagttcagatgttgactatgagaaatggaataaacttgcatcctttgtgtttacctggaactacattacacccattgcaactctctcagattcgaccccctgaagcaaccaatgatcctctgcttaatcataccaatcagtttgcttcgacttctaatgcaccggaaatgatcaatactgtggcttcttcatacgctttggaaccttctattcgcagtcactttggacctttccctctccttacttcacccgtggagatgagtcgggaaggtgggttaactcatccaaggttgaacattggtcattccaacgcaaacataaccggggaacaagctctgtttgatggacaacctgacctaaaagatcgaattacttgaacagtgtcccaacttcgggatctctatgtgttcttgtttcttagaacgcaagccataaagctgtctgac

SEQ ID NO: 468 - protein, 373 aa, Arabidopsis thaliana
  G590,HLH/MYC domain coordinates 194-251
MISQREEREEKKQRVMGDKKLISSSSSSSVYDTRINHHLHHPPSSSDEISQFLRHIFDRSSPLPSYYSPATTTTTASLIGVHGSGDPHADNSRSLVSHHPPSDSVLMSKRVGDFSEVLIGGGSGSAAACFGFSGGGNNNNVQGNSSGTRVSSSSVGASGNETDEYDCESEEGGEAVVDEAPSSKSGPSSRSSSKRCRAAEVHNLSEKRRRSRINEKMKALQSLIPNSNKTDKASMLDEAIEYLKQLQLQVQMLTMRNGINLHPLCLPGTTLHPLQLSQIRPPEATNDPLLNHTNQFASTSNAPEMINTVASSYALEPSIRSHFGPFPLLTSPVEMSREGGLTHPRLNIGHSNANITGEQALFDGQPDLKDRIT

SEQ ID NO: 469 - DNA, 1240 bp, Arabidopsis thaliana
  G591,family:HLH/MYC
gtaaatctctctttgaaggttcctaactcgttaatcgtaactcacagtgactcgttcgagtcaaagtctctgtctttagctcaaaccatggctagtaacaaccctcacgacaacctttctgaccaaactccttctgatgatttcttcgagcaaatcctcggccttcctaacttctcagcctcttctgccgccggtttatctggagttgacggaggattaggtggtggagcaccgcctatgatgctgcagttgggttccggagaagaaggaagtcacatgggtggcttaggaggaagtggaccaactgggtttcacaatcagatgtttcctttggggttaagtcttgatcaagggaaaggacctgggtttcttagacctgaaggaggacatggaagtgggaaaagattctcagatgatgttgttgataatcgatgttcttctatgaaacctgttttccacgggcagcctatgcaacagccacctccatcggccccacatcagcctacttcaatccgtcccagggttcgagctaggcgtggtcaggctactgatccacatagcatcgctgagcggctacgtagagaaagaatagcagaacggatcagggcgctgcaggaacttgtacctactgtgaacaagaccgatagagctgctatgatcgatgagattgtcgattatgtaaagtttctcaggctccaagtcaaggttttgagcatgaaccgacttggtggagccggtgcggttgctccacttgttactgatatgcctctttcatcatcagttgaggatgaaacgggtgagggtggaaggactccgcaaccagcgtgggagaaatggtctaacgatgggactgaacgtcaagtggctaaactgatggaagagaacgttggagccgcgatgcagcttcttcaatcaaaggctctttgtatgatgccaatctcattggcaatggcaatttaccattctcaacctccggatacatcttcagtggtcaagcctgagaacaatcctccacagtaggatttctgcaataaagagtttgtacagctaatccaactgtccaacatgggtttttcttctgctctaatgactctggtttcttctctcctctctcaccgacttgaaaggtaaaaaagtgaaaaaggctttgtagatggaatcaatgtaggatttgcagtagagggcaaaaaaatgtcatatagctcaattgatcaagtcttaaaaaaaaaaaaaaaaaaaa

SEQ ID NO: 470 - protein, 310 aa, Arabidopsis thaliana
  G591,HLH/MYC domain coordinates 149-206
MASNNPHDNLSDQTPSDDFFEQILGLPNFSASSAAGLSGVDGGLGGGAPPMMLQLGSGEEGSHMGGLGGSGPTGFHNQMFPLGLSLDQGKGPGFLRPEGGHGSGKRFSDDVVDNRCSSMKPVFHGQPMQQPPPSAPHQPTSIRPRVRARRGQATDPHSIAERLRRERIAERIRALQELVPTVNKTDRAAMIDEIVDYVKFLRLQVKVLSMNRLGGAGAVAPLVTDMPLSSSVEDETGEGGRTPQPAWEKWSNDGTERQVAKLMEENVGAAMQLLQSKALCMMPISLAMAIYHSQPPDTSSVVKPENNPPQ

SEQ ID NO: 471 - DNA, 1413 bp, Arabidopsis thaliana
  G592,family:HLH/MYC
aagctattaagatttggttttctacaaatttgttcttcctgaaacgtcacgagacagagcttacaagaagagaaaacagaggaaatttcgttgcattttttttacatattgattcgattaatggattcaaataatcatctctacgacccgaatcccaccgggtcgggtcttcttcgttttagatcagctccgagctctgttctcgccgcttttgttgacgacgacaagattggtttcgactccgataggttgctttcaagattcgtgacctctaatggcgttaacggagatctgggttcacctaaattcgaggataagtctccggtttcgttaacgaacacctctgtttcatacgccgccactctgccgccaccgccgcagcttgagccgtcgagttttctgggtttgccgccgcattacccgaggcagagtaaagggataatgaactcggttggtttggatcagtttctcggtatcaataatcatcacaccaaaccagttgaatctaatcttctccgtcaaagcagctctccagccggaatgtttactaatctctctgaccaaaacggttatggttcaatgaggaatttgatgaattacgaagaagatgaagagagtccatctaattccaatggattaagacgccattgcagtctctcttcaaggccaccttcttcacttggaatgctttctcaaatacctgaaatcgcacccgaaactaattttccatatagccattggaatgatccatccagctttattgataacttatcctcacttaaaagagaagccgaggacgatggaaaattgtttctcggagctcagaacggagagtccgggaatcgtatgcagttactgtcgcatcatttgagcctaccaaagtcatcatcgacagcctcggacatggtttcagtggataagtatcttcagctacaagattctgttccttgtaaaatcagagccaaacgtggttgcgctacacatcctcgaagcatcgctgaacgggtaagaagaacgcggataagcgagcgaatgaggaagttacaagagcttgttcctaacatggacaagcaaaccaacacttcggatatgttggatttagctgtggattacatcaaagatttacaaagacagtataagattttaaacgacaacagagctaactgtaagtgtatgaacaaggagaagaagtcaatatagggcgcaacaaagtgtgtagtagataggactaaaaagcagggagaaggacaagaaagaaacaatgtcatgtctgaatattttttagccgaaacagaccaaattgtctatgtaagctctcgagaaaagcatctgcttccaacaaaattctaagtaataaaatagtactcgatttgttcttatttcattattacaatgcagaatctactaatcaaa

SEQ ID NO: 472 - protein, 359 aa, Arabidopsis thaliana
  G592,HLH/MYC domain coordinates 282-340
MDSNNHLYDPNPTGSGLLRFRSAPSSVLAAFVDDDKIGFDSDRLLSRFVTSNGVNGDLGSPKFEDKSPVSLTNTSVSYAATLPPPPQLEPSSFLGLPPHYPRQSKGIMNSVGLDQFLGINNHHTKPVESNLLRQSSSPAGMFTNLSDQNGYGSMRNLMNYEEDEESPSNSNGLRRHCSLSSRPPSSLGMLSQIPEIAPETNFPYSHWNDPSSFIDNLSSLKREAEDDGKLFLGAQNGESGNRMQLLSHHLSLPKSSSTASDMVSVDKYLQLQDSVPCKIRAKRGCATHPRSIAERVRRTRISERMRKLQELVPNMDKQTNTSDMLDLAVDYIKDLQRQYKILNDNRANCKCMNKEKKSI

SEQ ID NO: 473 - DNA, 1292 bp, Arabidopsis thaliana
  G594,family:HLH/MYC
agaaaagataagagccttttaaagttttttttttaccttctcttcatggacttgtctgtacttgataggcttaagtggctgcaacagcaacaaatggtttcacctgagtttcttcagatacttggctcagatgggagagaagagctcaaaagagttgagagttacttgggaaacaacaatgatgagctgcagagtttcagacattttcccgaattcggaccggattatgatactactgatggctgcatttctaggacaagtagcttccatatggagccagtgaagaataatggacacagcagagccattaccttgcagaacaagagaaaaccagagggtaagacagaaaagagagagaagaagaagatcaaagcagaggatgaaacagagccaagcatgaaagggaaatcaaacatgagtaacacagagacatcttcagaaattcagaaaccagattacattcatgttagggctagacgaggtgaagccaccgacagacatagcttagcagagagggcaagaagagaaaagataagcaagaagatgaaatgtctacaagatattgttcctggatgcaacaaagttactggaaaagctggtatgcttgatgagatcatcaactatgtccaatctctgcaacaacaagtcgagttcttgtcgatgaaactctctgtcataaatccagaacttgagtgtcatatcgatgatttatccgcaaaacagtttcaggcttacttcacaggtcctccagaaggtgactcgaagcagtcaatcatggcggattttcggtcttttccattacatcagcaaggatctttagattactcagtcataaactcagaccacaccacatctctcggcgctaaagatcatacatcatcaagctgggaaactcactcacagtgtctttacaacagcttgagaaccgattctgtttccaatttcttcagcctcaagtaaaaaaattagggatagcctcattaaaaaaatcgcggttttttgttgttgtcttatccatttatctatcttatctgaaatttgaaccagaaagacagaggaaaccaatccaaagatctttctcaatctattatcttcatacaaatatagtgatttacatatattccaggggatatgtatatgtgtagaagaaagagaaaaaactcttgtggtcatagcaattcctttttttgtacattgtagaatcaaactcttgtggtcgtaacaattatttccttcacaaattacaactacacttgtattaatggagatgccttttggccctgggatcaaca

SEQ ID NO: 474 - protein, 304 aa, Arabidopsis thaliana
  G594,HLH/MYC domain coordinates 144-202
MDLSVLDRLKWLQQQQMVSPEFLQILGSDGREELKRVESYLGNNNDELQSFRHFPEFGPDYDTTDGCISRTSSFHMEPVKNNGHSRAITLQNKRKPEGKTEKREKKKIKAEDETEPSMKGKSNMSNTETSSEIQKPDYIHVRARRGEATDRHSLAERARREKISKKMKCLQDIVPGCNKVTGKAGMLDEIINYVQSLQQQVEFLSMKLSVINPELECHIDDLSAKQFQAYFTGPPEGDSKQSIMADFRSFPLHQQGSLDYSVINSDHTTSLGAKDHTSSSWETHSQCLYNSLRTDSVSNFFSLK

SEQ ID NO: 475 - DNA, 1538 bp, Arabidopsis thaliana
  G597,family:AT-hook
aaaattctcctgtaaaatttaatattataaaagtggtttctttttcatttatgtttatataattttcatctttaatcttaaattctggtaaccttaatgcgcgatccgcttttctaaagttttgtgagagagaagagatctaaaaaaatccacaattttgttcaaatcttggagttaaatgctgaattttaggccttgttgcttagatttatggcttaaagtttcaaacttttcattggatatgtgagaagaaaatgtcaggatctgagacgggtttaatggcggcgaccagagaatcaatgcaatttacaatggctctccaccagcagcagcaacacagtcaagctcaacctcagcagtctcagaacaggccattgtcattcggtggagacgacggaactgctctttacaagcagccgatgagatcagtatcaccaccgcagcagtaccaacccaactcagctggtgagaattctgtcttgaacatgaacttgcccggaggtgagtctggaggcatgactggaactggaagtgagccagtgaaaaagaggagaggtagaccgaggaaatatgggcctgatagtggtgaaatgtcacttggtttgaatcctggagctccttctttcactgtcagccaacctagtagcggcggcgatggaggagagaagaagagaggaagacctcctggttcttctagcaaaaggctcaagcttcaagctttaggctcgactggaatcggatttacgcctcatgtacttaccgtgctggctggagaggatgtatcatccaagataatggcgttaactcataatggaccccgtgctgtgtgtgtcttgtctgcaaatggagccatctccaatgtgactctccgccagtctgccacatccggtggaactgttacatatgaggggagatttgagattctgtctttatcgggatctttccatttgctggagaacaatggtcaaagaagcaggacgggaggtctaagcgtgtcattatcaagtccggatggtaatgtcctcggtggcagtgtagctggtcttcttatagcagcatcacctgttcagattgttgttgggagtttcttaccagacggagaaaaagaaccaaaacagcatgtgggacaaatgggactgtcgtcacccgtattaccgcgtgtggccccaacgcaggtgctgatgactccaagtagcccacaatctcgaggcacaatgagtgagtcatcttgtggaggaggacatggaagccctattcatcagagcactggaggaccttacaataacaccattaacatgccctggaagtagccaagtgatctgtgtcggcttaaaaccaacaacttcccgttattagagtgatttatttctacatttggtttagactttctagttctgatggttatttctacagttggtttagactttctagttctgttcagacaaaaggagtttgataaattgaccgacctattttgtgtgtttgaggtactttcagaaccataggtgttcagaaattagaatgttctgtttaaaaaa

SEQ ID NO: 476 - protein, 351 aa, Arabidopsis thaliana
  G597,AT-hook amino acids 97-105,137-144,DUF296 163-278
MSGSETGLMAATRESMQFTMALHQQQQHSQAQPQQSQNRPLSFGGDDGTALYKQPMRSVSPPQQYQPNSAGENSVLNMNLPGGESGGMTGTGSEPVKKRRGRPRKYGPDSGEMSLGLNPGAPSFTVSQPSSGGDGGEKKRGRPPGSSSKRLKLQALGSTGIGFTPHVLTVLAGEDVSSKIMALTHNGPRAVCVLSANGAISNVTLRQSATSGGTVTYEGRFEILSLSGSFHLLENNGQRSRTGGLSVSLSSPDGNVLGGSVAGLLIAASPVQIVVGSFLPDGEKEPKQHVGQMGLSSPVLPRVAPTQVLMTPSSPQSRGTMSESSCGGGHGSPIHQSTGGPYNNTINMPWK

SEQ ID NO: 477 - DNA, 1226 bp, Arabidopsis thaliana
  G598,family:DBP
gtccgttgtcatattttaaatttatcaccttcttgagaattccacatttttatcctttttgtcatgtagtgtatattttttcctctaacctaattaaaatcaaaacaaaatcctttgacccaattagcttcgcgatatatcagaagagatcaaactactttgatcagaccatgatcttcttcttcttcttcttcttcttcttcttctttttagacgatcacaattcctaaaccctatttctcagattatgctgactctttaccatcaagaaaggtcaccggacgccacaagtaatgatcgcgatgagacgccagagactgtggttagagaagtccacgcgctaactccagcgccggaggataattcccggacgatgacggcgacgctacctccaccgcctgctttccgaggctatttttctcctccaaggtcagcgacgacgatgagcgaaggagagaacttcacaactataagcagagagttcaacgctctagtcatcgccggatcctccatggagaacaacgaactaatgactcgtgacgtcacgcagcgtgaagatgagagacaagacgagttgatgagaatccacgaggacacggatcatgaagaggaaacgaatcctttagcaatcgtgccggatcagtatcctggttcgggtttggatcctggaagtgataatgggccgggtcagagtcgggttgggtcgacggtgcaaagagttaagagggaagaggtggaagcgaagataacggcgtggcagacggcaaaactggctaagattaataacaggtttaagagggaagacgccgttattaacggttggtttaatgaacaagttaacaaggccaactcttggatgaagaaaattgagtataatgtaggttcattcaacaatcgtctaaatgaggaagctagaggagagaaaagcaaaagcgatggagaaaacgcaaaacaatgtggcgaaagcgcagaggaaagcggaggagagaagagcgacggcagaggcaaagagagggacagaggttgcaaaagtagttgaagttgctaatctcatgagagcccttggacgtcctcctgccaaacgctccttcttctctttctcctaatttttagttatatcaaaccattaaattaaacagtactcgttatatatctagttagtaaacaaaggggcagttttatagctcatgtacacataattgagagtgtagtactgttgtgtcaaa

SEQ ID NO: 478 - protein, 263 aa, Arabidopsis thaliana
  G598,DBP domain coordinates 205-263
MLTLYHQERSPDATSNDRDETPETVVREVHALTPAPEDNSRTMTATLPPPPAFRGYFSPPRSATTMSEGENFTTISREFNALVIAGSSMENNELMTRDVTQREDERQDELMRIHEDTDHEEETNPLAIVPDQYPGSGLDPGSDNGPGQSRVGSTVQRVKREEVEAKITAWQTAKLAKINNRFKREDAVINGWFNEQVNKANSWMKKIEYNVGSFNNRLNEEARGEKSKSDGENAKQCGESAEESGGEKSDGRGKERDRGCKSS

SEQ ID NO: 479 - DNA, 1380 bp, Arabidopsis thaliana
  G600,family:DBP
atggagtctgtacggtgtccacctcccaaggctctatctcctactacatctgctgcatctggaggcgaaaagaaaccagctcctagtaacaacaatgagacttcaactctaaagccgtcaatagaaatagcagagatcacaagtgcttgggcgtctgcagaaatagttaaagtggaaaagccagttgatgcatctgcaaacattcaaggatcctcaaatggcaaggaagcagcagtttcacaactgaatacgcagccccccaaggaagaaatgccgcagcaggttgcttctggggagcaagcaggaaaaaggaagaagaagaaacctcggatgagtggaaccgatctagcaggccctgactatatgatgcccatgggcccaggtcccggtaatcagtacttcaatggtttccaacccggcttcaacggcgttcaacatgggttcaatggcgttcaacctgggttcaatggctttcatcatggtttcaatgggtttccaggcccttttcctggtgcgatgcctccttttgttggctatggatttggcggtgtgatccatccagatcctttcgctgcacagggctttgggttccctaatataccaccaccttatagggaccttgcggagatggggaatcgtatgaatctccagcatcctataatggggagagaagaatttgaagctaagaaaactgagatgaaaagaaagcgtgaaaacgagattcgacgatcggaaggagggaatgtcgtcagggacagtgaaaagagcagaataatgaacaactcggcagtcacttcctcacccgtgaagccaaaatctagacaaggacctccgccgccgatttcgtctgattacgaccgtcgcaggcgatcggatagatcgtcaccggagcgtcagtcatctcgaaggttcacctctcctcctcgatcatccagcaggaaatctgagcgtgatcgtcaccatgacctcgattccgaacacgaccgccgccgtgaccgtcccagagagacagatcgcaagcaccgtaagagatccgaaaagtcatcatcggatccaactgtagagatagacgataacaataagtctaacgtgttcactcggataagctttccagaggaatcttctggcaaacaacgaaagacatcaaagtcttctccagcgcctccagagagctcagtcgccccagtttcatcgggtcgtcgtcatcacagtcgaagagaaagagagatggtggaatacgattcaagtgatgatgaagacagacatttcaagaggaagccatcaaggtacaagcgatctccttcggttgcaccttctgacgccggtgatgagcatttccgtcattctaagcgatctaaaggagaaagagcgcgagcttga

SEQ ID NO: 480 - protein, 459 aa, Arabidopsis thaliana
  G600,DBP domain coordinates 115-290
MESVRCPPPKALSPTTSAASGGEKKPAPSNNNETSTLKPSIEIAEITSAWASAEIVKVEKPVDASANIQGSSNGKEAAVSQLNTQPPKEEMPQQVASGEQAGKRKKKKPRMSGTDLAGPDYMMPMGPGPGNQYFNGFQPGFNGVQHGFNGVQPGFNGFHHGFNGFPGPFPGAMPPFVGYGFGGVIHPDPFAAQGFGFPNIPPPYRDLAEMGNRMNLQHPIMGREEFEAKKTEMKRKRENEIRRSEGGNVVRDSEKSRIMNNSAVTSSPVKPKSRQGPPPPISSDYDRRRRSDRSSPERQSSRRFTSPPRSSSRKSERDRHHDLDSEHDRRRDRPRETDRKHRKRSEKSSSDPTVEIDDNNKSNVFTRISFPEESSGKQRKTSKSSPAPPESSVAPVSSGRRHHSRREREMVEYDSSDDEDRHFKRKPSRYKRSPSVAPSDAGDEHFRHSKRSKGERARA

SEQ ID NO: 481 - DNA, 720 bp, Arabidopsis thaliana
  G602,family:DBP
ataaaatctgttcttcttcttcggctgagagacaatggcggaggagcaaaagacgagtaaggttgacgtagaatctccggctgttttagctccggcgaaggaaccgactcctgctccggtggaagtcgcggatgagaaaattcataatccacctcccgtcgagtccaaagctcttgccgttgtagaaaaacccatcgaggagcatacacctaagaaagcttcatctggttcggccgatagagatgtgatacttgccgacttggaaaaagagaagaaaacgtcattcatcaaagcatgggaagagagtgagaagtcaaaggctgagaacagggcacaaaagaagatctctgatgtgcatgcttgggaaaatagcaagaaagcagccgtagaagctcaacttaggaagatcgaggaaaaattagagaagaaaaaagcgcagtacggtgagaaaatgaagaacaaagtagctgcaatccacaagttagcagaagagaagagagcaatggttgaagctaaaaaaggagaagagcttctcaaagctgaagaaatgggtgctaagtatagagccactggtgtagtaccaaaggcaacgtgtggatgtttctaagcctttattgaatttgtatctttgtaacaattcatctctgtttctttcttcttcttttgtttttgtgtgattcaacaactctttttagtttttgttatttgtttggaaaaaaa

SEQ ID NO: 482 - protein, 190 aa, Arabidopsis thaliana
  G602,DBP domain coordinates 110-162
MAEEQKTSKVDVESPAVLAPAKEPTPAPVEVADEKIHNPPPVESKALAVVEKPIEEHTPKKASSGSADRDVILADLEKEKKTSFIKAWEESEKSKAENRAQKKISDVHAWENSKKAAVEAQLRKIEEKLEKKKAQYGEKMKNKVAAIHKLAEEKRAMVEAKKGEELLKAEEMGAKYRATGVVPKATCGCF

SEQ ID NO: 483 - DNA, 1263 bp, Arabidopsis thaliana
  G605,family:AT-hook
aattccatcctaataattttcaaagctttaattctaagaaataatatctacaagaaaatattatctcatgtatggagactaccggagaagttgttaaaacaaccaccgggagcgacggaggcgttacggtggtgagatccaacgcgccgtcagacttccacatggctccgaggtcagaaacttcaaacacacctcccaactccgtcgctcctcctcctcctccaccgccgcaaaactcctttactccgtcggcggctatggatggtttctcaagcggaccgataaagaagagacgtgggcgccctaggaagtacggacacgacggagcagcggtgacgctatctccgaatccgatatcatcagccgcaccaacgacttctcacgtcatcgatttctcgacgacatcggagaaacgtggcaaaatgaaaccagcaactccaactccaagctcattcatcaggccaaagtaccaggtcgagaatttaggtgaatggtctccttcctctgccgccgctaatttcacgccgcatattattacggtgaatgcaggcgaggacgttacgaagaggataatatcattttctcaacaagggtctctagctatttgcgttttatgcgcaaacggtgtcgtttcgagcgttacacttcgtcagcctgattcatctggtggtacattgacctatgagggtcggtttgagatattgtcactatctggaacattcatgcctagtgactcagacgggacacgaagcagaacaggcgggatgagcgtgtcgcttgctagccctgatggacgtgtagtaggtggtggtgttgctggcttgctggttgcagccactcctattcaagtggttgtaggaactttcttaggtggaacaaaccagcaagaacagacaccgaagccgcataaccacaacttcatgtcttctccattaatgccaacttcttcgaatgtagctgatcatcgaaccatccgtcccatgacatctagtctcccgatcagtacatggacaccgtcttttccttctgattcacgacacaagcattctcatgactttaatatcactttgacgtgatttcttccttgaagaactcgtagatcctctgtattttggtttccagtttagggctctacatgttagactctcaaagtctaggtgttatgttggtctgtcacttaggattgtcacttaggattgttagaccatctccatcaatggtttctcattgagaaactgttcaatataaaaataaaatataatc

SEQ ID NO: 484 - protein, 334 aa, Arabidopsis thaliana
  G605,AT-hook amino acids 72-80, DUF296 150-265
METTGEVVKTTTGSDGGVTVVRSNAPSDFHMAPRSETSNTPPNSVAPPPPPPPQNSFTPSAAMDGFSSGPIKKRRGRPRKYGHDGAAVTLSPNPISSAAPTTSHVIDFSTTSEKRGKMKPATPTPSSFIRPKYQVENLGEWSPSSAAANFTPHIITVNAGEDVTKRIISFSQQGSLAICVLCANGVVSSVTLRQPDSSGGTLTYEGRFEILSLSGTFMPSDSDGTRSRTGGMSVSLASPDGRVVGGGVAGLLVAATPIQVVVGTFLGGTNQQEQTPKPHNHNFMSSPLMPTSSNVADHRTIRPMTSSLPISTWTPSFPSDSRHKHSHDFNITLT

SEQ ID NO: 485 - DNA, 2847 bp, Arabidopsis thaliana
  G611,family:PCOMB
cttctctcctccaacatttcagatttcgcgacccggatcttaacccggacccgcatttgtttcggttccgatctggtttcttgacaatggcgtcagaagcttcgccttcttcttcggccaccagatcggagccacccaaagactctccggcggaggagagaggtccagcttctaaggaagtatcagaagtaatagaatcgctaaagaagaagcttgcagctgataggtgtatatcaataaagaaaaggattgatgaaaacaagaagaatttgtttgctattactcaaagttttatgaggtcttctatggaacgaggaggtagctgtaaagatggcagtgatcttttagttaagaggcaaagagattcgccaggtatgaaaagcggaatcgatgaaagtaataacaacagatatgtagaagatggacctgccagttcaggaatggttcaaggatctagtgtccctgtcaaaatttccttacgtcctatcaaaatgcctgatatcaaacgtttgtcaccttataccacatgggtttttctggacagaaatcaaagaatgactgaagaccagtctgtagtgggtcgaaggagaatttattatgatcaaactggcggggaagcgcttatctgcagtgatagtgaagaggaggccattgacgacgaagaagaaaaaagagattttttggagcctgaagattatattattcgcatgacccttgagcaactaggtctttcagactcagtcctggcggaactagcaagtttcttgtctagaagtactagtgaaatcaaggcaagacatggagtgcttatgaaggaaaaagaagtatccgagagtggcgataatcaagcagagagctcccttctcaacaaagatatggaaggagcattagattctttcgataacctgttctgccgtagatgccttgtatttgattgccggcttcatgggtgttcacaggatctcatttttccggctgagaaaccagctccatggtgtcctcctgtagatgaaaatttaacctgtggtgcaaactgctataaaacgcttctcaagtctggaagatttccgggatatggcaccattgaaggtaaaactggcacttcatcagatggtgcaggtactaaaaccacacccacgaagttctccagcaaacttaatgggagaaaaccaaagaccttcccaagtgaaagtgcatcgtctaatgaaaagtgcgcactagaaacaagtgactcagagaatggactacagcaggataccaattccgataaagtttcatcatcgccaaaggtgaaaggtagtgggagacgagtaggtcgtaagaggaacaaaaaccgagttgctgagcgagttcctcgtaagactcagaagaggcagaagaagacagaagcctcggatagtgattccatcgccagtggaagttgttcacccagcgatgcaaaacataaagataatgaagatgctacttcctcttctcagaagcatgtaaaatctgggaactccgggaagtcaaggaagaatggcactcctgccgaagtctccaataattctgtgaaggatgacgttcctgtttgccagtcaaatgaggttgcgtcagagcttgatgcgccgggtagtgatgaaagtctaaggaaagaagagtttatgggtgaaactgtatctcgaggaagattggctacaaataagttgtggagaccacttgagaaaagcctttttgataaaggtgttgagatttttggaatgaatagctgcttgattgctagaaatcttttgagtggtttcaaatcatgttgggaggtcttccaatacatgacgtgctcggaaaataaagcttccttctttggaggtgatggattgaatcctgatggctcttccaagttcgatatcaatggaaatatggttaataaccaagtgaggagaaggtcaagatttctacgtaggagaggcaaagtgcggcgcttgaagtatacctggaagtctgctgcatatcattcaattaggaaaagaattactgagaagaaagaccagccctgccgtcagtttaatccatgtaactgcaaaattgcttgtgggaaggaatgtccttgtttgctaaacgggacttgctgcgagaagtactgcggttgcccaaagagctgcaagaataggtttagaggttgtcattgtgccaaaagtcagtgtcgaagccgccagtgtccatgctttgctgcagatcgggaatgtgacccagatgtttgtagaaactgctgggtcattggtggggatggttcgcttggggtcccaagccaaagaggcgataattatgagtgcaggaatatgaaattgctcctgaaacaacaacaaagggttttacttggaatatctgatgtttctggttggggagctttcttaaagaacagtgtaagtaagcatgaataccttggggaatacacaggagagctgatctcacataaagaggcagataaacgcgggaagatatacgatcgcgagaactgctcttttctcttcaatctaaacgatcagtttgtgctagatgcttacaggaaaggagataaactgaaattcgccaaccattctcctgaacctaactgttacgcaaaggtcatcatggttgctggagatcacagggtggggatcttcgcaaaagagaggatactggctggagaagaactattttacgattaccggtatgagccagatcgagctccagcttgggccaaaaaacctgaagctcctggttctaagaaagacgaaaatgttacaccttctgttggtagacccaagaagcttgcttagcaacaaaagaaacaaccatttttttgtcaattctttggttacaggtggaaga

SEQ ID NO: 486 - protein, 902 aa, Arabidopsis thaliana
  G611,PCOMB domain coordinates 655-874
MASEASPSSSATRSEPPKDSPAEERGPASKEVSEVIESLKKKLAADRCISIKKRIDENKKNLFAITQSFMRSSMERGGSCKDGSDLLVKRQRDSPGMKSGIDESNNNRYVEDGPASSGMVQGSSVPVKISLRPIKMPDIKRLSPYTTWVFLDRNQRMTEDQSVVGRRRIYYDQTGGEALICSDSEEEAIDDEEEKRDFLEPEDYIIRMTLEQLGLSDSVLAELASFLSRSTSEIKARHGVLMKEKEVSESGDNQAESSLLNKDMEGALDSFDNLFCRRCLVFDCRLHGCSQDLIFPAEKPAPWCPPVDENLTCGANCYKTLLKSGRFPGYGTIEGKTGTSSDGAGTKTTPTKFSSKLNGRKPKTFPSESASSNEKCALETSDSENGLQQDTNSDKVSSSPKVKGSGRRVGRKRNKNRVAERVPRKTQKRQKKTEASDSDSIASGSCSPSDAKHKDNEDATSSSQKHVKSGNSGKSRKNGTPAEVSNNSVKDDVPVCQSNEVASELDAPGSDESLRKEEFMGETVSRGRLATNKLWRPLEKSLFDKGVEIFGMNSCLIARNLLSGFKSCWEVFQYMTCSENKASFFGGDGLNPDGSSKFDINGNMVNNQVRRRSRFLRRRGKVRRLKYTWKSAAYHSIRKRITEKKDQPCRQFNPCNCKIACGKECPCLLNGTCCEKYCGCPKSCKNRFRGCHCAKSQCRSRQCPCFAADRECDPDVCRNCWVIGGDGSLGVPSQRGDNYECRNMKLLLKQQQRVLLGISDVSGWGAFLKNSVSKHEYLGEYTGELISHKEADKRGKIYDRENCSFLFNLNDQFVLDAYRKGDKLKFANHSPEPNCYAKVIMVAGDHRVGIFAKERILAGEELFYDYRYEPDRAPAWAKKPEAPGSKKDENVTPSVGRPKKLA

SEQ ID NO: 487 - DNA, 1519 bp, Arabidopsis thaliana
  G615,family:TEO
ttttttcttttctttctttttttgctggtgtgagaaattgtacgcttactatctctctctctctctgccagattctctctttttgatgatgtgaaagttgtgcttttgtttcttaagaaaaaggcatatttttaatacttgattcttggttcttgattcttgattcttggttttttttagcttcttaagttcggtgatgtcgtcttccaccaatgactacaacgatggtaataacaatggagtgtaccctctctctctttacctttcttcactctctggccatcaagacatcattcataatccctacaaccatcagttaaaagcatctccgggccatatggtatcagcagttcctgaatctctgatcgattacatggcgtttaagtcaaataatgttgtgaatcaacaaggctttgagtttcctgaggtgtcaaaggaaatcaagaaggtggtgaagaaggaccgacatagcaagattcaaacggcacaagggattagagacaggagggttaggctttttattgggattgctcgccaattctttgatcttcaggatatgttggggtttgataaagctagtaaaacgttagactggctgctcaagaagtcaagaaaagccatcaaagaggtcgtacaagcaaaaaacctcaacaatgatgatgaagattttggaaacattggaggcgatgtagaacaagaagaggagaaggaggaggatgacaatggcgataagagcttcgtgtatggtttgagccccgggtacggtgaagaagaagtggtatgtgaggccacgaaggcagggataagaaagaagaagagtgagttgagaaacatctcatcaaaggggctaggagccaaagctagaggaaaagcaaaggagcgaacaaaagagatgatggcctatgataatccagagactgcctctgatattacacaatctgaaatcatggacccattcaagaggtctatagtcttcaatgaaggagaagatatgacacaccttttctacaaggaaccaatcgaggagtttgataatcaagaatctatcttaaccaatatgactctaccaacgaagatgggtcaaagttacaatcaaaataatgggatacttatgttggtagatcagagttctagcagcaactataatacatttctgcctcaaaatttggattatagttatgatcaaaacccttttcatgaccaaaccttatatgtagtcaccgacaaaaatttccccaaaggtttcctataaatctcgacagttttgaaggactatgcatgatcaagtttaaacatgtaagccaatatagtcccttattcctctgaatgtatacaaaatctatagttatgtatatctgttcctttttaacgtatctttattgatcttctgtgccttgatcaaaattgtcattttaagattcagtttgtgtaatattttagctacaacttttaagtggtattattgtaaccttttgaactatatattttgaagatgaataagaacatgtttatataaaaa

SEQ ID NO: 488 - protein, 351 aa, Arabidopsis thaliana
  G615,TEO domain coordinates 88-147
MSSSTNDYNDGNNNGVYPLSLYLSSLSGHQDIIHNPYNHQLKASPGHMVSAVPESLIDYMAFKSNNVVNQQGFEFPEVSKEIKKVVKKDRHSKIQTAQGIRDRRVRLFIGIARQFFDLQDMLGFDKASKTLDWLLKKSRKAIKEVVQAKNLNNDDEDFGNIGGDVEQEEEKEEDDNGDKSFVYGLSPGYGEEEVVCEATKAGIRKKKSELRNISSKGLGAKARGKAKERTKEMMAYDNPETASDITQSEIMDPFKRSIVFNEGEDMTHLFYKEPIEEFDNQESILTNMTLPTKMGQSYNQNNGILMLVDQSSSSNYNTFLPQNLDYSYDQNPFHDQTLYVVTDKNFPKGFL

SEQ ID NO: 489 - DNA, 1431 bp, Arabidopsis thaliana
  G616,family:TEO
ctttaaatcccaaaccaaccctaaagttttgatttttaattttgggggtaaccaaaaaaaaaacaaaaccctaattttttttctttagtgatgagattattggtgatgatgaaatgattggagatctaatgaagaataacaacaatggcgacgttgtggataacgaagtgaacaaccggttaagccggtggcatcacaattcttcccggataattagggtttcacgagcttccggtggtaaagatcgacacagcaaagtcttgacttctaaaggaccacgtgaccgtcgtgtccggttatcagtctccaccgctcttcaattctatgatcttcaagatcggttaggttatgatcaacctagcaaagctgttgaatggttaatcaaagctgctgaagattcaatctctgagcttccttcactcaacaacactcattttccgaccgatgacgagaatcaccagaatcagacattaacaacagttgctgctaattccttgtctaaatctgcttgtagtagcaattcagacacgagcaagaactcttctggtttgtctttatcaagatcggagcttagagataaagctagagagagggctagagagagaacagctaaagagaccaaggaaagagatcataaccacacttcgtttacggatttgttaaattccggttcagatccggttaactcaaaccggcaatggatggcttcagctccttcttcatctccaatggagtatttcagttcgggtttaattctcgggtcgggtcaacaaacccatttccctatttcaacaaattctcatcctttctcatcaatctccgatcatcatcatcatcatcctcatcatcagcatcaagagttttcattcgttcccgaccatttgatatcaccggcagaatccaacggcggagcattcaatcttgattttaatatgtcaacaccctccggcgccggagctgccgtctccgccgcatcaggtggtggcttcagtggtttcaacagggggacccttcagtccaattcaacaaatcagcatcagtcattcctcgctaatctacagaggtttccaacatcagaaagtggaggaggtccacagttcttattcggtgcactgcctgcagagaatcaccaccacaatcaccagtttcagctttactatgaaaatggatgcagaaactcatcagaacataagggtaaaggcaagaactgatgatattaattattgcatctttggttttgttcaaatgctcattttgtatgtttatctttggtttatttcaaaacaaatgttaatctctttcgttgtctgatgtgtgttagggttttgttttatgtattgagggtctttggaaatctttttgcattgtgcttgtaatgttgtatttgtgataatagcattttgtttgtgagttaaaaaaaaaaaaaaaaaa

SEQ ID NO: 490 - protein, 360 aa, Arabidopsis thaliana
  G616,TEO domain coordinates 39-95
MKNNNNGDVVDNEVNNRLSRWHHNSSRIIRVSRASGGKDRHSKVLTSKGPRDRRVRLSVSTALQFYDLQDRLGYDQPSKAVEWLIKAAEDSISELPSLNNTHFPTDDENHQNQTLTTVAANSLSKSACSSNSDTSKNSSGLSLSRSELRDKARERARERTAKETKERDHNHTSFTDLLNSGSDPVNSNRQWMASAPSSSPMEYFSSGLILGSGQQTHFPISTNSHPFSSISDHHHHHPHHQHQEFSFVPDHLISPAESNGGAFNLDFNMSTPSGAGAAVSAASGGGFSGFNRGTLQSNSTNQHQSFLANLQRFPTSESGGGPQFLFGALPAENHHHNHQFQLYYENGCRNSSEHKGKGKN

SEQ ID NO: 491 - DNA, 1564 bp, Arabidopsis thaliana
  G618,family:TEO
cagataacgaccatttcttagattctccgtcgccgcctcttctagagatgagacaccaccaatcagcgacggagaacggtggtggttgcggagagattgtggaggtacaaggaggtcacattgttcggtcaacaggaagaaaagacagacatagtaaagtatgtacagcgaaaggaccacgtgaccggcgcgtgagactctcagctccgacggcgattcaattctacgatgttcaagatagacttggttttgatcgaccaagtaaagctgttgattggcttattactaaagctaaatccgccattgatgatcttgctcagcttcctccttggaaccccgccgatactcttcgtcaacacgccgccgctgctgctaacgctaaacccagaaaaaccaaaactttaatttctccgccaccgccacaaccggaagaaacagagcatcatcgaatcggagaagaagaagataacgaatcgagttttcttccggcgtcaatggattctgattcgatagctgacactataaagtcgttttttccggtagcttcaacgcaacagagctatcatcatcagccaccgtcacgaggcaatacacagaaccaagatcttcttcgtctctcgcttcaatctttccaaaatggtccaccttttcctaatcaaacagaacctgctctgttctccggccagagcaataatcagttagcgtttgactcatcgacggcaagctgggaacagagtcatcagtcaccggaatttggaaagatacagagactagtgtcatggaacaacgtcggagcagctgaatccgccggaagtaccggaggatttgtgtttgcttctccgtcgtcgttgcatccagtttatagccaaagtcagcttttatcacagaggggtccccttcagtccattaacacacctatgattcgtgcttggtttgatcctcaccatcatcatcatcatcatcagcagtccatgaccactgacgatctccaccatcatcatccctaccatatccctcccgggattcaccaatctgctattccaggcattgcatttgcttcaagtggtgaattctccggttttcgtataccagcacggtttcaaggcgaacaagaggagcacggcggcgacaacaagccgtcctctgcttcatccgattctcgccattaaacaagttccaaaaacacataagattgtgcaacacaacaggtttcttttcatattccagggcgcttcgaatgcgtggaatagtgaaggcggttttcgttgttgtgtgtttcgaatatccaaatggcctataaatctgatcaacagtttcaggttcttcttaagtctttaaaagcctaggccttggttaatttgaattcatcttgtatcaattagagaacgttctgtaagttcaattctgttttacaatgtttagctctagctacatgagctcacatcttgtttgttgtaacttgttctacaattacttgtcgtttctttatgttcttgtgttggaaacctttaaccccacttgaagctaaagtcttttgtttgccctttaaaaaaaaaaaaaaaaa

SEQ ID NO: 492 - protein, 373 aa, Arabidopsis thaliana
  G618,TEO domain coordinates 32-89
MRHHQSATENGGGCGEIVEVQGGHIVRSTGRKDRHSKVCTAKGPRDRRVRLSAPTAIQFYDVQDRLGFDRPSKAVDWLITKAKSAIDDLAQLPPWNPADTLRQHAAAAANAKPRKTKTLISPPPPQPEETEHHRIGEEEDNESSFLPASMDSDSIADTIKSFFPVASTQQSYHHQPPSRGNTQNQDLLRLSLQSFQNGPPFPNQTEPALFSGQSNNQLAFDSSTASWEQSHQSPEFGKIQRLVSWNNVGAAESAGSTGGFVFASPSSLHPVYSQSQLLSQRGPLQSINTPMIRAWFDPHHHHHHHQQSMTTDDLHHHHPYHIPPGIHQSAIPGIAFASSGEFSGFRIPARFQGEQEEHGGDNKPSSASSDSRH

SEQ ID NO: 493 - DNA, 826 bp, Arabidopsis thaliana
  G620,family:CAAT
gaattgaacttggaccagcacagcaacaacccaaccccaatgaccagctcagtcatagtagccggcgccggtgacaagaacaatggtatcgtggtccagcagcaaccaccatgtgtggctcgtgagcaagaccaatacatgccaatcgcaaacgtcataagaatcatgcgtaaaaccttaccgtctcacgccaaaatctctgacgacgccaaagaaacgattcaagaatgtgtctccgagtacatcagcttcgtgaccggtgaagccaacgagcgttgccaacgtgagcaacgtaagaccataactgctgaagatatcctttgggctatgagcaagcttgggttcgataactacgtggaccccctcaccgtgttcattaaccggtaccgtgagatagagaccgatcgtggttctgcacttagaggtgagccaccgtcgttgagacaaacctatggaggaaatggtattgggtttcacggcccatctcatggcctacctcctccgggtccttatggttatggtatgttggaccaatccatggttatgggaggtggtcggtactaccaaaacgggtcgtcgggtcaagatgaatccagtgttggtggtggctcttcgtcttccattaacggaatgccggcttttgaccattatggtcagtataagtgaagaaggagttattcttcatttttatatctattcaaaacatgtgtttcgatagatattttatttttatgtcttatcaataacatttctatataatgttgcttctttaaggaaaagtgttgtatgtcaatactttatgagaaactgatttatatatgcaaat

SEQ ID NO: 494 - protein, 208 aa, Arabidopsis thaliana
  G620,CAAT domain coordinates 28-117
MTSSVIVAGAGDKNNGIVVQQQPPCVAREQDQYMPIANVIRIMRKTLPSHAKISDDAKETIQECVSEYISFVTGEANERCQREQRKTITAEDILWAMSKLGFDNYVDPLTVFINRYREIETDRGSALRGEPPSLRQTYGGNGIGFHGPSHGLPPPGPYGYGMLDQSMVMGGGRYYQNGSSGQDESSVGGGSSSSINGMPAFDHYGQYK

SEQ ID NO: 495 - DNA, 2628 bp, Arabidopsis thaliana
  G622,family:ABI3/VP-1
tctttctttcttcaattcgccgtcaaaatcttctctttctcttcccccgccggtccttcaccaatcctctgatctctctacacacgaacctttgattttgaccaacgtcgatgcatgttcatgactagtctcttcctcaatccttcaatttcatcaattcacgtcgatttcgtatccgattcgttgttctagctctttgtgtggtgttagggttttaagattttggaattggggtttggagtttgtgatgtttgaagtcaaaatggggtcaaagatgtgcatgaacgcttcatgtggtacgacttctactgttgaatggaagaaaggttggcctcttcgatctggtcttctcgctgatctctgttatcgttgcggatctgcgtatgagagttctctattctgtgaacaatttcataaggaccaatctggttggagggaatgctatttgtgtagcaagagactacattgtggatgcattgcttctaaggtaacgattgagttaatggactatggtggtgttggttgtagtacatgtgcttgctgccatcaactcaatttgaacacaaggggtgagaatccaggtgtttttagcagattgccaatgaaaacgttagctgataggcaacatgtaaatggcgaaagcggaggaagaaacgaaggcgatctcttttctcagccactagtcatgggcggagataaaagggaagagttcatgcctcaccgtgggtttggtaagctaatgagtccagaaagtacaaccaccgggcataggctggatgctgctggggaaatgcatgaatcatcacctttacagccatctttaaatatgggtttggctgtgaatccgtttagcccatcttttgcaaccgaggctgtcgagggaatgaaacacatcagtccttctcagtccaacatggtccattgctctgcttctaatatactgcaaaagccatcaagacctgctatttcaactcctcctgtggctagtaaatccgctcaggcgcggattggaaggcctcctgtcgaagggcgagggagaggccacttgcttccgcggtattggccaaaatatacggataaagaggttcagcagatctctggaaatttgaatttgaacattgtacctctctttgagaaaactcttagtgccagtgatgctggtcgcattggtcgtctagttcttccaaaagcctgtgcagaggcatattttcctccgattagtcaatccgaaggcattcctttgaaaatccaagatgtgaggggtagggagtggacgttccagttcagatattggcccaataacaatagtagaatgtatgttttagaaggtgtcactccatgcatacagtccatgatgctacaggctggtgatacagtaactttcagtcgggttgatcctggcggaaaactaatcatgggttccaggaaggcagctaatgctggagacatgcagggttgtgggctcaccaacggaacatcaactgaggacacatcatcgtctggtgtaacagaaaacccaccctccataaatggttcctcgtgtatttcactaataccgaaagagttgaatggtatgcctgagaatttgaacagtgagactaacgggggcaggataggtgatgatcctacacgagttaaagagaagaagagaactcgaaccattggtgcaaaaaataagagacttcttttgcatagtgaagaatctatggagctgagactcacttgggaagaagctcaggacttgcttcgtccctctcctagtgtaaagcctaccatcgttgtcattgaggagcaagaaattgaagaatatgacgaacctcctgtctttggaaagaggactatagtcactacaaaaccttcaggtgaacaggaacgatgggcaacttgcgacgactgctctaaatggagaaggttacctgtagatgctcttctttcctttaaatggacatgtatagacaatgtttgggatgtgagtaggtgttcatgttctgcaccggaggagagtctgaaggaacttgagaatgttcttaaagtaggtagagagcacaagaagagaagaactggggaaagacaggcagcacaaagtcagcaagaaccgtgtggtttggacgcactggcgagtgcagcagtcttaggagacacaataggcgagccagaggtagcgaccacgaccagacatccaaggcacagggctggatgctcttgcatcgtgtgcattcagccaccaagtgggaaaggtaggcacaagcctacatgtggctgcactgtgtgtagcaccgtgaagagaaggttcaagacgcttatgatgaggaggaagaagaagcagttggagcgcgatgtaacagcagcagaagataagaagaagaaggacatggaactggctgagtctgataagagtaaggaggagaaggaagtgaacacagcgagaatagacctgaacagtgatccatacaataaagaagatgttgaagctgttgcggtggagaaagaagagagtcgaaaaagagcaataggacagtgttcgggcgtggtggctcaagacgccagtgatgttttaggagttacagagttagaaggagagggtaagaatgttcgtgaagagccgagagtttcaagctgatatggaaa

SEQ ID NO: 496 - protein, 790 aa, Arabidopsis thaliana
  G622,ABI3/VP-1 domain coordinates 294-375
MFEVKMGSKMCMNASCGTTSTVEWKKGWPLRSGLLADLCYRCGSAYESSLFCEQFHKDQSGWRECYLCSKRLHCGCIASKVTIELMDYGGVGCSTCACCHQLNLNTRGENPGVFSRLPMKTLADRQHVNGESGGRNEGDLFSQPLVMGGDKREEFMPHRGFGKLMSPESTTTGHRLDAAGEMHESSPLQPSLNMGLAVNPFSPSFATEAVEGMKHISPSQSNMVHCSASNILQKPSRPAISTPPVASKSAQARIGRPPVEGRGRGHLLPRYWPKYTDKEVQQISGNLNLNIVPLFEKTLSASDAGRIGRLVLPKACAEAYFPPISQSEGIPLKIQDVRGREWTFQFRYWPNNNSRMYVLEGVTPCIQSMMLQAGDTVTFSRVDPGGKLIMGSRKAANAGDMQGCGLTNGTSTEDTSSSGVTENPPSINGSSCISLIPKELNGMPENLNSETNGGRIGDDPTRVKEKKRTRTIGAKNKRLLLHSEESMELRLTWEEAQDLLRPSPSVKPTIVVIEEQEIEEYDEPPVFGKRTIVTTKPSGEQERWATCDDCSKWRRLPVDALLSFKWTCIDNVWDVSRCSCSAPEESLKELENVLKVGREHKKRRTGERQAAQSQQEPCGLDALASAAVLGDTIGEPEVATTTRHPRHRAGCSCIVCIQPPSGKGRHKPTCGCTVCSTVKRRFKTLMMRRKKKQLERDVTAAEDKKKKDMELAESDKSKEEKEVNTARIDLNSDPYNKEDVEAVAVEKEESRKRAIGQCSGVVAQDASDVLGVTELEGEGKNVREEPRVSS

SEQ ID NO: 497 - DNA, 2291 bp, Arabidopsis thaliana
  G624,family:ABI3/VP-1
ccactatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcctctgcgtatgaacaaggaaagttttgtgacgtatttcaccaaagggcttctggatggaggtgttgtgagtcatgtggaaagcgaattcattgtggatgtattgcgtctgcttctgcttatacgttaatggatgctggaggaattgagtgtttggcttgcgcaagaaaaaagtttgctttgggacccaatttttcgccatcaccgtcctttcttttccagtctccaatttctgagaaattcaaggacttgtcgatcaactggagttcttcaactagatcaaatcagataagctaccagcctcctagttgtttagatccttcagttctgcagtttgattttcgtaatcgtggaggtaataatgaatttagtcaacctgcttctaaagaaagggtcactgcatgtaccatggagaaaaaaaggggaatgaatgacatgatagggaaattaatgagtgaaaactcgaaacattatagagtatctccttttccaaatgtcaatgtatatcacccactgatctcactaaaggagggtccatgtgggacacagcttgcgtttcctgtgccaattacaacaccaattgagaaaactggtcactctagactagatggaagtaatttatggcacacacgtaattcttctccgctaagtcgcttacacaatgacttgaatggtggagcagactcgccattcgaaagcaaaagtcgtaatgtgatggctcatcttgagacgccaggaaaatatcaggtggttccacgattttggcccaaggtttcatataaaaaccaagttctgcagaatcaatcaaaagaatctgaatccgttgtcactcctctctttgagaagatcctgagtgcaactgatactggaaagcggctggtcctgccaaagaaatatgcagaggctttcttgccccaactttcccacaccaaaggtgtgcctctcacagtacaggacccaatgggtaaagagtggagatttcagtttcgcttttggcccagcagcaaaggcagaatatatgttctagagggagtaactccattcatacagaccttgcagttgcaggctggtgatacagtcatattcagtcgattagatccagaaaggaagttaattttgggattcagaaaggcttcgattactcaatcgtctgatcagcaggctgatccggctgatatgcattcaccgtttgaagttaagaagtctgcttatataactaaagaaaccccaggagtagaatgttcctctggtaagaagaaaagcagcatgatgattacaagaagtaaacgtcaaaaagttgaaaagggagacgacaacttgctgaagctaacatgggaagaagctcaaggatttctcctgcctcctcccaacctcactccatctagagttgtgatagaggattacgagtttgaggagtatgaggaggctccaatcatcgggaagcctactgatgttgcaggtttcagatcaacgtgcactgaagttgaaggactgttgatatcaccaacaaccacaaagcacccacgacatagagatggctgtacttgcatcatttgcatacaatccccaagtgggataggtcctaaacacgaccgatgctgttcttgtgcagtctgcgacactaacaaacgccgtaggcgttccctgttgctacggagggaaaagaagcagatggagaaagaagacaatgcgcgcaagttgctcgagcaactgaattctgataatggacttcaccaatctgctaacaacagtgagaatcatgagcgtcatgcttcgcctttgaaagttcaattagatttgaacttcaaaccagaaaaggacgaagaatctctccctggttctaacaaaactaccaagagcgagactctgcctcatgatgacacagtaaagtctagcttcacgtcaccaagctcatcaagtgctcatagccaaaataacaaggaagatgaaggaaaactcaagacaaccacagaaattgcagacaccaccaccacaagctccatgtagattttgcagactcttatagctgcaaggtgaatagattatgatgggaaacacca

SEQ ID NO: 498 - protein, 716 aa, Arabidopsis thaliana
  G624,ABI3/VP-1 domain coordinates 327-406
MLSSSSMSSSSLSARFCFNHECFEFKLDHCRPGWRLRSGDFVDLCDRCASAYEQGKFCDVFHQRASGWRCCESCGKRIHCGCIASASAYTLMDAGGIECLACARKKFALGPNFSPSPSFLFQSPISEKFKDLSINWSSSTRSNQISYQPPSCLDPSVLQFDFRNRGGNNEFSQPASKERVTACTMEKKRGMNDMIGKLMSENSKHYRVSPFPNVNVYHPLISLKEGPCGTQLAFPVPITTPIEKTGHSRLDGSNLWHTRNSSPLSRLHNDLNGGADSPFESKSRNVMAHLETPGKYQVVPRFWPKVSYKNQVLQNQSKESESVVTPLFEKILSATDTGKRLVLPKKYAEAFLPQLSHTKGVPLTVQDPMGKEWRFQFRFWPSSKGRIYVLEGVTPFIQTLQLQAGDTVIFSRLDPERKLILGFRKASITQSSDQQADPADMHSPFEVKKSAYITKETPGVECSSGKKKSSMMITRSKRQKVEKGDDNLLKLTWEEAQGFLLPPPNLTPSRVVIEDYEFEEYEEAPIIGKPTDVAGFRSTCTEVEGLLISPTTTKHPRHRDGCTCIICIQSPSGIGPKHDRCCSCAVCDTNKRRRRSLLLRREKKQMEKEDNARKLLEQLNSDNGLHQSANNSENHERHASPLKVQLDLNFKPEKDEESLPGSNKTTKSETLPHDDTVKSSFTSPSSSSAHSQNNKEDEGKLKTTTEIADTTTTSSM

SEQ ID NO: 499 - DNA, 699 bp, Arabidopsis thaliana
  G627,family:MADS
atggtgaggggcaaaacggagatgaagaggatagagaacgcaacaagcaggcaagtgacgttttcgaagagaagaaatggactcttgaagaaagccttcgaattatcggtcctttgtgatgctgaagttgctttggttatcttctctccaagatccaaactctatgagttctctagctctagtatagcagcaacaattgaacgctatcagagacgaataaaagaaattgggaataatcataagagaaatgataattctcagcaagcgagagacgaaacatctggattgacaaaaaagattgaacagctagagatatctaaacgaaaattgcttggagaaggcattgatgcatgttccatcgaggagctgcaacagttagagaatcagttggaccgaagcttgagcaggataagagccaagaagtaccaattactccgtgaagaaattgagaagttgaaggcagaggagaggaatctcgttaaggaaaataaagatctgaaggagaagtggcttggaatgggaacagcaacaatagcatcatcacaatcaacgttatcatcatcagaagtgaacatagatgacaatatggaagtggagactggtttgttcattggacctcctgagacaagacaatccaaaaaattccctcctcaaaattaatcttacaacttcttcaaaaagaatgttttaactatatga

SEQ ID NO: 500 - protein, 219 aa, Arabidopsis thaliana
  G627,MADS domain coordinates 1-57
MVRGKTEMKRIENATSRQVTFSKRRNGLLKKAFELSVLCDAEVALVIFSPRSKLYEFSSSSIAATIERYQRRIKEIGNNHKRNDNSQQARDETSGLTKKIEQLEISKRKLLGEGIDACSIEELQQLENQLDRSLSRIRAKKYQLLREEIEKLKAEERNLVKENKDLKEKWLGMGTATIASSQSTLSSSEVNIDDNMEVETGLFIGPPETRQSKKFPPQN

SEQ ID NO: 501 - DNA, 1557 bp, Arabidopsis thaliana
  G629,family:bZIP
cgaaatgaaaaaattctctgtattaccagaaacgtgtttcataagcatctttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttgattagaactttatggtttttgctttatgaagtatctctccagagaagattgtaaatttgggttgaaactttgtaatatattaagatccaccaaataagtttgaaatctgagcaatttgataataaaaaaaaaaaaaaaaaaaaaaaaaa

SEQ ID NO: 502 - protein, 368 aa, Arabidopsis thaliana
  G629,bZIP domain coordinates 92-152
MMSSSSPTQLASLRDMGIYEPFQQIVGWGNVFKSDINDHSPNTATSSIIQVDPRIDDHNNNIKINYDSSHNQIEAEQPSSNDNQDDDGRIHDKMKRRLAQNREAARKSRLRKKAYVQQLEESRLKLSQLEQELEKVKQQGHLGPSGSINTGIASFEMEYSHWLQEQSRRVSELRTALQSHISDIELKMLVESCLNHYANLFRMKSDAAKADVFYLISGMWRTSTERFFQWIGGFRPSELLNVVMPYLQPLTDQQILEVRNLQQSSQQAEDALSQGIDKLQQSLAESIVIDAVIESTHYPTHMAAAIENLQALEGFVNQADHLRQQTLQQMAKILTTRQSARGLLALGEYLHRLRALSSLWAARPQEPT

SEQ ID NO: 503 - DNA, 759 bp, Arabidopsis thaliana
  G630,family:bZIP
gagagaaattgaccatgcagccaaattatgatagctcaagtcttaacaacatgcaacaacaagactacttcaacttgaacaactactacaacaacttaaacccttcaaccaataacaacaacctcaatatcctccaataccctcaaattcaagaactcaacctacaatctccggtaagcaacaactccacaacttccgatgacgcaactgaagaaatcttcgtcatcaacgagaggaagcaaagacgtatggtatctaacagagagtcagcaagaagatcaagaatgagaaagcaaagacacttagatgagcttctctcacaggttgcttggcttcgaagcgagaaccaccagcttttagataagcttaaccaagtctccgacaacaatgatcttgttattcaagagaactcgagtcttaaagaagaaaacttggagcttcgtcaggttatcacatccatgaagaagcttggaggaggcatacatgacaaatattcttctccgtcgtctatggatgaattggatcaagacttttcttctatcacagatgatccaagaactcatcatccatcatgagttgttctgatcgagaaaaacattacttcaagtttctgcctctaatcttatctattttctttctttggtatcactttttaaaccgtttaactacgtaccaaagtttgggttttatttgtttttctgttgttttgtcagaagataattaaatgatggatatttgaaaaaaaaaaaaaaaaaaaaa

SEQ ID NO: 504 - protein, 186 aa, Arabidopsis thaliana
  G630,bZIP domain coordinates 74-146
MQPNYDSSSLNNMQQQDYFNLNNYYNNLNPSTNNNNLNILQYPQIQELNLQSPVSNNSTTSDDATEEIFVINERKQRRMVSNRESARRSRMRKQRHLDELLSQVAWLRSENHQLLDKLNQVSDNNDLVIQENSSLKEENLELRQVITSMKKLGGGIHDKYSSPSSMDELDQDFSSITDDPRTHHPS

SEQ ID NO: 505 - DNA, 798 bp, Arabidopsis thaliana
  G634,family:TH
atggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatga

SEQ ID NO: 506 - protein, 265 aa, Arabidopsis thaliana
  G634,TH domain coordinates 62-147,189-245
MEQGGGGGGNEVVEEASPISSRPPANNLEELMRFSAAADDGGLGGGGGGGGGGSASSSSGNRWPREETLALLRIRSDMDSTFRDATLKAPLWEHVSRKLLELGYKRSSKKCKEKFENVQKYYKRTKETRGGRHDGKAYKFFSQLEALNTTPPPPPSHPHAHQPEQKQQQQPQQEMVMSSEQSSLPSSSRWPKAEILALINLRSGMEPRYQDNVPKGLLWEEISTSMKRMGYNRNAKRCKEKWENINKYYKKVKESNNSNYNNKNQ

SEQ ID NO: 507 - DNA, 993 bp, Arabidopsis thaliana
  G635,family:TH
atggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaa

SEQ ID NO: 508 - protein, 330 aa, Arabidopsis thaliana
  G635,TH domain coordinates 239-323
MEIMRPGVSENTLKGKIRITTRCMWLDKGRLLDALHKAAHAALSSCPVTCPLSHMERTVSEVLRKIVRKYSGKRPEVIAIATENPMAVRADEVSARLSGDPSVGSGVAALRKVVEGNDKRSRAKKAPSQEASPKEVDRTLEDDIIDSARLLAEEETAASTYTEEVDTPVGSSSEESDDFWKSFINPSSSPSPSETENMNKVADTEPKAEGKENSRDDDELADASDSETKSSPKRVRKNKWKPEEIKKVIRMRGELHSRFQVVKGRMALWEEISSNLSAEGINRSPGQCKSLWASLIQKYEESKADERSKTSWPHFEDMNNILSELGTPAS

SEQ ID NO: 509 - DNA, 1913 bp, Arabidopsis thaliana
  G636,family:TH
cgatgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcacattcttggaagctgttgaaaagcgagaacacaagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacgcacaatcgtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttcgaaccggtttggtggtgaaagattagtaatctttttttaagttttgatacagaacatgagaatttaaatattggagggttt

SEQ ID NO: 510 - protein, 602 aa, Arabidopsis thaliana
  G636,TH domain coordinates 55-145,405-498
MQLGGGTPTTTAAATTVTTATAPPPQSNNNDSAATEAAAAAVGAFEVSEEMHDRGFGGNRWPRQETLALLKIRSDMGIAFRDASVKGPLWEEVSRKMAEHGYIRNAKKCKEKFENVYKYHKRTKEGRTGKSEGKTYRFFDQLEALESQSTTSLHHHQQQTPLRPQQNNNNNNNNNNNSSIFSTPPPVTTVMPTLPSSSIPPYTQQINVPSFPNISGDFLSDNSTSSSSSYSTSSDMEMGGGTATTRKKRKRKWKVFFERLMKQVVDKQEELQRTFLEAVEKREHKRLVREESWRVQEIARINREHEILAQERSMSAAKDAAVMAFLQKLSEKQPNQPQPQPQPQQVRPSMQLNNNNQQQPPQRSPPPQPPAPLPQPIQAVVSTLDTTKTHNRGDQNMTPAASASSSRWPKVEIEALIKLRTNLDSKYQENGPKGPLWEEISAGMRRLGFNRNSKRCKEKWENINKYFKKVKESNKKRPEDSKTCPYFHQLDALYRERNKFHSNNNIAASSSSSGLVKPDNSVPLMVQPEQQWPPAVTTATTTPAAAQPDQQSQPSEQNFDDEEGTDEEYDDEDEEEENEEEEGGEFELVPSNNNNNKTTNNL

SEQ ID NO: 511 - DNA, 2136 bp, Arabidopsis thaliana
  G638,family:TH
gaattaaaaggtttaacctttacctttttttcccttcactatcgataattgatcttctctttcggctgaatataaatctgaaaaaatggatcaagatcagcatcctcagtacggtataccggagctccggcagctcatgaaaggcggaggaaggacgactactacaacaccgtctacttcttctcattttccctctgatttcttcggttttaaccttgctccggtgcagccaccgccacaccgtcttcatcagttcactactgatcaagatatgggtttcttgccacgtggcatacatggattgggtggaggttcttcaacggctggaaataacagtaacttaaacgcgagtactagtggtggaggagttgggtttagtgggtttcttgacggtggtggtttcggcagcggagtaggaggagacggtggaggaactggaaggtggccgagacaagaaaccctaactctgttggaaattagatctcgtcttgatcataaattcaaagaagctaatcataaaggacctctttgggatgaagtttctaggattatgtccgaggaacatggataccaaaggagtgggaagaaatgcagagagaagtttgagaatctgtacaaatactatagtaagactaaagaaggcgaagccggaagacaagacggaaaacatcacagatttttccgccagctccaagcgctatacggggattctaataacttggtttcttgtcccaatcataacacgcagttcatgagcagtgctcttcatggtttccatactcaaaaccctatgaacgttgctacaacaacgtccaacatccataacgttgatagtgttcatggttttcatcaaagccttagtctttctaacaactacaactcctccgagcttgagctgatgacttcctcttcggaagggaatgattctagtagtagaaggaaaaagaggagttggaaagcgaagataaaggagttcattgatacgaacatgaaaaggttgatagagaggcaagatgtttggcttgagaagttgacaaaggttattgaagacaaagaggaacaacggatgatgaaagaagaggaatggaggaagattgaagctgcaaggattgataaagagcatttgttttgggctaaagagagggcgaggatggaagctagggatgttgcggtgattgaggcattgcaatacttgacaggaaagccattgataaagccgctgtgttcatccccggaagagaggacaaatggtaataatgagatccgaaacaatagtgagacacagaatgagaatggaagcgatcaaacgatgactaacaatgtttgtgttaaaggaagtagtagctgctggggtgagcaagagattttaaagcttatggagataagaacgagcatggactcgacctttcaagagatattaggagggtgctcggatgagtttctatgggaggaaatcgcagcgaagttgattcagttagggtttgatcagagaagtgccttattatgcaaggaaaagtgggaatggataagcaatggaatgaggaaagaaaagaagcaaatcaacaagaaaagaaaggataattcgtccagctgcggcgtgtactacccgagaaacgaagaaaatccaatctacaataatcgagaaagtggatataatgataatgatccgcatcaaatcaacgaacaaggcaatgtaggttcttcaacatcaaacgcaaacgcaaacgcaaacgtaaccactggaaatccgagcggtgcaatggctgctagtacaaactgcttcccgttcttcatgggagatggagatcagaatttgtgggagagttatggtttgaggctcagtaaagaagagaatcagtaagtaatttctcttaatgaagaagaagaaggtaatcatgtggttaactaattcttttgagttagctatatatgagataaaccttgacttagctattatatgtcacatgctgcttagaattaagaaatatttgttggggcttaacgaattatatatcagcatatataagatgagagtctaagaattatatcaaattaggctttaaccaacgtacgattatatattatgttttcatgtatttattctgtaagactttttaatatcaatctttctctaaa

SEQ ID NO: 512 - protein, 591 aa, Arabidopsis thaliana
  G638,TH domain coordinates 119-206
MDQDQHPQYGIPELRQLMKGGGRTTTTTPSTSSHFPSDFFGFNLAPVQPPPHRLHQFTTDQDMGFLPRGIHGLGGGSSTAGNNSNLNASTSGGGVGFSGFLDGGGFGSGVGGDGGGTGRWPRQETLTLLEIRSRLDHKFKEANHKGPLWDEVSRIMSEEHGYQRSGKKCREKFENLYKYYSKTKEGEAGRQDGKHHRFFRQLQALYGDSNNLVSCPNHNTQFMSSALHGFHTQNPMNVATTTSNIHNVDSVHGFHQSLSLSNNYNSSELELMTSSSEGNDSSSRRKKRSWKAKIKEFIDTNMKRLIERQDVWLEKLTKVIEDKEEQRMMKEEEWRKIEAARIDKEHLFWAKERARMEARDVAVIEALQYLTGKPLIKPLCSSPEERTNGNNEIRNNSETQNENGSDQTMTNNVCVKGSSSCWGEQEILKLMEIRTSMDSTFQEILGGCSDEFLWEEIAAKLIQLGFDQRSALLCKEKWEWISNGMRKEKKQINKKRKDNSSSCGVYYPRNEENPIYNNRESGYNDNDPHQINEQGNVGSSTSNANANANVTTGNPSGAMAASTNCFPFFMGDGDQNLWESYGLRLSKEENQ

SEQ ID NO: 513 - DNA, 885 bp, Arabidopsis thaliana
  G643,family:TH
atggaggaaggaacttcaggttcacggagaacacggtctcaagttgctccagaatgggcagtcaaagattgtctagtcctcgtgaatgagatcgctgcggttgaagccgattgttcgaatgctttatctagcttccagaaatggacaatgatcacagagaactgcaacgctttggatgttagcagaaatctaaaccaatgcaggaggaaatgggattctttgatgtctgattacaatcagatcaagaagtgggaatctcagtaccgaggcactggtcgttcctattggtccctgagtagtgacaagaggaagttacttaatctcccgggggatatcgatatcgagctttttgaagccatcaatgcggttgtgatgatccaagatgaaaaagctgggactgaatctgatagtgaccctgaagcgcaagacgttgttgatctctctgctgaattagcttttgtaggatcaaaaagatcaagacagcgaacaatggtcatgaaggagacaaagaaagaagagccacggactagccgagttcaagtaaacactcgagagaaacctataactacaaaagcaacccatcagaacaaaaccatgggagagaagaagccggtggaagatatgtccacagatgaagaagaagatgaaacaatgaacatagaagaggatgtagaagtgatggaagcgaagctaagttataaaattgacttgatacatgcgatagtcgggagaaatctagcaaaggataatgaaacaaaggatggtgttagtatggacgacaagttgaagtctgtgagacagcaaggagacgagctcatcggttgtctgagtgaaattgttagtacccttaataggcttcatgaagttccacaagaaatcgagtga

SEQ ID NO: 514 - protein, 294 aa, Arabidopsis thaliana
  G643,TH domain coordinates 47-85
MEEGTSGSRRTRSQVAPEWAVKDCLVLVNEIAAVEADCSNALSSFQKWTMITENCNALDVSRNLNQCRRKWDSLMSDYNQIKKWESQYRGTGRSYWSLSSDKRKLLNLPGDIDIELFEAINAVVMIQDEKAGTESDSDPEAQDVVDLSAELAFVGSKRSRQRTMVMKETKKEEPRTSRVQVNTREKPITTKATHQNKTMGEKKPVEDMSTDEEEDETMNIEEDVEVMEAKLSYKIDLIHAIVGRNLAKDNETKDGVSMDDKLKSVRQQGDELIGCLSEIVSTLNRLHEVPQEIE

SEQ ID NO: 515 - DNA, 1029 bp, Arabidopsis thaliana
  G646,family:Z-Dof
atggatacggctcagtggccacaggagattgtagtgaagcccttggaagaaatagtaacaaacacatgcccaaagccgcaaccgcaaccgcttcaaccgcagcagccaccgtcggtgggtggagagaggaaggcaaggccagaaaaggatcaagctgtaaactgtccgagatgtaactcaaccaacacaaagttttgttactacaacaattatagtttgacgcagccaagatacttctgcaaaggttgtagaaggtattggaccgaaggcggttcgcttaggaacattcctgttggcggtggctcaagaaagaacaagagatctcactcttcttcttctgatattagtaacaatcactcggattctacacaaccagctacaaagaagcatctctctgatcatcaccaccacctcatgagcatgtctcaacaaggtttgaccggtcaaaaccctaaattccttgagacgacccaacaagatctcaatttaggtttttcaccacatgggatgattaggaccaacttcactgacctcatccacaacattggcaacaacaccaacaagagcaacaacaataacaatccattgattgtttcttcatgttctgccatggctacttcttctctggatctcataagaaacaatagtaacaatgggaattcttcaaattcttccttcatgggatttccagttcataatcaagatccagcatcaggagggttttcaatgcaagatcattacaagccttgcaacacaaacaccacactgctagggttttcattagatcatcatcataataatggatttcatggagggtttcaaggaggagaagaaggtggagaaggtggtgatgatgtgaatggaaggcacttgtttccttttgaggatttgaaattgccagtttcttcttcatcagcaacaattaatgtcgacattaatgaacatcagaagcgaggaagcggtagtgatgcagctgctacgtctggtgggtattggactgggatgttgagtggaggatcatggtgctaa

SEQ ID NO: 516 - protein, 342 aa, Arabidopsis thaliana
  G646,Z-Dof domain coordinates 55-97
MDTAQWPQEIVVKPLEEIVTNTCPKPQPQPLQPQQPPSVGGERKARPEKDQAVNCPRCNSTNTKFCYYNNYSLTQPRYFCKGCRRYWTEGGSLRNIPVGGGSRKNKRSHSSSSDISNNHSDSTQPATKKHLSDHHHHLMSMSQQGLTGQNPKFLETTQQDLNLGFSPHGMIRTNFTDLIHNIGNNTNKSNNNNNPLIVSSCSAMATSSLDLIRNNSNNGNSSNSSFMGFPVHNQDPASGGFSMQDHYKPCNTNTTLLGFSLDHHHNNGFHGGFQGGEEGGEGGDDVNGRHLFPFEDLKLPVSSSSATINVDINEHQKRGSGSDAAATSGGYWTGMLSGGSWC

SEQ ID NO: 517 - DNA, 869 bp, Arabidopsis thaliana
  G651,family:Z-C2H2
ttctgctctgttttggtaaattgaggaaatggaagagaggcataagtgcaagttatgttggaagagcttcgctaatggaagggctttgggaggtcacatgaggtctcacatgctcattcaccctctccccagtcagcccgagtcatattcgtcttccatggctgatccagggtttgttcttcaggacagagagagtgaaaccgagtcgtccaagaagccctcccgcaaacgatccagacttaaccggagatccatctcatcattacgtcatcaacaatccaacgaagaagggaaaagtgaaaccgcaagagcagcagatatcaagatcggggttcaagaactcagtgagtcgtgtacggagcaggaaccgatgagttcggtgtcggacgctgcaacaacggaagaagacgtggccttgagtctcatgttgctgtcgagagacaagtgggagaaggaggaagaggaaagtgatgaagagagatggaagaagaagaggaataagtggttcgagtgcgagacttgcgagaaagtgtttaagtcgtatcaggcgttagggggacacagagcaagccacaagaagaagatagcagaaacagatcaattaggctcagatgagttgaagaagaagaagaagaagagtactagtagtcaccatgaatgtccaatctgtgccaaagtcttcacatctggtcaagctctcggaggtcacaaaagatctcacgcttccgctaataatgaattcacgagaagatcaggaataataattagcttgatagatctaaatctcccagcgccatcggaggaggaagagatggcctcgtcggttttttaatgcttgatcagattggtcaaactatagtaattaccac

SEQ ID NO: 518 - protein, 267 aa, Arabidopsis thaliana
  G651,Z-C2H2 domain coordinates 5-31,162-182,208-231
MEERHKCKLCWKSFANGRALGGHMRSHMLIHPLPSQPESYSSSMADPGFVLQDRESETESSKKPSRKRSRLNRRSISSLRHQQSNEEGKSETARAADIKIGVQELSESCTEQEPMSSVSDAATTEEDVALSLMLLSRDKWEKEEEESDEERWKKKRNKWFECETCEKVFKSYQALGGHRASHKKKIAETDQLGSDELKKKKKKSTSSHHECPICAKVFTSGQALGGHKRSHASANNEFTRRSGIIISLIDLNLPAPSEEEEMASSVF

SEQ ID NO: 519 - DNA, 606 bp, Arabidopsis thaliana
  G652,family:Z-CLDSH
atgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttga

SEQ ID NO: 520 - protein, 201 aa, Arabidopsis thaliana
  G652,Z-CLDSH domain coordinates 28-49,137-151,182-196
MSGGGDVNMSGGDRRKGTVKWFDTQKGFGFITPSDGGDDLFVHQSSIRSEGFRSLAAEESVEFDVEVDNSGRPKAIEVSGPDGAPVQGNSGGGGSSGGRGGFGGGGGRGGGRGGGSYGGGYGGRGSGGRGGGGGDNSCFKCGEPGHMARECSQGGGGYSGGGGGGRYGSGGGGGGGGGGLSCYSCGESGHFARDCTSGGAR

SEQ ID NO: 521 - DNA, 928 bp, Arabidopsis thaliana
  G653,family:Z-LIM
tcttcatcttcatcttcacgcagcgacttctttgattctctctttttattctcagctccaatttcaacctgcatttctctcttctcaattttgggtttctttttttgatatctcatttgatcagatcgacgaagagaggaagaaggtttgagctgagagatctttggaggtagaaagaagatctcaaaaacgatgtcgtttacaggaactcagcagaaatgcagggcgtgcgagaagacagtgtaccctgtggagcttctctcagctgatggaatctcttatcacaaggcttgcttcaaatgctctcactgcaaaagcagacttcaactgagcaattattcatcaatggaaggagtggtgtattgtaggcctcattttgagcagcttttcaaggagtctggtagtttcagcaagaactttcagtcacctgcaaagccattgactgataagccaaccccggagctgaataggacacctagtcgacttgctggtatgttctctggaacgcaagacaaatgcgctacttgcactaaaaccgtgtatcctatcgaaaaggtaactgtggaaagccagtgttaccataaatcttgcttcaagtgttctcatggaggctgtccgatatctccatcgaactatgcagctctagagggaatattgtactgcaagcaccatttcgctcagcttttcaaggagaaaggaagttacaatcatctcatcaaatctgcttccatcaaacgtgctactgctgctgctaccgcagctgctgcagctgtagcagccgttcccgaatcttgaattcaaattctctttatttttgtgtatgtgctgtgttgtttacatgtattcgatatgattcatgttctttgtcttccataattgaaccaggcataaaattctcccagttttctctgaaaaaaaaaaaaaaaaa

SEQ ID NO: 522 - protein, 200 aa, Arabidopsis thaliana
  G653,Z-LIM domain coordinates 10-61,109-160
MSFTGTQQKCRACEKTVYPVELLSADGISYHKACFKCSHCKSRLQLSNYSSMEGVVYCRPHFEQLFKESGSFSKNFQSPAKPLTDKPTPELNRTPSRLAGMFSGTQDKCATCTKTVYPIEKVTVESQCYHKSCFKCSHGGCPISPSNYAALEGILYCKHHFAQLFKEKGSYNHLIKSASIKRATAAATAAAAAVAAVPES

SEQ ID NO: 523 - DNA, 2331 bp, Arabidopsis thaliana
  G657,family:MYB-(R1)R2R3
atgaagcgtgagatgaaagcacctactactccactagagagtctccaaggtgacctcaaaggaaaacaagggaggacatctggccctgctagacgatctaccaaaggacaatggacacctgaagaggacgaagtcttgtgtaaagctgttgagcgttttcaaggaaagaactggaagaagatagctgaatgttttaaggatcggactgatgttcagtgtcttcatagatggcaaaaggtcttgaacccagagcttgtgaaaggaccgtggtcaaaagaggaggataacacaataattgacctggttgaaaaatatgggccaaagaaatggtctactatatctcagcatttacctgggcgcataggaaagcaatgtagggaaaggtggcataaccatcttaaccctgggattaataaaaatgcatggactcaggaagaggaactgactcttattcgtgcgcatcaaatttatgggaataaatgggcagagcttatgaaatttttgccaggaaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataa

SEQ ID NO: 524 - protein, 776 aa, Arabidopsis thaliana
  G657,MYB-(R1)R2R3 domain coordinates 35-187
MKREMKAPTTPLESLQGDLKGKQGRTSGPARRSTKGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKKLDSYYASGLLDQCQSSPLIALQNKSIASSSSWMHSNGDEGSSRPGVDAEESECSQASTVFSQSTNDLQDEVQRGNEEYYMPEFHSGTEQQISNAASHAEPYYPSFKDVKIVVPEISCETECSKKFQNLNCSHELRTTTATEDQLPGVSNDAKQDRGLELLTHNMDNGGKNQALQQDFQSSVRLSDQPFLSNSDTDPEAQTLITDEECCRVLFPDNMKDSSTSSGEQGRNMVDPQNGKGSLCSQAAETHAHETGKVPALPWHPSSSEGLAGHNCVPLLDSDLKDSLLPRNDSNAPIQGCRLFGATELECKTDTNDGFIDTYGHVTSHGNDDNGGFPEQQGLSYIPKDSLKLVPLNSFSSPSRVNKIYFPIDDKPAEKDKGALCYEPPRFPSADIPFFSCDLVPSNSDLRQEYSPFGIRQLMISSMNCTTPLRLWDSPCHDRSPDVMLNDTAKSFSGAPSILKKRHRDLLSPVLDRRKDKKLKRAATSSLANDFSRLDVMLDEGDDCMTSRPSESPEDKNICASPSIARDNRNCASARLYQEMIPIDEEPKETLESGGVTSMQNENGCNDGGASAKNVSPSLSLHIIWYQL

SEQ ID NO: 525 - DNA, 1033 bp, Arabidopsis thaliana
  G663,family:MYB-(R1)R2R3
gtcgacccacgcgtccgtgggaagccacaataaccccctattcctcggccttttttaaaaaagttttagaataatccgataaaatacttttatattaatttttctttggtccatggagggttcgtccaaagggttgaggaaaggtgcatggactgctgaagaagatagtctcttgaggctatgtattgataagtatggagaaggcaaatggcatcaagttcctttgagagctgggctaaatcgatgcagaaagagttgtagactaagatggttgaactatttgaagccaagtatcaagagaggaagacttagcaatgatgaagttgatcttcttcttcgccttcataagcttctaggaaataggtggtccttgattgctggtcgattgcctggtcggaccgctaatgatgtcaaaaattactggaacacccatctgagtaaaaaacatgagtcttcgtgttgtaagtctaaaatgaaaaagaaaaacattatttcccctcctacaacaccggtccaaaaaatcggtgtttttaagcctcgacctcgatccttctctgttaacaatggttgcagccatctcaatggtctgccagaagttgatttaattccttcatgccttggactcaagaaaaataatgtttgtgaaaatagtatcacatgtaacaaagatgatgagaaagatgattttgtgaataatctaatgaatggagataatatgtggttggagaatttactgggggaaaaccaagaagctgatgcgattgttcctgaagcgacgacagctgaacatggggccactttggcgtttgacgttgagcaactttggagtctgtttgatggagagactgttgaacttgattagtgtttctcaccgtttgtttaagattgtgggtggcttttctttcgtattttagtaatgtatttttctgtatgaagtaaagaatttcagcattttaagaaaaatggttatgtttctacgtaataaaaaaaaacgttatttataaaaaaaaaaaaaaaaaaaaaaaaaaaaaaa

SEQ ID NO: 526 - protein, 249 aa, Arabidopsis thaliana
  G663,MYB-(R1)R2R3 domain coordinates 9-111
MEGSSKGLRKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKKHESSCCKSKMKKKNIISPPTTPVQKIGVFKPRPRSFSVNNGCSHLNGLPEVDLIPSCLGLKKNNVCENSITCNKDDEKDDFVNNLMNGDNMWLENLLGENQEADAIVPEATTAEHGATLAFDVEQLWSLFDGETVELD

SEQ ID NO: 527 - DNA, 1087 bp, Arabidopsis thaliana
  G664,family:MYB-(R1)R2R3
caatccctcaatataaaataacaagtagaattgatctgcctatatataagattttgagacgaaataagatctaaaccacaagaaagaaagtaaacataaaagtatgggaaggtcaccgtgctgtgagaaagctcacacaaacaaaggagcatggacgaaagaagaggacgagaggctcgtcgcctacattaaagctcatggagaaggctgctggagatctctccccaaagccgccggacttcttcgctgtggcaagagctgccgtctccggtggatcaactatctccggcctgaccttaagcgtggaaacttcaccgaggaagaagacgaactcatcatcaagctccatagccttcttggcaacaaatggtcgcttattgccgggagattaccgggaagaacagataacgagataaagaactattggaacacgcatatacgaagaaagcttataaacagagggattgatccaacgagtcatagaccaatccaagaatcatcagcttctcaagattctaaacctacacaactagaaccagttacgagtaataccattaatatctcattcacttctgctccaaaggtcgaaacgttccatgaaagtataagctttccgggaaaatcagagaaaatctcaatgcttacgttcaaagaagaaaaagatgagtgcccagttcaagaaaagttcccagatttgaatcttgagctcagaatcagtcttcctgatgatgttgatcgtcttcaagggcatggaaagtcaacaacgccacgttgtttcaagtgcagcttagggatgataaacggcatggagtgcagatgcggaagaatgagatgcgatgtagtcggaggtagcagcaaggggagtgacatgagcaatggatttgattttttagggttggcaaagaaagagaccacttctcttttgggctttcgaagcttggagatgaaataatattgtcaaattttaggcgtaactgtacaaaacttttgcctagataatttgaaagtatatcttcaacttgtatgagaaatttaactggtgaattataatatatagaatttgttttttaaaaaaaaaaaaaaaaaa

SEQ ID NO: 528 - protein, 282 aa, Arabidopsis thaliana
  G664,MYB-(R1)R2R3 domain coordinates 14-116
MGRSPCCEKAHTNKGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKLINRGIDPTSHRPIQESSASQDSKPTQLEPVTSNTINISFTSAPKVETFHESISFPGKSEKISMLTFKEEKDECPVQEKFPDLNLELRISLPDDVDRLQGHGKSTTPRCFKCSLGMINGMECRCGRMRCDVVGGSSKGSDMSNGFDFLGLAKKETTSLLGFRSLEMK

SEQ ID NO: 529 - DNA, 1310 bp, Arabidopsis thaliana
  G666,family:MYB-(R1)R2R3
attagatccatttcagagctaagcgtactaattagtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgagataaatcagtaataattttatttattttccctctttaatttacaattaatgatggggttgcttttaaa

SEQ ID NO: 530 - protein, 323 aa, Arabidopsis thaliana
  G666,MYB-(R1)R2R3 domain coordinates 14-116
MVRPPCCDKGGVKKGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKLNKVNQDSHQELDRSSLSSSPSSSSANSNSNISRGQWERRLQTDIHLAKKALSEALSPAVAPIITSTVTTTSSSAESRRSTSSASGFLRTQETSTTYASSTENIAKLLKGWVKNSPKTQNSADQIASTEVKEVIKSDDGKECAGAFQSFSEFDHSYQQAGVSPDHETKPDITGCCSNQSQWSLFEKWLFEDSGGQIGDILLDENTNFF

SEQ ID NO: 531 - DNA, 1056 bp, Arabidopsis thaliana
  G668,family:MYB-(R1)R2R3
atgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctag

SEQ ID NO: 532 - protein, 351 aa, Arabidopsis thaliana
  G668,MYB-(R1)R2R3 domain coordinates 14-115
MGRPPCCEKIGVKKGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKLKKINESGEEDNDGVSSSNTSSQKNHQSTNKGQWERRLQTDINMAKQALCEALSLDKPSSTLSSSSSLPTPVITQQNIRNFSSALLDRCYDPSSSSSSTTTTTTSNTTNPYPSGVYASSAENIARLLQDFMKDTPKALTLSSSSPVSETGPLTAAVSEEGGEGFEQSFFSFNSMDETQNLTQETSFFHDQVIKPEITMDQDHGLISQGSLSLFEKWLFDEQSHEMVGMALAGQEGMF

SEQ ID NO: 533 - DNA, 777 bp, Arabidopsis thaliana
  G669,family:MYB-(R1)R2R3
atgggaaagagagcaactactagtgtgaggagagaagagttaaacagaggagcttggactgatcatgaagacaagatccttagagattacatcaccactcacggcgaaggcaaatggagcactctccctaaccaagctggtctcaagaggtgtggcaaaagctgtagacttcggtggaagaactacctaagaccggggataaagcgcggtaacatctcatctgatgaagaagaactcataatccgtctccataatcttcttggaaacagatggtcgttgatagctgggaggcttccaggccgaacagacaatgaaataaagaatcattggaactcaaacctccgcaaaagacttcccaaaactcaaaccaagcaaccaaaacgtataaaacattcgacgaacaacgagaataatgtatgtgttatacgtacaaaggcgattaggtgctcaaagactcttctcttctcggatctctctcttcagaagaagagtagtactagtccactacctctgaaagaacaagagatggatcaaggtggatcttcgttgatgggagatctcgaattcgatttcgataggatccattcggagtttcacttcccggatttgatggattttgatggtttggactgtggaaacgttacatctcttgtttcatctaacgagattttgggagagttggttcctgctcaaggtaatctcgatctcaatagacctttcacttcttgtcatcatcgtggcgacgatgaagattggctccgagacttcacttgttga

SEQ ID NO: 534 - protein, 258 aa, Arabidopsis thaliana
  G669,MYB-(R1)R2R3 domain coordinates 15-118
MGKRATTSVRREELNRGAWTDHEDKILRDYITTHGEGKWSTLPNQAGLKRCGKSCRLRWKNYLRPGIKRGNISSDEEELIIRLHNLLGNRWSLIAGRLPGRTDNEIKNHWNSNLRKRLPKTQTKQPKRIKHSTNNENNVCVIRTKAIRCSKTLLFSDLSLQKKSSTSPLPLKEQEMDQGGSSLMGDLEFDFDRIHSEFHFPDLMDFDGLDCGNVTSLVSSNEILGELVPAQGNLDLNRPFTSCHHRGDDEDWLRDFTC

SEQ ID NO: 535 - DNA, 1307 bp, Arabidopsis thaliana
  G670,family:MYB-(R1)R2R3
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctgtatatttcatgggcgagctgtctttatttttatgtttaaaaaaaaaaaaaaaaaa

SEQ ID NO: 536 - protein, 374 aa, Arabidopsis thaliana
  G670,MYB-(R1)R2R3 domain coordinates 14-122
MGRHSCCYKQKLRKGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKKKLKQRGIDPNTHKPISEVESFSDKDKPTTSNNKRSGNDHKSPSSSSATNQDFFLERPSDLSDYFGFQKLNFNSNLGLSVTTDSSLCSMIPPQFSPGNMVGSVLQTPVCVKPSISLPPDNNSSSPISGGDHVKLAAPNWEFQTNNNNTSNFFDNGGFSWSIPNSSTSSSQVKPNHNFEEIKWSEYLNTPFFIGSTVQSQTSQPIYIKSETDYLANVSNMTDPWSQNENLGTTETSDVFSKDLQRMAVSFGQSL

SEQ ID NO: 537 - DNA, 1384 bp, Arabidopsis thaliana
  G671,family:MYB-(R1)R2R3
ttcacttgagaacaaccccctttgaactcgatcaagaaagctaagtttgaagaatcaagaatggtgcggacaccgtgttgcaaagccgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatagatggtgatgatgaccatgcatgaatcatgaatgtagttcgtgttgtcacatatgcttgtgtttttgtgttttttttttttggtctgaagtgtgttgtttcgttgtaaatggattataaatggtgatgtaataattataatgttaaaaaaaaaaaaaaaaaaaaaaa

SEQ ID NO: 538 - protein, 352 aa, Arabidopsis thaliana
  G671,MYB-(R1)R2R3 domain coordinates 15-115
MVRTPCCKAELGLKKGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKKRLIKKGIDPVTHKGITSGTDKSENLPEKQNVNLTTSDHDLDNDKAKKNNKNFGLSSASFLNKVANRFGKRINQSVLSEIIGSGGPLASTSHTTNTTTTSVSVDSESVKSTSSSFAPTSNLLCHGTVATTPVSSNFDVDGNVNLTCSSSTFSDSSVNNPLMYCDNFVGNNNVDDEDTIGFSTFLNDEDFMMLEESCVENTAFMKELTRFLHEDENDVVDVTPVYERQDLFDEIDNYFG

SEQ ID NO: 539 - DNA, 786 bp, Arabidopsis thaliana
  G674,family:MYB-(R1)R2R3
atggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaa

SEQ ID NO: 540 - protein, 261 aa, Arabidopsis thaliana
  G674,MYB-(R1)R2R3 domain coordinates 20-120
MVFKSEKSNREMKSKEKQRKGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKKGVTLKQHETTKKHQTPLITNSLEALQSSTERSSSSINVGETSNAQTSSFSPNLVFSEWLDHSLLMDQSPQKSSYVQNLVLPEERGFIGPCGPRYLGNDSLPDFVPNSEFLLDDEISSEIEFCTSFSDNFLFDGLINELRPM

SEQ ID NO: 541 - DNA, 1292 bp, Arabidopsis thaliana
  G675,family:MYB-(R1)R2R3
taatcagagagagatggggaggtcgccttgttgcgacgagaatggtctaaagaaagggccatggactcctgaagaagatcaaaagcttattgattacattcataaacatggtcatggaagctggagagctctccccaagctcgcagatttgaataggtgtggaaagagttgtagactgaggtggacaaattatttgagaccagacatcaaaagaggaaagttttcagccgaagaagagcaaacaatcctccatctccactccattctcgggaataaatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgttagtcttttgtttaaaaaaaaaaaaaaaaaaaa

SEQ ID NO: 542 - protein, 365 aa, Arabidopsis thaliana
  G675,MYB-(R1)R2R3 domain coordinates 13-116
MGRSPCCDENGLKKGPWTPEEDQKLIDYIHKHGHGSWRALPKLADLNRCGKSCRLRWTNYLRPDIKRGKFSAEEEQTILHLHSILGNKWSAIATHLQGRTDNEIKNFWNTHLKKKLIQMGIDPVTHQPRTDLFASLPQLIALANLKDLIEQTSQFSSMQGEAAQLANLQYLQRMFNSSASLTNNNGNNFSPSSILDIDQHHAMNLLNSMVSWNKDQNPAFDPVLELEANDQNQDLFPLGFIIDQPTQPLQQQKYHLNNSPSELPSQGDPLLDHVPFSLQTPLNSEDHFIDNLVKHPTDHEHEHDDNPSSWVLPSLIDNNPKTVTSSLPHNNPADASSSSSYGGCEAASFYWPDICFDESLMNVIS

SEQ ID NO: 543 - DNA, 612 bp, Arabidopsis thaliana
  G676,family:MYB-(R1)R2R3
atgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtttaaagagatgtggaaagagttgtagattgaggtggatgaattatctcagccctaatgtgaaaagaggcaatttcaccgagcaagaagaggatcttatcattaggctccacaagttgcttggtaataggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttga

SEQ ID NO: 544 - protein, 203 aa, Arabidopsis thaliana
  G676,MYB-(R1)R2R3 domain coordinates 17-119
MRKKVSSSGDEGNNEYKKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKKLGIKDQKTKQSNGDIVYQINLPNPTETSEETKISNIVDNNNILGDEIQEDHQGSNYLSSLWVHEDEFELSTLTNMMDFIDGHCF

SEQ ID NO: 545 - DNA, 2526 bp, Arabidopsis thaliana
  G680,family:MYB-related
cagttatcttcttccttcttctctctgttttttaaatttatttttagagaattttttttgttttgcttccgatttgattatttccgggaacgatgacttctccggggagttcccggtgagatgataagtcagattgcatacttgtctcctccatggctactctcaagggttttggctgcggtggattcgtttggtttctctagaatctaaagaggttatcacaacggctttgcaatttgaaaactttcatgtttggggagatcaaagatggtttcttttttatactttacttgttagagaggatttgaagcagcgaatagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggtaaaaaaaaaacatccacatttttatcaatatctttaaatctagtgttagtagtttgcttctccaatctttatgaaagagacttttaattttccttccgaacatttctttggtcatgtcaggttctgtaccatattaccccatgtcttgtctcttgtctctgtttgtgtatgctacttgtggtctatatgtcatctgctactactgttaattaaccattaagcaatggatttgtcttta

SEQ ID NO: 546 - protein, 645 aa, Arabidopsis thaliana
  G680,MYB-related domain coordinates 25-71
MDTNTSGEELLAKARKPYTITKQRERWTEDEHERFLEALRLYGRAWQRIEEHIGTKTAVQIRSHAQKFFTKLEKEAEVKGIPVCQALDIEIPPPRPKRKPNTPYPRKPGNNGTSSSQVSSAKDAKLVSSASSSQLNQAFLDLEKMPFSEKTSTGKENQDENCSGVSTVNKYPLPTKQVSGDIETSKTSTVDNAVQDVPKKNKDKDGNDGTTVHSMQNYPWHFHADIVNGNIAKCPQNHPSGMVSQDFMFHPMREETHGHANLQATTASATTTASHQAFPACHSQDDYRSFLQISSTFSNLIMSTLLQNPAAHAAATFAASVWPYASVGNSGDSSTPMSSSPPSITAIAAATVAAATAWWASHGLLPVCAPAPITCVPFSTVAVPTPAMTEMDTVENTQPFEKQNTALQDQTLASKSPASSSDDSDETGVTKLNADSKTNDDKIEEVVVTAAVHDSNTAQKKNLVDRSSCGSNTPSGSDAETDALDKMEKDKEDVKETDENQPDVIELNNRKIKMRDNNSNNNATTDSWKEVSEEGRIAFQALFARERLPQSFSPPQVAENVNRKQSDTSMPLAPNFKSQDSCAADQEGVVMIGVGTCKSLKTRQTGFKPYKRCSMEVKESQVGNINNQSDEKVCKRLRLEGEAST

SEQ ID NO: 547 - DNA, 840 bp, Arabidopsis thaliana
  G681,family:MYB-(R1)R2R3
atggggaggacgacatggttcgacgtcgacgggatgaagaaaggagagtggacggcagaggaagaccagaagctcggcgcttacatcaacgagcatggcgtttgtgattggcgttccctccccaaaagagctggtttgcagagatgtggaaagagctgcagattaaggtggcttaactatctaaagcctgggattagaagaggcaaattcactcctcaagaagaagaagaaatcatccaacttcatgctgttctcggaaacaggtgggcagccatggcgaagaagatgcagaatcgaacagacaatgatatcaagaaccattggaactcttgtctcaagaaaagactttcgagaaagggaatcgaccctatgacccacgagcccatcatcaaacacctcaccgtcaataccactaacgcagattgtggtaactcttccaccacgacgtccccgtcgacgacggaaagctctccttcctccggctcgtctcgtcttcttaacaaactcgccgcaggtatctcatctagacaacatagtctcgataggatcaagtacatcttgtcgaattcaataatcgaaagcagtgatcaagcaaaagaggaagaagaaaaagaagaagaagaagaagaaagagattcaatgatgggtcagaagattgacggtagtgaaggagaagatattcagatttggggcgaggaggaagttaggcgtttaatggagattgatgcaatggatatgtacgagatgacttcgtacgacgctgtcatgtacgagagtagtcacatacttgatcatctcttttgacttaatatagtgtgactgtgtgagtgcatgcatgtt

SEQ ID NO: 548 - protein, 267 aa, Arabidopsis thaliana
  G681,MYB-(R1)R2R3 domain coordinates 14-120
MGRTTWFDVDGMKKGEWTAEEDQKLGAYINEHGVCDWRSLPKRAGLQRCGKSCRLRWLNYLKPGIRRGKFTPQEEEEIIQLHAVLGNRWAAMAKKMQNRTDNDIKNHWNSCLKKRLSRKGIDPMTHEPIIKHLTVNTTNADCGNSSTTTSPSTTESSPSSGSSRLLNKLAAGISSRQHSLDRIKYILSNSIIESSDQAKEEEEKEEEEEERDSMMGQKIDGSEGEDIQIWGEEEVRRLMEIDAMDMYEMTSYDAVMYESSHILDHLF

SEQ ID NO: 549 - DNA, 341 bp, Arabidopsis thaliana
  G682,family:MYB-related
acatggataaccatcgcaggactaagcaacccaagaccaactccatcgttacttcttcttctgaaggaacagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgaaaagtgatcaatatatctctatagtttcactgattgtttcgattatattccgttgtattttaaatttaccaactctgttataagaagaaaactttcttaaatccc

SEQ ID NO: 550 - protein, 77 aa, Arabidopsis thaliana
  G682,MYB-related domain coordinates 33-77
MDNHRRTKQPKTNSIVTSSSEGTEVSSLEWEVVNMSQEEEDLVSRMHKLVGDRWELIAGRIPGRTAGEIERFWVMKN

SEQ ID NO: 551 - DNA, 2562 bp, Arabidopsis thaliana
  G707,family:HB
ctctcatccatggcggatttcttctatcttcattaaatatttccctctttattaaaatctcatgaatttcaacggttttctcgacgacggtgctggagcctcaaagctactctctgatgctccgtacaacaaccacttctctttctccgccgtagacaccatgctcggaagcgccgccattgctccttctcagtctcttcctttctcttcttcaggcctctctctcggactccaaacaaatggagaaatgagtagaaacggagagattatggagtcaaacgtaagtcgtaagagtagtagaggagaagatgtagaaagcagatctgaaagtgataacgctgaagctgtctccggtgacgatttagatacctccgatagacctttaaagaagaagaaacgttaccatcgtcacactcctaaacaaattcaagacctcgaatcggtttttaaagagtgtgcacatccagacgagaagcaacgtcttgatcttagccgtcgacttaacttagatcctcgtcaagtcaagttctggttccagaatcgtcgtactcagatgaagactcaaatcgaacgacatgagaatgctttgttgaggcaagagaacgataagcttcgagctgagaatatgtctgtacgcgaagctatgagaaaccctatgtgtggtaattgcggcggacctgccgttatcggtgagatctcaatggaagagcaacatctgagaattgaaaactctcgtctcaaagatgagttagaccgagtctgtgccttaaccggtaagtttcttggccggtctaatggttcacatcatataccggactcagcacttgttctcggcgttggtgttggttctggtggatgtaatgttggtggtggtttcactctctcttctccgctgttgcctcaagcttctcctagatttgagatttctaatggaaccggttctggtttggtggctacggttaaccgtcaacaaccggttagtgttagtgattttgatcagagatcgaggtatttggatttagctcttgcggctatggatgagcttgtgaagatggctcagacacgtgagccgctctgggttcgaagctcggattctggttttgaagtgctgaaccaggaagagtacgacacaagtttctctcggtgtgttggaccaaaacaagatgggtttgtctcagaagcttctaaagaagctggaactgttatcatcaatagcttagcgctcgttgaaaccttaatggactcggaacggtgggcggaaatgtttcctagtatggtctcaagaacttcaaccacagagattatctctagtggcatgggagggcgaaatggtgcacttcacctgatgcacgcagagcttcaactgctgtctccactcgtgccggttagacaagtgtcgttcttgcggttctgtaaacagcacgcggaaggtgtttgggcagtcgtggatgtctcaattgattccattagagaaggttcttcttcgagctgtagaagattaccatccggttgcctcgtacaagacatggccaatggctactcaaaggtaacatggatcgagcacacggagtatgacgaaaaccacatccaccgtttataccgcccattactcaggtgcggtctagcgtttggtgcgcatcgatggatggctgcattacaacgtcaatgcgaatgcctcacgattctcatgtcctccactgtttccacttccactaatccatcccctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctgatcatcgagatcagacgatggaggagattgagtcaagaacgaacctcattttgtgatgaatccgtttttgtgatg

SEQ ID NO: 552 - protein, 808 aa, Arabidopsis thaliana
  G707,HB domain coordinates 109-169
MNFNGFLDDGAGASKLLSDAPYNNHFSFSAVDTMLGSAAIAPSQSLPFSSSGLSLGLQTNGEMSRNGEIMESNVSRKSSRGEDVESRSESDNAEAVSGDDLDTSDRPLKKKKRYHRHTPKQIQDLESVFKECAHPDEKQRLDLSRRLNLDPRQVKFWFQNRRTQMKTQIERHENALLRQENDKLRAENMSVREAMRNPMCGNCGGPAVIGEISMEEQHLRIENSRLKDELDRVCALTGKFLGRSNGSHHIPDSALVLGVGVGSGGCNVGGGFTLSSPLLPQASPRFEISNGTGSGLVATVNRQQPVSVSDFDQRSRYLDLALAAMDELVKMAQTREPLWVRSSDSGFEVLNQEEYDTSFSRCVGPKQDGFVSEASKEAGTVIINSLALVETLMDSERWAEMFPSMVSRTSTTEIISSGMGGRNGALHLMHAELQLLSPLVPVRQVSFLRFCKQHAEGVWAVVDVSIDSIREGSSSSCRRLPSGCLVQDMANGYSKVTWIEHTEYDENHIHRLYRPLLRCGLAFGAHRWMAALQRQCECLTILMSSTVSTSTNPSPINCNGRKSMLKLAKRMTDNFCGGVCASSLQKWSKLNVGNVDEDVRIMTRKSVNNPGEPPGIILNAATSVWMPVSPRRLFDFLGNERLRSEWDILSNGGPMKEMAHIAKGHDRSNSVSLLRASAINANQSSMLILQETSIDAAGAVVVYAPVDIPAMQAVMNGGDSAYVALLPSGFAILPNGQAGTQRCAAEERNSIGNGGCMEEGGSLLTVAFQILVNSLPTAKLTVESVETVNNLISCTVQKIKAALHCDST

SEQ ID NO: 553 - DNA, 925 bp, Arabidopsis thaliana
  G714,family:CAAT
ccacgcgtccgcgtcaatctttgagtttggtagagaaatggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaaggcgtatatgggtcagccaatgtggcaacaaccaggacctgagcagcaggatcctgacaattagcttggcctaataaactagccgtctaattcgaagctctccccggtggatctactcaagaagaagaatgttaatagaaaactattgcgacataaaaagtttggtgtagtagaataatttctgttttatgatccatggatttatcaattgttattcagtttggtttatcttgtcatcaaactgttttcggtcaatgtaacaaattcataaattgagaattgaacttacaaaaggcta

SEQ ID NO: 554 - protein, 217 aa, Arabidopsis thaliana
  G714,CAAT domain coordinates 58-150
MDQQGQSSAMNYGSNPYQTNAMTTTPTGSDHPAYHQIHQQQQQQLTQQLQSFWETQFKEIEKTTDFKNHSLPLARIKKIMKADEDVRMISAEAPVVFARACEMFILELTLRSWNHTEENKRRTLQKNDIAAAVTRTDIFDFLVDIVPREDLRDEVLGGVGAEAATAAGYPYGYLPPGTAPIGNPGMVMGNPGAYPPKAYMGQPMWQQPGPEQQDPDN

SEQ ID NO: 555 - DNA, 705 bp, Arabidopsis thaliana
  G715,family:CAAT
atggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaaggttaa

SEQ ID NO: 556 - protein, 234 aa, Arabidopsis thaliana
  G715,CAAT domain coordinates 53-149
MDTNNQQPPPSAAGIPPPPPGTTISAAGGGASYHHLLQQQQQQLQLFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKDEAAVLGGGMVVAPTASGVPYYYPPMGQPAGPGGMMIGRPAMDPNGVYVQPPSQAWQSVWQTSTGTGDDVSYGSGGSSGQGNLDGQG

SEQ ID NO: 557 - DNA, 1530 bp, Arabidopsis thaliana
  G718,family:SBP
aagctttactctattgaagacgagatccttctctaatttacagattttggtggtcagtgtctgatggagtgtaatgcaaagccaccgtttcaatgggaattggaaaacttgatatcttttggcacttctacagctgaagttcctagaaagctaaaaccaatggagtgggaaattgatggatttgattgcacctctctgtattcttcaagctttgcctatgctggtagttcaggttctgatatagctcatgctttctctaaaagctcaaagtcaacttccattagctcttcatcagctgaagtaagaacacacaattttacatccgaaactggtgaaagtcttcctggagaatttgcaaaggggattgatacttctccaactcttgaactttcttttggctctggtgatccggttctcggtttaaagcttgctaaacgaacgtactttgaagacttttgggaagtggagaatgctaaaggtttgggacttcctgtgactctcgcttcatcttctgtttctcccgtgaagaaatcgaaatccattcctcagaccttacaaactcctcactgtcaagttgaaggctgtaatcttgatctttcatcagctaaagactatcatcggaaacataggatttgtgaaaaccattcaaagtttcctaaagtcgttgtgagtggcgtagagcgtcggttctgccaacaatgtagcaggttccactgtctctccgagtttgatgagaagaaacgtagctgtcgccgacctctctcagatcacaatgcaagacgtcgcaagccaaatcctggaaggacatatgatgggaaaccacaggtggattttgtatggaacagatttgcacttatccatccaagaagtgaggaaaagtttctatggcccagttcaaagcctgtaccatcaagagtcttaatgccgcagcctgcaaagaccgagatttccaataagctgttcaccgagcacagtagatttggattgttggaccccaaaacaaaatccgcaagagcggagttattcagtaaagaaaaggtcacaatctcttcacacatgggtgcttctcaagatcttgatggtgctctctctcttctgtcaaattcaacaacatgggtttcttcctctgaccaaccaagacgttttacccttgatcaccatccctcaagcaacctccaacccgtagctaaccggtctgcggctcaactcagttcagtgtccggctattggcagccggacccacccgcagttgaaggcccgaccgctctgcatagaaatggggcaggccagtttaatgaaaactacttcagcttgaaccagttttataactgaaagctgtatgcctttaaatcctatttaggatcaagcaagctagtgataagttaagataggagctgtgaaacttgcaagacaccaaatcctctcttatttctttgtccaaatattttcatgggttagagagctttgacaattgtctttaatatcaactttatcgtgttatacattaggattataaaaaaaaaaaaaaaa

SEQ ID NO: 558 - protein, 422 aa, Arabidopsis thaliana
  G718,SBP domain coordinates 169-242
MECNAKPPFQWELENLISFGTSTAEVPRKLKPMEWEIDGFDCTSLYSSSFAYAGSSGSDIAHAFSKSSKSTSISSSSAEVRTHNFTSETGESLPGEFAKGIDTSPTLELSFGSGDPVLGLKLAKRTYFEDFWEVENAKGLGLPVTLASSSVSPVKKSKSIPQTLQTPHCQVEGCNLDLSSAKDYHRKHRICENHSKFPKVVVSGVERRFCQQCSRFHCLSEFDEKKRSCRRPLSDHNARRRKPNPGRTYDGKPQVDFVWNRFALIHPRSEEKFLWPSSKPVPSRVLMPQPAKTEISNKLFTEHSRFGLLDPKTKSARAELFSKEKVTISSHMGASQDLDGALSLLSNSTTWVSSSDQPRRFTLDHHPSSNLQPVANRSAAQLSSVSGYWQPDPPAVEGPTALHRNGAGQFNENYFSLNQFYN

SEQ ID NO: 559 - DNA, 2209 bp, Arabidopsis thaliana
  G720,family:GARP
ctttgaatgtgactcaggatagagagagggcgagacagataaagagagcttgaggaaggatttaagcagatctgcaagaaacactctctcagtgtttactttttttccgtagaatcaaaccggcggcgacagtgacggcggcgaaaagcggcggtgttggccgcaaaaacgatgcaaaaccagctatggtcattaccgctaacgatttatcaaaatgggaaaattttcctaaaggacttaaggttcttcttctcctcaacggctgtgacagcgacggagatggctcctcagccgccgagactcgatcagagctcgaatcaatggactatatcgttactacattcaccgatgaaactgaagcactctctgcggttgtcaagaacccggagagcttccacattgccatcgtcgaggtgaatatgagcgctgagagtgagagtttcaagtttcttgaggctgccaaagacgttcttcctactataatgatttcaaccgatcattgcatcactactacaatgaaatgcatagcgcttggtgcagttgagttcctacaaaaaccgctctcaccggagaaattaaagaacatttggcagcatgttgttcataaggcattcaatgatggtggaagtaatgtttcgatatcacttaagccagtgaaagaatccgttgtctcgatgcttcatcttgagaccgacatgacaatcgaggagaaagatccagcgccatcaacaccgcaattgaaacaagattcacggttactagacggtgattgccaagagaacataaatttctcgatggaaaatgtaaattcctcgaccgagaaagataacatggaagatcatcaagacatcggtgaatctaaatcagtcgacactacaaaccgcaaattagatgacgacaaagtggttgtcaaagaagagagaggagacagtgaaaaagaagaagaaggtgaaaccggagatctcataagcgagaagacagattcagttgatattcataagaaagaagatgagactaaaccgattaataaatcatccgggatcaagaacgtgtctggtaacaaaactagtcgaaagaaggtggattggacaccagagctgcacaagaagtttgtgcaagcagttgagcaactcggcgttgatcaagcgataccctcgcggattcttgagttgatgaaagtaggcaccttaacaagacacaatgtagctagtcaccttcagaaatttcggcagcataggaagaatattcttccaaaggatgatcataaccatagatggatacaatctagagagaaccatagaccaaatcaacgtaattataacgtttttcaacagcaacaccgtcccgtgatggcttatcccgtttggggtcttcccggtgtttatccgccaggagcgattccacctttgtggccaccgccgctgcagtccattggtcaaccacctccgtggcattggaaaccaccttatccaacggtgagcggtaatgcatggggttgtccggttggaccgcctgtgaccggatcatatattactccttcgaatactaccgccggcggatttcaatatcccaacggagctgaaaccggcttcaaaataatgccggcgagtcagccggacgaggaaatgttagatcaagtggttaaagaagcgataagcaaaccgtggctgccgctaccgctcgggctaaaaccgccgtccgcggagagcgttttggctgagctaacgcgtcaaggcatctcagccgtcccttcttcttcttgtctaatcaacggctctcatcgtctccgctgacgtgtccatgatgaaacagaacccgcagatatgatgacgtcatgcgtggcgtacttgtccgtgtctgacgatccgaagcgggaactgattcggatcctgagagttgttttttaattgttgtttttaattttttgttgtcataaaaacatttgtctctattggtattattaaagaagatcggacggtggagatagaggcaacgatgttagtctgaggaccacaagtggactctgcggctgtaagtagatctcggacacgggattttgacaagtcggaatctgacgtgtgtgcgtactcgcttttgtgggttgtcgagaatttaatagttgacactgttttaggtggatatgagatatgatgatgataataataaaaaggtacaactcaaagattccgtgatgaaaaaaaaaaaaaaa

SEQ ID NO: 560 - protein, 535 aa, Arabidopsis thaliana
  G720,GARP domain coordinates 301-349
MVITANDLSKWENFPKGLKVLLLLNGCDSDGDGSSAAETRSELESMDYIVTTFTDETEALSAVVKNPESFHIAIVEVNMSAESESFKFLEAAKDVLPTIMISTDHCITTTMKCIALGAVEFLQKPLSPEKLKNIWQHVVHKAFNDGGSNVSISLKPVKESVVSMLHLETDMTIEEKDPAPSTPQLKQDSRLLDGDCQENINFSMENVNSSTEKDNMEDHQDIGESKSVDTTNRKLDDDKVVVKEERGDSEKEEEGETGDLISEKTDSVDIHKKEDETKPINKSSGIKNVSGNKTSRKKVDWTPELHKKFVQAVEQLGVDQAIPSRILELMKVGTLTRHNVASHLQKFRQHRKNILPKDDHNHRWIQSRENHRPNQRNYNVFQQQHRPVMAYPVWGLPGVYPPGAIPPLWPPPLQSIGQPPPWHWKPPYPTVSGNAWGCPVGPPVTGSYITPSNTTAGGFQYPNGAETGFKIMPASQPDEEMLDQVVKEAISKPWLPLPLGLKPPSAESVLAELTRQGISAVPSSSCLINGSHRLR

SEQ ID NO: 561 - DNA, 1254 bp, Arabidopsis thaliana
  G728,family:GARP
tcgacccacgcgtccgaaacagaaaccgatcaaaggatgggtcttaatctgaatttgtctatctactctttaccaaaacccttatctcaatttctcgatgaagtgtcgaggatcaaagacaatcattccaaactgtctgaaatcgatggttatgtcggaaaattagaggaagaaaggaacaaaatcgatgtttttaaacgagaactccctttatgcatgctcttattgaacgaagcgattggggcgttgaaggatgaggctagaaaagggttatcactgatggcatctaatgggaaattcgatgatgttgaaagggcaaaaccggaaactgataagaagagctggatgagctctgcccagttatggatctcgaaccctaattcccaattccgatcgacaaatgaagaagaagaagatcggtgtgtgagtcagaacccatttcagacatgtaattaccctaatcaaggaggggtatttatgccatttaaccgtcccccacctcctccaccaccagctcctctgtctctcatgactccaacatcagagatgatgatggattatagcagaattgagcagagtcatcatcatcatcaattcaataaaccttcttcacagagtcatcacattcagaagaaagagcagagaaggagatggtcacaggaacttcaccgtaaatttgttgatgctcttcataggcttggagggccacaagttgctacaccaaagcagattagagatttgatgaaagttgatggtttaaccaatgatgaagtcaagagccatttacaaaaatatagaatgcatatccgtaagcatccgctgcatccgacaaagactttgtcatcgtcggatcagccaggtgtgttagagagagaatcgcagagcttaataagtttgtcgaggtcggattcgccacaaagcccacttgttgcaagagggttgttcagtagtaatgttggtcatagctcagaggaagatgaggaggaggaggatgaagaggaggagaagtctgatggacgtagtagctgtagaaatgatgaaacaaagaagaagagacaagtgttggatcttgagctttgaaagtctgcatagtgaatgatataatctttaccaacttatgttatatatgctcaaaactttgagtttgttcgggagtttttgtagatgtaaacatgagagttgaaataaggaagaggattttgagcaaaaagtagggtttgtttttgcaagaggaaatagatagagaagagtggc

SEQ ID NO: 562 - protein, 347 aa, Arabidopsis thaliana
  G728,GARP domain coordinates 206-255
MGLNLNLSIYSLPKPLSQFLDEVSRIKDNHSKLSEIDGYVGKLEEERNKIDVFKRELPLCMLLLNEAIGALKDEARKGLSLMASNGKFDDVERAKPETDKKSWMSSAQLWISNPNSQFRSTNEEEEDRCVSQNPFQTCNYPNQGGVFMPFNRPPPPPPPAPLSLMTPTSEMMMDYSRIEQSHHHHQFNKPSSQSHHIQKKEQRRRWSQELHRKFVDALHRLGGPQVATPKQIRDLMKVDGLTNDEVKSHLQKYRMHIRKHPLHPTKTLSSSDQPGVLERESQSLISLSRSDSPQSPLVARGLFSSNVGHSSEEDEEEEDEEEEKSDGRSSCRNDETKKKRQVLDLEL

SEQ ID NO: 563 - DNA, 1760 bp, Arabidopsis thaliana
  G729,family:GARP
aaaaaaaacaaaagaatagtcatcatcatcatcaccatcatcatccttatcatcatcaacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtatgcagtatatatctttgtgacgatgaaattctcagcgtaaaagaaggagaacacgtagagagccaagctgctcaagagtgttgatttttgcacagagagagagaatatcactaccaaaatgaagaaatttggaggttcctcttctcaagttccattgatgatttgattataaagtggatgatcaatgtatgagtttttgtttttgggttttcgggtttttagttttttgaggttgatctggtggtgtgatcataagttatataattggaagatcatcaaaatgtggtgaaagtttggatatttttttgaaagcctcttggttggctagagggtttcaagttttttttttttttttt

SEQ ID NO: 564 - protein, 403 aa, Arabidopsis thaliana
  G729,GARP domain coordinates 224-272
MSMEGVFLEKTKTNTTTTLPDLSLHISLPDIHQYHHNESSKESSRRSSQLENNNRSSNFELSLSHHNHPTARIFHCPDRRTLNLPHQQHYNNPIINGVHQRVDESEISNLHRPIRGIPVYHNRSFPFHQQNSSLPSLGGGDMDQISILNSSSGYNNAYRSLQSSPRLKGVPLHHHHHHNQYGVVGSSDSSSPHHHNHHHHGMIRSRFLPKMPTKRSMRAPRMRWTSSLHARFVHAVELLGGHERATPKSVLELMDVKDLTLAHVKSHLQMYRTVKTTNKPAASSDGSGEEEMGINGNEVHHQSSTDQRAQSDDTSLHQETDISSTQPRWSNSSRETWPLSNNCSSDIDTMIRTSSTSMISHYQRSSIQNQEQRSNDQAKRCGNLSCENPSLEFTLGRPDWHEK

SEQ ID NO: 565 - DNA, 1182 bp, Arabidopsis thaliana
  G730,family:GARP
ctttttgaaataaataacattatacccctcctttttcccataaaattcatcaagattatctcaaaatcattcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttcttatatatactaaaaatacatattatctgttaaaaattatataaatctcaaacttaaaagtttatgcttttgaaaaaatatatatgaaatgacgtttatttcttccttaaaaaaaaaaa

SEQ ID NO: 566 - protein, 322 aa, Arabidopsis thaliana
  G730,GARP domain coordinates 169-217
MELFPSQPDLYLKISRRREEEQEKESQELQEQEVERRLGFQSKASDLDNKSSNNLIHTLQFTSNNEATKINSNQEHKESLDQDLRSIFMMRPIRGIPLYQNQVLDHYYYSSTSPNPFFFSEVNGQHASRRLITNPNCSFNLHNRHRRQAQPQPPRFTAKRGVRAPRMRWTTTLHAHFVHAVQLLGGHERATPKSVLELMDVQDLTLAHVKSHLQMYRTIKSTEKPTTSSGQSDCENGSQVNSEREARNLTGLWNNSSSEARFQLKAKASSGVDISSNENEWKNRRCPSNERLSSDSSSLTGTRPETETPNLDFTLATPNLSP

SEQ ID NO: 567 - DNA, 834 bp, Arabidopsis thaliana
  G732,family:bZIP
aaaaaaaccaaacataaaacataaaactctgtcctttttttgtcttcttgtaacttttcttgttaaaaatcaatggcgtcatctagcagcacataccggagctcaagctcttccgacggtggtaataataacccgtcggactccgtcgtcaccgtcgacgaacgaaaacgtaaaagaatgttatcgaacagagaatctgcacgtaggtcaaggatgcgtaaacagaaacacgttgatgatctaacggctcagatcaatcagctatcaaacgacaaccgtcagatcttgaacagcctcaccgtaacatctcagctttacatgaagatccaagccgagaactctgttctcaccgctcagatggaggagcttagcaccagactccaatctctcaacgagatcgttgatcttgttcaatccaacggtgcaggatttggtgttgaccagatcgacggctgtggttttgatgatcgtacggttgggatcgacggatattacgatgatatgaatatgatgagtaatgttaatcattggggtggttcggtttacactaaccaacccattatggctaatgatatcaatatgtattgattaataaaattaattaaaataattagatgccccttttttgtctttttattttaaaatttagcccattttggtgtttttgggttggtgtgatgatgtaattatagtacatgcatctttgattggttggaaggataaatataaactttatatatatattggggcatatatatatgagttgtactttgcatgtattggtgtgtgttttgttataattatatgattatatatgtttatgttaaaaaaaaa

SEQ ID NO: 568 - protein, 171 aa, Arabidopsis thaliana
  G732,bZIP domain coordinates 31-91
MASSSSTYRSSSSSDGGNNNPSDSVVTVDERKRKRMLSNRESARRSRMRKQKHVDDLTAQINQLSNDNRQILNSLTVTSQLYMKIQAENSVLTAQMEELSTRLQSLNEIVDLVQSNGAGFGVDQIDGCGFDDRTVGIDGYYDDMNMMSNVNHWGGSVYTNQPIMANDINMY

SEQ ID NO: 569 - DNA, 1060 bp, Arabidopsis thaliana
  G735,family:bZIP
acaaattacaaaagagaaaagatggaaaaagttttctccgacgaagaaatctccggtaaccatcactggtcggttaatggaatgacgtcgttgaatcgcagtgcttccgaatgggcattcaatcgtttcatacaagaatcctccgccgctgcagacgacggagaatctacgacggcgtgtggtgtttccgtctcctctcctcctaatgttcctgtagattcagaggaatacagagcatttctcaagagtaaacttaatcttgcttgtgctgctgtcgccatgaaaaggggaactttcatcaaacctcaggatacttctggtagatctgacaatggtggagccaatgaatcagaacaagcctctcttgcttcttccaaagctacaccaatgatgagcagtgctataacaagtggatctgagctctctggtgatgaagaagaagctgatggtgaaactaatatgaaccctactaatgttaaacgcgttaaaaggatgctctctaatagagaatcagctagacggtccagaagaagaaagcaagcacacttgagtgagctagagacacaagtttcacagcttcgtgtagagaattcaaaactcatgaagggtctcactgatgtaactcaaacattcaatgatgcatctgtagaaaacagagttttaaaagccaatattgagacactacgagcaaaggtgaaaatggctgaagagacagtgaagagactcactggctttaacccaatgttccacaatatgcctcagattgtttcaactgtctctcttccttcagagacatcaaattctccagacactacaagcagccaagtgactacaccagagatcattagctcggggaacaaaggcaaggccttgatagggtgcaagatgaacagaacagcttcgatgcgtagagttgagagcttggaacatctgcagaaacgtattcgaagcgttggggatcagtagctgttaaagaagaatcttgatttgtaacattaatcttaagacatatgttaaagacaaaatgttgtatgtttttggcggccgcgaattcctgcag

SEQ ID NO: 570 - protein, 314 aa, Arabidopsis thaliana
  G735,bZIP domain coordinates 153-237
MEKVFSDEEISGNHHWSVNGMTSLNRSASEWAFNRFIQESSAAADDGESTTACGVSVSSPPNVPVDSEEYRAFLKSKLNLACAAVAMKRGTFIKPQDTSGRSDNGGANESEQASLASSKATPMMSSAITSGSELSGDEEEADGETNMNPTNVKRVKRMLSNRESARRSRRRKQAHLSELETQVSQLRVENSKLMKGLTDVTQTFNDASVENRVLKANIETLRAKVKMAEETVKRLTGFNPMFHNMPQIVSTVSLPSETSNSPDTTSSQVTTPEIISSGNKGKALIGCKMNRTASMRRVESLEHLQKRIRSVGDQ

SEQ ID NO: 571 - DNA, 513 bp, Arabidopsis thaliana
  G736,family:Z-Dof
atggcgactcaagattctcaagggattaaactctttggcaaaactattgcatttaacactcgaacaataaaaaatgaagaagagacacacccgccggagcaagaagccacaatagccgttagatcatcatcatcatcggatctgacggccgagaagcgtccggataagatcatagcatgtccaagatgcaagagcatggagacaaagttctgttacttcaacaactacaacggtaatcagcctcgacacttttgtaaaggctgccaccgttactggaccgccggtggtgcactccggaacgttcccgtcggcgccggtcgtcggaagtccaaaccacctggtcgtgtcgtggttggtatgcttggagatggaaatggtgttcgccaagtcgagcttataaatggcttgctcgttgaggagtggcagcatgccgcagccgcagctcacggtagtttccggcatgattttcccatgaagcggctccggtgttactccgacggtcaatcgtgctga

SEQ ID NO: 572 - protein, 170 aa, Arabidopsis thaliana
  G736,Z-Dof domain coordinates 54-111
MATQDSQGIKLFGKTIAFNTRTIKNEEETHPPEQEATIAVRSSSSSDLTAEKRPDKIIACPRCKSMETKFCYFNNYNGNQPRHFCKGCHRYWTAGGALRNVPVGAGRRKSKPPGRVVVGMLGDGNGVRQVELINGLLVEEWQHAAAAAHGSFRHDFPMKRLRCYSDGQSC

SEQ ID NO: 573 - DNA, 1728 bp, Arabidopsis thaliana
  G738,family:Z-Dof
atggaagctgagaaagaaacagaacaagaaggaaacttgacagtaatgaaacttccggtgttaccaactaaacccaacactcacagccactctatgtcatcaccaattcacagttccatatcagcttcagttccctttagctgggaagaagagcctggcaagcccaagcaacactctacttcttcttcctcctcttcctcttcctcaccattaacttcttattcttcatctccttttgaaactcacaagtccttagagctaccaccaaggcttcacttacttgaaaaagatggaggatcagtaaccaaacttcactcgcctataacagtctttgatggaccttatagcatgacgacatcaaaaaggatggattcaccttcctttaggatgatggtgaaaggtagtgctgattgttatgggtctttcaggagtgatatcgatggtgatttagaggatttggaagtgggctctaagcagcaggagaacttgagtagtggctctttggctgttgtgaagaagagagggagattagggttttttgggtttaggaggaggagagcattgaaagggaaaacagagtttggtagaggtagttatgtgttcccatcttctgtagacagagagagtgaatacagtagaaaggaagaggaagaagaaaaagaagacaaaaggtttggttatgatgatactgatggtattagttgcagccaaagcagcaggttttgtgatgtgaagatctcaagcattagtagaacaggcagcttctctactctgcctgcaccaccttcttcttcttcaaagtctcacttttggggattaattactgtaattgaagctcacatcatggaccatcatcagtatcatcatcatgatcaataccaacatcagatgatgactagtactaacaataattcctataacaccatcgtcacaacacaaccaccaccaacaacaacaacaatggattcaacaacagcaacaactatgataatggatgacgagaagaagttgatgacgacaatgagcactaggccgcaagaaccaagaaactgtccaagatgcaactcaagcaacaccaagttttgttattacaacaactacagcttagcacagcctaggtacttgtgtaagtcttgtcggagatattggactgaaggtggctctctccgtaacgtccccgtaggcggaggttctagaaagaacaagaagcttccatttcctaattcctctacttcttcttccaccaagaacctcccggatctcaaccctcctttcgtcttcacatcatcagcttcatcatcaaaccctagcaagacgcatcaaaacaataatgacctcagcctatccttctcctcccctatgcaagacaagcgagctcaagggcattacggtcatttcagtgagcaagttgtgacaggagggcagaactgtcttttccaagctcctatgggaatgattcagtttcgtcaagagtatgatcatgagcaccccaaaaagaatcttgggttttcattagacaggaacgaggaagagattggtaatcatgataacttcgttgttaatgaggaaggaagtaagatgatgtatccttatggagatcatgaagaccgtcaacaacatcaccatgtgagacacgatgatggtaataagaagagagaaggtggttcaagcaatgagctatggagcggaatcatcctaggtggtgatagtggtggaccaacatggtga

SEQ ID NO: 574 - protein, 575 aa, Arabidopsis thaliana
  G738,Z-Dof domain coordinates 351-393
MEAEKETEQEGNLTVMKLPVLPTKPNTHSHSMSSPIHSSISASVPFSWEEEPGKPKQHSTSSSSSSSSSPLTSYSSSPFETHKSLELPPRLHLLEKDGGSVTKLHSPITVFDGPYSMTTSKRMDSPSFRMMVKGSADCYGSFRSDIDGDLEDLEVGSKQQENLSSGSLAVVKKRGRLGFFGFRRRRALKGKTEFGRGSYVFPSSVDRESEYSRKEEEEEKEDKRFGYDDTDGISCSQSSRFCDVKISSISRTGSFSTLPAPPSSSSKSHFWGLITVIEAHIMDHHQYHHHDQYQHQMMTSTNNNSYNTIVTTQPPPTTTTMDSTTATTMIMDDEKKLMTTMSTRPQEPRNCPRCNSSNTKFCYYNNYSLAQPRYLCKSCRRYWTEGGSLRNVPVGGGSRKNKKLPFPNSSTSSSTKNLPDLNPPFVFTSSASSSNPSKTHQNNNDLSLSFSSPMQDKRAQGHYGHFSEQVVTGGQNCLFQAPMGMIQFRQEYDHEHPKKNLGFSLDRNEEEIGNHDNFVVNEEGSKMMYPYGDHEDRQQHHHVRHDDGNKKREGGSSNELWSGIILGGDSGGPTW

SEQ ID NO: 575 - DNA, 1212 bp, Arabidopsis thaliana
  G740,family:Z-CLDSH
cttcttcaacttttttttttaacgatggcttcagaggatcaatcggcggcgagatctaccgggaaggtgaactggttcaacgcttctaaaggctatggtttcattactcctgacgatggcagcgtagagcttttcgttcatcaatcttcaattgtctccgaaggttaccggagtttaaccgtcggcgatgcggttgagttcgctattactcagggaagcgacggtaagactaaagccgtcaatgttactgctcctggtggtggttctctcaagaaggagaataactctcgtggtaacggtgctaggcgcggcggcggtggaagcggttgctacaattgcggtgagttaggtcatatctctaaagattgtggtattggtggcggcggcggaggtggtgaacgtagatctagaggaggagaaggttgttacaattgtggtgatactggtcacttcgctagggattgtacttcagctggaaacggtgaccaacgtggagccaccaaaggtggaaacgatggttgctacacttgcggtgatgttggtcacgtggctagggattgtactcagaaatcagttggaaacggagaccaacgtggagcggtcaaaggtggaaacgatggttgctacacttgtggtgatgttggtcactttgctagggattgtactcagaaggttgctgccggaaacgtcagaagcggtggtggtggtagtggaacttgttattcatgcggtggagttggtcacattgcaagagattgtgcgactaagagacagccttctcgtgggtgttaccagtgtggtggttctggtcacttggctcgtgattgtgaccagagaggaagcggtggaggaggtaatgataatgcgtgctacaagtgtggtaaggaaggtcactttgcaagggaatgttcttctgtagcttaatcgatttcctaatcaacaaaacaaaaaaacaagaatgaaattgaatcgagttatatagtttggtatatattactcttcgttttcatttatctttttttttgttgttgatgggaatgaaattgcctggtccttttggtgtgtttttgagcttttattattatacagagtgatcccttttttgttataactattacaagtttttagctttatttgatatggatgctctctccttttcttctatctgtttctggaaattttgacctcatcatattacttatgtcatccaaa

SEQ ID NO: 576 - protein, 299 aa, Arabidopsis thaliana
  G740,Z-CLDSH domain coordinates 24-42,232-268
MASEDQSAARSTGKVNWFNASKGYGFITPDDGSVELFVHQSSIVSEGYRSLTVGDAVEFAITQGSDGKTKAVNVTAPGGGSLKKENNSRGNGARRGGGGSGCYNCGELGHISKDCGIGGGGGGGERRSRGGEGCYNCGDTGHFARDCTSAGNGDQRGATKGGNDGCYTCGDVGHVARDCTQKSVGNGDQRGAVKGGNDGCYTCGDVGHFARDCTQKVAAGNVRSGGGGSGTCYSCGGVGHIARDCATKRQPSRGCYQCGGSGHLARDCDQRGSGGGGNDNACYKCGKEGHFARECSSVA

SEQ ID NO: 577 - DNA, 672 bp, Arabidopsis thaliana
  G744,family:RING/C3H2C3
atggatacgaccctttctcccgccgtggaggcggaacaaatcgccgactcaacgatcgacactgtttctcgtttgatcgccggcgttttctccggcgcacttactggaatcttcgctatggctggagcttttactggagctgtaactggtgcggtggcaggaagagctgcacagtatggagttctccgtggggctgcacttggcgctgttgctggagctatcctctctgttgaagtgttggaggcttctcgtgcgtattggtatttagagctgtcaggatcaaggggtccatcatctatggcagattttgtagagcaactgtttcgtgggagactggtagatgaacaacttatgtcaacaatgataaattcacaccattggcagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggacatcaaaacaggggaaatcacacgaagcttaccgaaatgtgatcatacgtttcatctggtatgtgttgataaatggctcatcagacacgggtcatgccccatttgcagacaggcagttaaagattaa

SEQ ID NO: 578 - protein, 223 aa, Arabidopsis thaliana
  G744,RING/C3H2C3 domain coordinates 176-217
MDTTLSPAVEAEQIADSTIDTVSRLIAGVFSGALTGIFAMAGAFTGAVTGAVAGRAAQYGVLRGAALGAVAGAILSVEVLEASRAYWYLELSGSRGPSSMADFVEQLFRGRLVDEQLMSTMINSHHWQLRISDVSYEEREDVYGELEARGLSGDSLRKLPCYIMSSEMVRRQVTHCTICLQDIKTGEITRSLPKCDHTFHLVCVDKWLIRHGSCPICRQAVKD

SEQ ID NO: 579 - DNA, 1707 bp, Arabidopsis thaliana
  G748,family:Z-Dof
ccacgcgtccgcactctcccaaatctctcttctttaacaacaaaaaaaaaatcacagagacatagagagaagaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttgttgcgttggcatttcaaaaaaaaaaaaaaaa

SEQ ID NO: 580 - protein, 448 aa, Arabidopsis thaliana
  G748,Z-Dof domain coordinates 112-140
MMMETRDPAIKLFGMKIPFPSVFESAVTVEDDEEDDWSGGDDKSPEKVTPELSDKNNNNCNDNSFNNSKPETLDKEEATSTDQIESSDTPEDNQQTTPDGKTLKKPTKILPCPRCKSMETKFCYYNNYNINQPRHFCKACQRYWTAGGTMRNVPVGAGRRKNKSSSSHYRHITISEALEAARLDPGLQANTRVLSFGLEAQQQHVAAPMTPVMKLQEDQKVSNGARNRFHGLADQRLVARVENGDDCSSGSSVTTSNNHSVDESRAQSGSVVEAQMNNNNNNNMNGYACIPGVPWPYTWNPAMPPPGFYPPPGYPMPFYPYWTIPMLPPHQSSSPISQKCSNTNSPTLGKHPRDEGSSKKDNETERKQKAGCVLVPKTLRIDDPNEAAKSSIWTTLGIKNEAMCKAGGMFKGFDHKTKMYNNDKAENSPVLSANPAALSRSHNFHEQI

SEQ ID NO: 581 - DNA, 1570 bp, Arabidopsis thaliana
  G752,family:RING/C3H2C3
ggaacaagattggacgaaagctaaaggtattgcatccatttaaaaagttcatggataggtggtccagtaaaagagccatggaggcgagacctgactctaagaagaagggtggtgttgtttttagagatagatttaacagcaatagttgcaaggttcctatttgtagtgatgagaaaaaatcaatgaactttactaggtttgttggctcttcagataagaaagagaaatcagtgttgtctacataccgctcttcgccaaacgggaaggaagtaattggaacttcctctaagatttgtatctctagctcctcttctgtgaaaagtggtgagaagcaaccgttttctcagatagccattgattcatcagagagcagcagaggtagtgaagacgaggtagagtcagaaatcttgcaagttcctcttggaagagataaaagaagaatgaacaataaacttatttatggaaaagttataacacctgaagcggaatgctcaaagttgccatcaagctcaagaatcaagagaggttttaggcagagatttgggttgagcaagcaagagtttcatcctggtccatctggccagtcaacatctgctaaccggggatgcagcccgttgttgtcaggtgtcattccaagtggttttggattggacaaaagattaagtcggaaggcagatacaatcagtaagacaaaagtttacggagaaagcagttctagctcctcagctagggggaagaatgtaacagaacctccaccagttgaagtgagacgtcgtagttttaatccgagaggttctgtttctgatagtagacgggctagacactgcattttggatgatgacaacgatgttgcttcagttgggagtcagagattggcaaatagaaataatagtcgcattagagggagtggtagagacggtttatcctctgtcacggcagcagagatgtctcagactgaaacatcaaacaatctcaattctcctgtctctttggagctgttctctggttttccagaatttggcctctctggttccttattgagtcatgacagttttcgcagttataatttagatgggatctccgagattctgccagaacttgataggatcgaacaagatatcgaacttaattatgaggatctgcttatcatggaaacaggtttacttctcggtggactaagcttccatgaccaacaccgagacatgaggctagacatcgataacatgtcatatgaggaactattagctctagaagagaggattggtacagtaagcactgctttgacagaagaagcaatatcaaagtgcttgaaaacaagtatctatcagatgaaacctttgagttatgggtctatcaccaaaagtcctagtgataacaaggaagatgccaaatgcagcatctgccaggaagaatatacgattggagatgaagttgggaggctacactgtgagcacacataccatgtgaagtgtgtgcaagagtggttgcggataaagagttggtgcccaatctgcaaagccacagccgaaacctcctctaaataaccgtcttcttcttcttcctcgttcgt

SEQ ID NO: 582 - protein, 497 aa, Arabidopsis thaliana
  G752,RING/C3H2C3 domain coordinates 439-479
MDRWSSKRAMEARPDSKKKGGVVFRDRFNSNSCKVPICSDEKKSMNFTRFVGSSDKKEKSVLSTYRSSPNGKEVIGTSSKICISSSSSVKSGEKQPFSQIAIDSSESSRGSEDEVESEILQVPLGRDKRRMNNKLIYGKVITPEAECSKLPSSSRIKRGFRQRFGLSKQEFHPGPSGQSTSANRGCSPLLSGVIPSGFGLDKRLSRKADTISKTKVYGESSSSSSARGKNVTEPPPVEVRRRSFNPRGSVSDSRRARHCILDDDNDVASVGSQRLANRNNSRIRGSGRDGLSSVTAAEMSQTETSNNLNSPVSLELFSGFPEFGLSGSLLSHDSFRSYNLDGISEILPELDRIEQDIELNYEDLLIMETGLLLGGLSFHDQHRDMRLDIDNMSYEELLALEERIGTVSTALTEEAISKCLKTSIYQMKPLSYGSITKSPSDNKEDAKCSICQEEYTIGDEVGRLHCEHTYHVKCVQEWLRIKSWCPICKATAETSSK

SEQ ID NO: 583 - DNA, 2001 bp, Arabidopsis thaliana
  G760,family:NAC
tgcttaattccaatgccatcgtgatcgattcatctctctctctctcttccaattttcccaattcttttttaaaaccctaatttttcagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaacctgcccctaaagaattggagaaggaggtcgcaggaggcaaagaggcagtggaggaaaaggaaagtggcgaaggatcttcttcaaaacaagatacagatttcaaggactttgattcagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaactttggcagtgctttgctgctcaatatttaaattttaaaaaaaaaaaaaaaaa

SEQ ID NO: 584 - protein, 567 aa, Arabidopsis thaliana
  G760,NAC domain coordinates 12-156
MGRGSVTSLAPGFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRIFQKSGTGPKNGEQYGAPYLEEEWEEDGMTYVPAQDAFSEGLALNDDVYVDIDDIDEKPENLVVYDAVPILPNYCHGESSNNVESGNYSDSGNYIQPGNNVVDSGGYFEQPIETFEEDRKPIIREGSIQPCSLFPEEQIGCGVQDENVVNLESSNNNVFVADTCYSDIPIDHNYLPDEPFMDPNNNLPLNDGLYLETNDLSCAQQDDFNFEDYLSFFDDEGLTFDDSLLMGPEDFLPNQEALDQKPAPKELEKEVAGGKEAVEEKESGEGSSSKQDTDFKDFDSAPKYPFLKKTSHMLGAIPTPSSFASQFQTKDAMRLHAAQSSGSVHVTAGMMRISNMTLAADSGMGWSYDKNGNLNVVLSFGVVQQDDAMTASGSKTGITATRAMLVFMCLWVLLLSVSFKIVTMVSAR

SEQ ID NO: 585 - DNA, 1665 bp, Arabidopsis thaliana
  G772,family:NAC
aaaaaccaaaaccggtttttttttttctttttatgggtcgcgaatctctggctgttgtgtcctcgccgccatcggcgactgcgcccagtactgctgtgtcggctacctcgcttgctcctggctttcgatttcatccgactgatgaggaactcgtgagctattacttgaagaggaaggttctgggtaaacctgtacgcttcgatgcgattggagaggtagatatctacaagcatgagccctgggatttagcagtgttttcgaagttgaaaactcgggaccaagaatggtacttcttcagtgcgttagataagaagtacggtaatggtgctaggatgaatcgagcaactaacaaagggtactggaaagcaactggaaaagacagagaaatccgccgggatattcagttgctcggtatgaaaaagacgcttgttttccacagcgggcgtgctccagacggccttcggactaattgggtcatgcacgagtatcgccttgtggaatatgaaactgaaactaacggaagcctgctgcaggatgcatatgtgttgtgcagagtgtttcacaagaataacattgggccaccaagtgggaacagatatgcgccattcatggaagaagaatgggctgatggtggaggagctctgattccaggaatagacgttagggtcagggtagaggctctaccacaagccaatggaaacaaccagatggaccaggaaatgcattcagcaagcaaggatctcattaacatcaacgagctaccgagagatgctactccaatggacatcgaacctaaccaacagaatcatcatgagagtgccttcaagccacaggagagtaacaaccatagtggttatgaagaagatgaggacacactcaaacgcgagcacgcagaagaagatgagcgtcctccttctctatgcattctcaacaaagaagctccactacctctcctgcaatacaaacgtagacgccaaaacgagtccaacaacaactcaagcaggaacacacaggaccattgttcgtccacaataacaaccgtcgacaatacaaccaccttaatctcatcatctgctgctgctgctaccaacactgccatctctgcattgcttgagttctcacttatgggtatctccgacaagaaagaaaaccagcagaaagaggaaacttctcctcctagtccaattgcatctcctgaagagaaggttaatgatctccagaaggaggttcaccagatgtctgttgaaagagaaactttcaagcttgagatgatgagtgcagaggctatgatcagcattctccagtcaagaatcgatgcgctgcgtcaggagaacgaggaacttaagaagaagaacgccagtggacaagctagttaaaccaccgcaacatctctccaggtgtcttcttcttcttcttcttcttctttgcctcttagctgtaatcttcttaatagtatgagctatggatgtagcttcttcagacggatcagaaaccttatgaatctctgttgtaaaattaggataaaacggaacggagccaaccaactaggtctttttattttatccttttttactttggatgtttctgcatcttttgggaacattttcaggctgatccattgtcgtatattatcatctatctatctagtcttttcagacaaaaaaa

SEQ ID NO: 586 - protein, 447 aa, Arabidopsis thaliana
  G772,NAC domain coordinates 27-176
MGRESLAVVSSPPSATAPSTAVSATSLAPGFRFHPTDEELVSYYLKRKVLGKPVRFDAIGEVDIYKHEPWDLAVFSKLKTRDQEWYFFSALDKKYGNGARMNRATNKGYWKATGKDREIRRDIQLLGMKKTLVFHSGRAPDGLRTNWVMHEYRLVEYETETNGSLLQDAYVLCRVFHKNNIGPPSGNRYAPFMEEEWADGGGALIPGIDVRVRVEALPQANGNNQMDQEMHSASKDLININELPRDATPMDIEPNQQNHHESAFKPQESNNHSGYEEDEDTLKREHAEEDERPPSLCILNKEAPLPLLQYKRRRQNESNNNSSRNTQDHCSSTITTVDNTTTLISSSAAAATNTAISALLEFSLMGISDKKENQQKEETSPPSPIASPEEKVNDLQKEVHQMSVERETFKLEMMSAEAMISILQSRIDALRQENEELKKKNASGQAS

SEQ ID NO: 587 - DNA, 1324 bp, Arabidopsis thaliana
  G773,family:NAC
tccgggcaggtcttcaatctcagaaggcaaaaaagaaaatcaaagaagatagttttgtgattgttttctataaaaagtgcagatattttctttgtcctagagaaagaggtgataggaaaaatgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttgattgtgtaatggtaacgtaataagaaaaacatatttttattttttgtccgtgtcagattagttaattaatatagcgtagaattcgaactctagggttagatttaggttctacgacttgtattgtatattcgtcgtcatttgtcctgacatttacatttttgtaaacttttatagctggaacttttgtattgatcaattatttattagaaaaacagatattgcattggatctataaaaaaaaaaaaaaaaaa

SEQ ID NO: 588 - protein, 317 aa, Arabidopsis thaliana
  G773,NAC domain coordinates 17-159
MGLQELDPLAQLSLPPGFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRIYKKQTSAQKQAYNNLMTSGREYSNNGSSTSSSSHQYDDVLESLHEIDNRSLGFAAGSSNALPHSHRPVLTNHKTGFQGLAREPSFDWANLIGQNSVPELGLSHNVPSIRYGDGGTQQQTEGIPRFNNNSDVSANQGFSVDPVNGFGYSGQQSSGFGFI

SEQ ID NO: 589 - DNA, 1640 bp, Arabidopsis thaliana
  G776,family:NAC
tgcaattgaaggtgaggtttggtgaaagggaaattgagaaaaccctagaacaagtacggtctctattttgctttaatgggtcgcgaatctgtggctgttgtgactgcgccgccctcggcgactgctccgggtactgcttcggtggcgacctcgcttgctcctggcttccgatttcatccgactgatgaggaactcgtgagctattacttgaagaggaaggttctgggccaacctgtacgcttcgatgcgattggagaggtcgatatatacaagcatgagccctgggatttagcagtgttttcgagattgaagacaagggaccaagaatggtacttctacagtgcattagataagaagtatggaaacggtgctaggatgaaccgagcaactaacagagggtactggaaagctactggaaaagacagagaaatccgccgtgacattctgcttctcggtatgaaaaagacacttgttttccacagtgggcgtgcaccagacgggcttcggactaattgggttatgcatgagtatcgccttgtggaatatgaaaccgagaaaaacggaaacctggtgcaagatgcatatgtgttgtgtagagtcttccacaagaataacattgggccaccaagtgggaacagatatgctccgttcatggaagaggaatgggctgatgatgaaggagctctgattccaggaatagacgttaagctcaggctagagccgccgccagtagccaatggaaacgaccagatggaccaggaaatccagtcagccagcaagagtctcatcaacatcaatgagccaccgagagagacagctccactggatatcgaatcggaccaacagaatcatcatgagaatgacctcaagccggaggagcataacaacaataataattatgatgaaaacgaggaaacactcaaacgcgagcagatggaagaagaggagcgtcctcctcgacctgtatgcgttctcaacaaagaagctccattacctcttctgcaatacaaacgtagacgccaaagcgagtccaacaacaactcaagcaggaacacacaggaccattgttcgtccacaacaacaactgtcgacaatacaaccactttaatctcatcatctgccgctgccaccaacactgccatctctgcattgcttgagttctcactcatgggtatctccgacaagaaagaaaagccgcagcaaccgctacgtcctcacaaggaacctttgcctcctcaaactccacttgcatctcctgaagagaaggttaatgatctccagaaggagattcaccagatgtctgttgaaagagaaactttcaagcttgaaatgatgagtgcagaagctatgatcagtattctccagtcaaggatcgatgcgctgcgtcaggagaacgaggaactcaagaagaacaatgctaatggacaataaaggctctaaaaacatctctccaggttacttcttattgcccttcgccttttatttagctttaatctccctaatactatgacccatctacatagctcctctagacagattgcgaactgtgtgaatctctgttgtaacataggataaaacggattcgagcccctgagctgagtgttttatccttcttcttttaaaaaaaaaaaaaaaaaaaa

SEQ ID NO: 590 - protein, 451 aa, Arabidopsis thaliana
  G776,NAC domain coordinates 27-175
MGRESVAVVTAPPSATAPGTASVATSLAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRVFHKNNIGPPSGNRYAPFMEEEWADDEGALIPGIDVKLRLEPPPVANGNDQMDQEIQSASKSLININEPPRETAPLDIESDQQNHHENDLKPEEHNNNNNYDENEETLKREQMEEEERPPRPVCVLNKEAPLPLLQYKRRRQSESNNNSSRNTQDHCSSTTTTVDNTTTLISSSAAATNTAISALLEFSLMGISDKKEKPQQPLRPHKEPLPPQTPLASPEEKVNDLQKEIHQMSVERETFKLEMMSAEAMISILQSRIDALRQENEELKKNNANGQ

SEQ ID NO: 591 - DNA, 1057 bp, Arabidopsis thaliana
  G777,family:HLH/MYC
gtggctctctctttatctttcttggagtttagttagagattttaacgttgcaaatggatcaaccaatgaaaccaaaaacttgctctgaatctgattttgctgatgattcctctgcttcttcttcttcttcttcgggacaaaatctcagaggagctgagatggtggtggaagtgaagaaggaagcagtttgttcccagaaagcagagcgagagaagcttcgtagagataagcttaaggaacagtttcttgagcttggaaatgcacttgatccgaataggcctaagagtgacaaagcctcagttctcactgatacaatacaaatgctcaaggatgtaatgaaccaagttgatagactaaaagctgagtatgaaacactatctcaagagtctcgtgagctaattcaagagaagagtgagctgagagaggagaaagcgactttaaagtctgatatcgagattcttaatgctcaatatcagcatagaatcaaaaccatggttccatgggtacctcattacagttatcatatccccttcgtagccataactcagggtcagtccagttttataccttattcagcctctgtcaatcctctaaccgaacaacaagcatcggttcagcagcattcttcttcttctgccgatgcttcaatgaaacaagattccaaaatcaagccgttagatttggatctgatgatgaacagtaaccattcaggtcaaggaaatgatcaaaaagatgatgttcgtttaaagctcgagcttaaaatccatgcctcttctttagctcaacaggatgtttctggaaaagagaagaaagtaagcttgacaaccactgcaagctcatcgaatagttactcattatctcaagctgttcaagatagttcccccggtaccgtaaatgacatgttgaagccataaaccaataaacatattcccctgaacttgtgtttaataccgtgattgagaaggtaccatgattaaacttgttgtagattatccacatgattaacgatgtattcttatcacaagcaaataaaacacaaaagcatttgcttaaaaaa

SEQ ID NO: 592 - protein, 286 aa, Arabidopsis thaliana
  G777,HLH/MYC domain coordinates 41-99
MDQPMKPKTCSESDFADDSSASSSSSSGQNLRGAEMVVEVKKEAVCSQKAEREKLRRDKLKEQFLELGNALDPNRPKSDKASVLTDTIQMLKDVMNQVDRLKAEYETLSQESRELIQEKSELREEKATLKSDIEILNAQYQHRIKTMVPWVPHYSYHIPFVAITQGQSSFIPYSASVNPLTEQQASVQQHSSSSADASMKQDSKIKPLDLDLMMNSNHSGQGNDQKDDVRLKLELKIHASSLAQQDVSGKEKKVSLTTTASSSNSYSLSQAVQDSSPGTVNDMLKP

SEQ ID NO: 593 - DNA, 1389 bp, Arabidopsis thaliana
  G778,family:HLH/MYC
tctcaataacacaaaaccttttaaactagtaaaatacacagattttaggatgagccaatgtgttccaaactgtcacatcgatgatactccggcagcagccaccaccaccgtccgctccaccacagccgcagacatccccatattagactacgaggtagccgagctgacgtgggagaacgggcaactaggcttgcacggcttaggtccaccgcgagtgacggcttcgtcgaccaagtactccacaggcgccggtggaacgttggagtcgatagtggaccaagctactcgcctccctaaccctaagcccacggatgagctcgtcccgtggttccatcatcgctcctccagggccgcgatggcaatggacgcgcttgtcccttgctccaacctagtacacgagcagcagagcaagcctggtggcgttggctccacccgggtggggtcatgtagcgatggtcgtaccatgggcggtggaaaacgagcaagagtggcaccggagtggagcggcggcgggagtcagcggctgaccatggacacttacgacgtaggtttcacctcaacatcaatgggctcgcacgataacacaatcgacgatcatgactccgtctgccacagccgcccacagatggaggacgaagaagagaagaaagccggaggaaaatcatcagtttcaaccaagagaagcagagctgctgctattcataaccaatccgaacgtaagaggagagataaaatcaatcaaaggatgaagactttgcaaaaactggttcccaattccagcaagacggataaagcatctatgttggatgaagtgatagagtatttgaagcaacttcaagcacaagtgagcatgatgagcagaatgaatatgccttctatgatgcttcctatggccatgcagcaacaacaacaactacaaatgtctctcatgtccaatcccatgggtttagggatgggcatggggatgcccggtctcggtctcctcgaccttaattctatgaaccgagctgctgcaagcgctcctaatatccatgccaacatgatgccaaacccatttttgcccatgaattgtccatcgtgggatgcttcttccaatgactctcgatttcagtctcctctcatccccgatcctatgtctgcctttcttgcatgctctactcagccaacgacgatggaagcgtatagcaggatggctacattatatcagcaaatgcaacaacaacttcctcctccttcgaatccaaaatgattattactcaaacacctctatatagtttacgtctatatatgtgttagtcacatacatacatatatatattccatcataattatttatttatatgtataggcttctcatgaattatgatattatacgtattacgtaaaaaa

SEQ ID NO: 594 - protein, 399 aa, Arabidopsis thaliana
  G778,HLH/MYC domain coordinates 210-267
MSQCVPNCHIDDTPAAATTTVRSTTAADIPILDYEVAELTWENGQLGLHGLGPPRVTASSTKYSTGAGGTLESIVDQATRLPNPKPTDELVPWFHHRSSRAAMAMDALVPCSNLVHEQQSKPGGVGSTRVGSCSDGRTMGGGKRARVAPEWSGGGSQRLTMDTYDVGFTSTSMGSHDNTIDDHDSVCHSRPQMEDEEEKKAGGKSSVSTKRSRAAAIHNQSERKRRDKINQRMKTLQKLVPNSSKTDKASMLDEVIEYLKQLQAQVSMMSRMNMPSMMLPMAMQQQQQLQMSLMSNPMGLGMGMGMPGLGLLDLNSMNRAAASAPNIHANMMPNPFLPMNCPSWDASSNDSRFQSPLIPDPMSAFLACSTQPTTMEAYSRMATLYQQMQQQLPPPSNPK

SEQ ID NO: 595 - DNA, 766 bp, Arabidopsis thaliana
  G779,family:HLH/MYC
gacatgcatgtaagcattcggttaattaatcgagtcaaagatatatatcagtaaatacatatgtgtatatttctggaaaaagaatatatatattgagaaataagaaaagatgaaaatggaaaatggtatgtataaaaagaaaggagtgtgcgactcttgtgtctcgtccaaaagcagatccaaccacagccccaaaagaagcatgatggagcctcagcctcaccatctcctcatggattggaacaaagctaatgatcttctcacacaagaacacgcagcttttctcaatgatcctcaccatctcatgttagatccacctcccgaaaccctaattcacttggacgaagacgaagagtacgatgaagacatggatgcgatgaaggagatgcagtacatgatcgccgtcatgcagcccgtagacatcgaccctgccacggtccctaagccgaaccgccgtaacgtaaggataagcgacgatcctcagacggtggttgctcgtcggcgtcgggaaaggatcagcgagaagatccgaattctcaagaggatcgtgcctggtggtgcgaagatggacacagcttccatgctcgacgaagccatacgttacaccaagttcttgaaacggcaggtgaggattcttcagcctcactctcagattggagctcctatggctaacccctcttacctttgttattaccacaactcccaaccctgatgaactacacagaagctcgctagctagacatttggtgtcatcctctcaaccttt

SEQ ID NO: 596 - protein, 200 aa, Arabidopsis thaliana
  G779,HLH/MYC domain coordinates 117-174
MKMENGMYKKKGVCDSCVSSKSRSNHSPKRSMMEPQPHHLLMDWNKANDLLTQEHAAFLNDPHHLMLDPPPETLIHLDEDEEYDEDMDAMKEMQYMIAVMQPVDIDPATVPKPNRRNVRISDDPQTVVARRRRERISEKIRILKRIVPGGAKMDTASMLDEAIRYTKFLKRQVRILQPHSQIGAPMANPSYLCYYHNSQP

SEQ ID NO: 597 - DNA, 1283 bp, Arabidopsis thaliana
  G782,family:HLH/MYC
cgaggaggctagagaatcgagaatcgatcttcgccgaaccaccttgtcttctcttagctcatcgaatctctccgtcgccgtcgattcttcccgccggtgaatctctgccttattgttttcttcaatttgatcgtcctgaattcatcgtcctatttagggtttcgatcacaatctgaagaggaggtcatggacgtttctgctagaaagtcacaaaaagctgggcgcgaaaagttgaggagggaaaaactgaatgagcattttgttgaactgggaaatgtactcgatccagagagacccaagaatgacaaagccacgattctgactgatactgttcagttgttgaaagagctcacatctgaagtcaacaaactgaaatctgagtacaccgcattgacagatgagtcccgcgagttgacacaggagaaaaacgacctgagagaagaaaagacatcgctgaaatcagatatagagaatctcaatcttcaataccagcagagattaaggtcaatgtctccatggggagctgcgatggatcacacagtcatgatggctccaccaccctcctttccataccctatgcctattgctatgcctcccgggtcaatcccaatgcatccatcaatgccatcttacacatactttgggaaccagaaccctagcatgatcccagctccatgtcctacatacatgccctacatgcctcctaatacagtcgttgagcaacaatccgtgcacattccacagaaccccggtaaccgttctcgggaacctagagcaaaggtttcaagagagagcagatctgagaaagcagaggactccaacgaagttgcaacacaactcgaattaaaaacccctggatctacttctgataaggatacattgcaaaggccagagaagacaaagagatgtaagagaaacaacaacaacaactcaatagaagaaagctctcattctagcaagtgttcatcttctccgagcgtacgagaccacagttcttccagtagcgtagctggtggccaaaaacctgatgatgcaaaatgattcgaaagaatctgatgttgatcatctcaagtatccaagtatcgtttcgatgagtactgtatatagtgcgagtacaaaatgcacttagctgtttaaagcagtgttttgatgcaccgtggcattcgttttcctcggatagtcatttctcagatgattttcatccttaataggtctgctttagttctaaaactcggatgatttgtaatttccagtgtccaaatctactaattttattaaaaaaa

SEQ ID NO: 598 - protein, 284 aa, Arabidopsis thaliana
  G782,HLH/MYC domain coordinates 2-60
MDVSARKSQKAGREKLRREKLNEHFVELGNVLDPERPKNDKATILTDTVQLLKELTSEVNKLKSEYTALTDESRELTQEKNDLREEKTSLKSDIENLNLQYQQRLRSMSPWGAAMDHTVMMAPPPSFPYPMPIAMPPGSIPMHPSMPSYTYFGNQNPSMIPAPCPTYMPYMPPNTVVEQQSVHIPQNPGNRSREPRAKVSRESRSEKAEDSNEVATQLELKTPGSTSDKDTLQRPEKTKRCKRNNNNNSIEESSHSSKCSSSPSVRDHSSSSSVAGGQKPDDAK

SEQ ID NO: 599 - DNA, 1027 bp, Arabidopsis thaliana
  G783,family:HLH/MYC
gtctacagtttccgacgagattctcaccggagaaagaaaggtgacttgacagagaatcttgttctgtaataaaagcaaagatggtatcgaaaactccttctacatcgtctgatgaagcaaatgctactgcagatgaaagatgtagaaaaggtaaagtaccgaaaaggatcaacaaggccgttcgtgagaggcttaagcgtgagcatttgaatgagcttttcattgaattagccgatactcttgaactgaatcaacagaacagtgggaaagcttctatactatgcgaagctactcgattcttgaaggacgtgtttggtcaaattgagtctcttagaaaggagcatgcttctctcctatctgaatctagctatgtaaccacagagaagaatgagctcaaggaagaaacatcagtgcttgagactgagatttcgaaactacaaaacgagattgaagctagagcgaatcagtcgaaacctgacttgaacacctctcctgcacccgagtaccatcatcatcattatcaacaacaacatcctgaacgtgtatctcagttcccaggacttcccattttccaaggccccggctttcaacaatctgctacaactcttcatcctcctgcaacagttcttgtccttccaatacaacctgatccccagacacaagatatctcagaaatgactcaagcgcagcagcctttgatgtttaatagctcaaatgtgagtaacccatgtccaaggtatgctagcgcggctgactcgtggtcttctcggctacttggagagcggctgaaagccagtgaatgaggtcttgaacggctccacatggagtagcaacgcaagttataagacatggcaacttatgaaggactctggttttgtattttttaatacatcgttctgatgtccttgtgggtttggccttggctatttcttgtttttgatggttgttcataggatcaggaagttatggccttgatgggtcgtttgagataaataagtaaattagctcaaaaaaaaaaaaaaaaaaa

SEQ ID NO: 600 - protein, 240 aa, Arabidopsis thaliana
  G783,HLH/MYC domain coordinates 24-82
MVSKTPSTSSDEANATADERCRKGKVPKRINKAVRERLKREHLNELFIELADTLELNQQNSGKASILCEATRFLKDVFGQIESLRKEHASLLSESSYVTTEKNELKEETSVLETEISKLQNEIEARANQSKPDLNTSPAPEYHHHHYQQQHPERVSQFPGLPIFQGPGFQQSATTLHPPATVLVLPIQPDPQTQDISEMTQAQQPLMFNSSNVSNPCPRYASAADSWSSRLLGERLKASE

SEQ ID NO: 601 - DNA, 1913 bp, Arabidopsis thaliana
  G789,family:HLH/MYC
ggcaagaagaaccttagcctctctttcttctttctctctctctctctctgtggtactgttctgtttcaactttactccctcagtttcagaacaattccctatctagaagagagataaaaccgagaaggttttggagatagaatcttttgttcttcttttgtccctccttgctcgatttttgttacgtgtgaagcaataaaaaaaaactgatatagctaaatcttccatccattcagaggcttctaaatctgatctgacatggaacaagtgtttgctgattggaattttgaagataattttcacatgtccactaataaaagatcaatcagaccagaagatgaattagtggagctattgtggagagatggtcaagtggttttacaaagccaagctcgtagagaaccgtcagtccaagtccaaacccacaaacaagaaaccctaagaaaacccaacaatatttttcttgacaaccaagaaacagtacaaaagcctaactacgctgctctagatgatcaagaaaccgtctcctggatacaataccctccggatgacgtcatcgaccctttcgaatccgagttctcctctcatttcttctcttcgatcgatcacctcggaggtcctgagaagccacgaacgatcgaagagacagttaagcatgaggctcaagccatggctcctcctaagtttagatcctcggttataacagtcggaccgagtcattgcggcagcaaccagtcaacaaatattcatcaggccactacacttccggtttctatgagtgatagaagcaagaacgtcgaagaaagacttgacacttcgtcaggtggctcctccggttgcagctatggaaggaacaacaaagaaaccgttagtggaacaagtgtaaccattgaccgtaaaagaaaacatgttatggatgctgatcaagaatctgtgtctcaatcagatataggtttgacctcaaccgatgatcaaaccatgggtaacaaatcgagccaacggtcaggatctactcgaagaagccgtgcagctgaagttcataatctctcagaaaggaggaggagagatcggatcaatgaaagaatgaaagctcttcaagaactcatacctcactgcagcagaacagataaagcttcgatattggatgaagcaattgattacttaaaatcacttcaaatgcaactccaagtgatgtggatgggaagtggaatggcggcggcggcagcagcagcagcaagtccgatgatgtttcccggggtacaatcatctccatacattaatcagatggctatgcaaagtcagatgcaattgtctcaattcccggttatgaaccggtccgctccgcagaaccatcccggtttagtatgtcaaaacccggtacagttgcagctccaagcacagaaccaaatcttatcggagcagctcgctaggtacatgggcgggattccccagatgccgccggcgggaaatcagatgcagaccgtgcaacaacaaccagcggacatgttgggatttggatctccggcgggaccgcaaagtcaactgtcggcaccggcgaccaccgacagtcttcatatgggtaaaataggctgacttggcatatagttttcctccgaaattattcttcttacagttggtgattgttatttatttttggtcgcctaagcaagcataaaagctaagtcaaatgtattatagagatctaataagttagtctcatacttataacttatttttaaacagttgaattatagtatcaatcaagtgttgggaacctaaagatcatacatgtgtcaatacttttatatttgttctcaaggttcatcagaaaaacaaaataaaaaggatagactaggcctgcatttgacattatcatgggcttttttgggtctatgaatatgaacattaacccc

SEQ ID NO: 602 - protein, 444 aa, Arabidopsis thaliana
  G789,HLH/MYC domain coordinates 253-310
MEQVFADWNFEDNFHMSTNKRSIRPEDELVELLWRDGQVVLQSQARREPSVQVQTHKQETLRKPNNIFLDNQETVQKPNYAALDDQETVSWIQYPPDDVIDPFESEFSSHFFSSIDHLGGPEKPRTIEETVKHEAQAMAPPKFRSSVITVGPSHCGSNQSTNIHQATTLPVSMSDRSKNVEERLDTSSGGSSGCSYGRNNKETVSGTSVTIDRKRKHVMDADQESVSQSDIGLTSTDDQTMGNKSSQRSGSTRRSRAAEVHNLSERRRRDRINERMKALQELIPHCSRTDKASILDEAIDYLKSLQMQLQVMWMGSGMAAAAAAAASPMMFPGVQSSPYINQMAMQSQMQLSQFPVMNRSAPQNHPGLVCQNPVQLQLQAQNQILSEQLARYMGGIPQMPPAGNQMQTVQQQPADMLGFGSPAGPQSQLSAPATTDSLHMGKIG

SEQ ID NO: 603 - DNA, 1107 bp, Arabidopsis thaliana
  G791,family:HLH/MYC
ttttctttgggtgttccttccaccaacggcagaaatcgattcggcttaaatctccccctcctttcgatctctctgatcgccgccgggaacattcaatttcccgggagttcaacaaaaaaaaaactctccgtttttatttttccccctttttcaccggtggaagtttccggagatggtgtcacccgaaaacgctaattggatttgtgacttgatcgatgctgattacggaagtttcacaatccaaggtcctggtttctcttggcctgttcagcaacctattggtgtttcttctaactccagtgctggagttgatggctcggctggaaactcagaagctagcaaagaacctggatccaaaaagagggggagatgtgaatcatcctctgccactagctcgaaagcatgtagagagaagcagcgacgggacaggttgaatgacaagtttatggaattgggtgcaattttggagcctggaaatcctcccaaaacagacaaggctgctatcttggttgatgctgtccgcatggtgacacagctacggggcgaggcccagaagctgaaggactccaattcaagtcttcaggacaaaatcaaagagttaaagactgagaaaaacgagctgcgagatgagaaacagaggctgaagacagagaaagaaaagctggagcagcagctgaaagccatgaatgctcctcaaccaagttttttcccagccccacctatgatgcctactgcttttgcttcagcgcaaggccaagctcctggaaacaagatggtgccaatcatcagttacccaggagttgccatgtggcagttcatgcctcctgcttcagtcgatacttctcaggatcatgtccttcgtcctcctgttgcttaatcaagaaaaatcatcaaccggtttgcttcttgcttccgcttaaaagaaaagtctccatttgttttgctctcctctctttctcggctttcttagtcttatccttttgctttgtcgtgttatcatcgtaactgttatctgttgaacaatgatatgacattgtaaactccaattgcttcgcgcaatgttatctattcacatgtaaatttaagtagagtttggcaaaaaaaaaa

SEQ ID NO: 604 - protein, 234 aa, Arabidopsis thaliana
  G791,HLH/MYC domain coordinates 68-127
MVSPENANWICDLIDADYGSFTIQGPGFSWPVQQPIGVSSNSSAGVDGSAGNSEASKEPGSKKRGRCESSSATSSKACREKQRRDRLNDKFMELGAILEPGNPPKTDKAAILVDAVRMVTQLRGEAQKLKDSNSSLQDKIKELKTEKNELRDEKQRLKTEKEKLEQQLKAMNAPQPSFFPAPPMMPTAFASAQGQAPGNKMVPIISYPGVAMWQFMPPASVDTSQDHVLRPPVA

SEQ ID NO: 605 - DNA, 1420 bp, Arabidopsis thaliana
  G793,family:HLH/MYC
cattctctcacctaacaactccacacaagattcttcgcatggaaagttgttcttcgacttctcttctctaactcgctatcttttaactcacccagctccactgagtcgaaaatttcaaacctttactcgtttccttcatggctaataacaacaacatcccacatgatagcatctccgatccatctcctaccgacgatttcttcgagcagatcctcgggctttccaacttctccggttcttcaggttctggtctctctggaatcggcggcgtgggtccacctccgatgatgcttcagcttggttcaggcaacgaagggaatcataatcatatgggtgccattggaggaggtggacctgtagggtttcataatcagatgtttccgttgggattaagtctcgatcaagggaaaggacatggctttcttaaacctgatgaaactggtaaacgtttccaagacgatgttcttgataatcgatgttcctctatgaaacctattttccatgggcagccaatgtcacagccagctccaccaatgccgcatcaacagtctactattcggcctagagttagggctaggcgaggtcaagctaccgatccacatagcatcgctgagaggctccgaagggaaagaatagcagaacggatcaggtcgttgcaggaacttgtacctaccgttaacaagacagatagggctgctatgatcgacgagattgtcgattatgtaaagtttctcaggctccaagttaaggtcctgagcatgagccgtcttggtggagccggtgctgtcgcaccactagtcactgaaatgccattatcttcatcagttgaggatgagacgcaggccgtgtgggagaaatggtcaaacgatgggacagagaggcaagtggctaagctgatggaagaaaacgttggagcagcgatgcaacttttgcaatcaaaggctctttgcataatgccgatctcattggcaatggcgatttaccattctcagccaccagacacatcttcttcaatcgtcaaaccagagatgaatcctccaccgtagatttttgttcatccaacggtccccagctgatgattgacattttgctctgtttcccactactagacttttgtgactcatgaaaggtaagtaaaaaggcattggagatggaatctaagtaggatttgtgcagtaaagaagtaaaacgggatctgtcaaaagaaggaaaaagctctcgcttgcttggctagtatttatcattttgatgaaagtaactcttttttgttcaaagactttagtgtgattttcaggaccaagggctttgagggtagtgctagctgtagtaatagtaatgaaggtgtgggatcgtgtttttgaattatgtaaaaaaggaagaaaaaacaaatgttggtattatattatggttttgcctgaaa

SEQ ID NO: 606 - protein, 302 aa, Arabidopsis thaliana
  G793,HLH/MYC domain coordinates 147-204
MANNNNIPHDSISDPSPTDDFFEQILGLSNFSGSSGSGLSGIGGVGPPPMMLQLGSGNEGNHNHMGAIGGGGPVGFHNQMFPLGLSLDQGKGHGFLKPDETGKRFQDDVLDNRCSSMKPIFHGQPMSQPAPPMPHQQSTIRPRVRARRGQATDPHSIAERLRRERIAERIRSLQELVPTVNKTDRAAMIDEIVDYVKFLRLQVKVLSMSRLGGAGAVAPLVTEMPLSSSVEDETQAVWEKWSNDGTERQVAKLMEENVGAAMQLLQSKALCIMPISLAMAIYHSQPPDTSSSIVKPEMNPPP

SEQ ID NO: 607 - DNA, 923 bp, Arabidopsis thaliana
  G798,family:Z-Dof
gcatcacttcccttaaagcttcaaccttctccgatatgccgacgtcgactccggtgaaccacggcgaatagctatgaaacctaacggcgtaacagttccgatttctgaccagcaagaacagcttccatgtcctcgttgtgactcatccaacactaagttctgttactacaacaactacaacttctctcagcctcgtcacttctgcaaagcttgtcgtcgttactggactcacggtggtactctccgtgacgttcctgtcggtggtggtactcgtaaaagcgcgaaacgttcccgcacttgctcgaactcttcttcctcctctgtttctggtgtcgtctctaactctaacggtgttccgttacaaacgacgcctgttctcttccctcagtcgtcaatctctaacggcgttactcacacagtaactgaaagcgacggaaagggaagtgctttatctctctgtggaagtttcacctccactctgttgaaccataacgctcgtgcgacggctacgcatggatccggttcggttattggtatcggaggttttggaatcggactcgggtcgggttttgatgacgtcagctttggactcggaagagcgatgtggccgttttcaactgttggtactgcgacaacgacgaatgttgggagtaacggtggtcatcacgctgttccaatgccagccacgtggcagttcgagggtttagagagcaacgctggtggtggatttgtctccggtgagtactttgcgtggccggatctttccatcacaactccgggaaactcactcaaatgagaaaagcttctgtcttcatcaaagggcttcaaagtctcttcctttttttagtctctattggtgatgttgatctcttagtttgtgtcttgtcaatttagaaacttgtcttcggaaactagaaaacaga

SEQ ID NO: 608 - protein, 240 aa, Arabidopsis thaliana
  G798,Z-Dof domain coordinates 19-47
MKPNGVTVPISDQQEQLPCPRCDSSNTKFCYYNNYNFSQPRHFCKACRRYWTHGGTLRDVPVGGGTRKSAKRSRTCSNSSSSSVSGVVSNSNGVPLQTTPVLFPQSSISNGVTHTVTESDGKGSALSLCGSFTSTLLNHNARATATHGSGSVIGIGGFGIGLGSGFDDVSFGLGRAMWPFSTVGTATTTNVGSNGGHHAVPMPATWQFEGLESNAGGGFVSGEYFAWPDLSITTPGNSLK

SEQ ID NO: 609 - DNA, 1009 bp, Arabidopsis thaliana
  G801,family:PCF
gatagtgataacgaaatcctaattccatggccgacaacgacggagcagtgagtaacggcatcatagtcgagcagacgtcaaacaaaggacctcttaacgccgttaagaaaccaccgtctaaagatcgacacagcaaagttgacggaagaggaagaaggattcgtatgccaatcatttgcgcagctcgagtttttcaattgaccagagagttaggtcacaagtccgatggtcaaaccatagagtggcttctccgtcaagctgagccttctatcatagccgccactggaactggcactactccggcgagtttctccactgcttctctctccacttcttctccgtttactctcgggaaacgtgtcgtcagagcggaggaaggagaatccggcggcggaggaggaggagggttaacagtgggacacacaatggggacttcgttaatgggtggtggtggttctggtgggttttgggctgttccggcgaggccggatttcggacaagtctggagctttgcaaccggagctccaccggaaatggtttttgcgcagcagcagcaaccagctacactcttcgtccgccaccagcagcaacagcaagcttccgccgccgcagcagctgcaatgggtgaggcttcagcagctagagttgggaattatcttccgggtcatcatctcaatttgcttgcttctttgtctggtggagctaacgggtcgggtcggagggaagacgaccacgaaccacgttgagaaatggtattgtctttttggtaatgtatagaaaaattcctatgttttatgtcatcgaaagtgtttagaaagtacctctaatttgcggtttcttttgctccttttttacttaatttaagcttattgcttgtttgattagggttttagggtttaagaatatttggtctcgttaatttgtttcggagagtgatagaaagagagagagattgattgattgttgtacctaaaacgctataaaagctctgtttttactagcgaaaaaa

SEQ ID NO: 610 - protein, 239 aa, Arabidopsis thaliana
  G801,PCF domain coordinates 32-93
MADNDGAVSNGIIVEQTSNKGPLNAVKKPPSKDRHSKVDGRGRRIRMPIICAARVFQLTRELGHKSDGQTIEWLLRQAEPSIIAATGTGTTPASFSTASLSTSSPFTLGKRVVRAEEGESGGGGGGGLTVGHTMGTSLMGGGGSGGFWAVPARPDFGQVWSFATGAPPEMVFAQQQQPATLFVRHQQQQQASAAAAAAMGEASAARVGNYLPGHHLNLLASLSGGANGSGRREDDHEPR

SEQ ID NO: 611 - DNA, 1604 bp, Arabidopsis thaliana
  G802,family:PCF
gctctctctctcttctcgagacaaagaagaagacaagagtcaaacttgaaggcgacaatcggagcttccatggccgtttcttcctctttcaccaaaccctaatttcaatttcatcttcttttcccttctttctcaccggaaaatggatctctccgacatccgaaacaacaacaacgacaccgccgccgtcgccaccggaggaggagcaagacagctagttgacgcatctctctcaatcgttcccagatctacacctcccgaagactcaacactcgcaacaacctcatctacggcaacggcgactacaacgaagcggtcgactaaagaccgtcacacgaaagtcgacggaagaggacgtcggattcgtatgccggcgctatgtgcagctagagtttttcagttaacgagagagttaggtcataaatccgatggtgaaactattgaatggcttcttcaacaagctgagccagctattgttgctgctacaggtacaggaactattccggcgaacttctctactttaagtgtttcgttacgaagtagtggatcgactctctctgctccgccgtcgaaatcggtgccgctttacggtgctcttggattgactcatcatcagtatgatgaacaaggaggcggcggtgtgtttgctgctcatacgtcgccgcttttagggtttcatcatcagcttcaacaccaccagaaccagaatcagaatcaagatccggtggaaactattcctgaaggtgagaatttctctaggaaacggtatagatcggttgatttgtctaaagaaaacgatgatcggaaacagaacgagaataaatctttgaaagaaagtgaaacgtcgggtcctacggcggcgccgatgtgggcggttgcgccgccgagtaggtctggtgctgggaacactttttggatgcttccggtaccgacaacggccggtaatcaaatggagagtagtagcaacaataacaccgccgcaggccaccgtgctcctcctatgtggccatttgtgaactctgctggaggaggagcgggaggtggaggcggagcagcgactcactttatggcgggaacggggtttagttttccgatggatcagtacagaggaagtccacttcagttaggttcttttttagctcagccgcagccgactcagaacttaggactaagtatgccggactcgaatctcgggatgttagccgctttgaactcggcttattcaagaggcggaaacgcaaacgcgaatgcggaacaagcgaacaatgcggtggagcatcaagagaagcagcaacagagtgatcatgatgatgatagtagagaggagaactcaaatagctctgagtgagtgatgtaaactaatcttgtgaaatcattgaatgtggtaagaaattgatttaaagcgtttgtagcggtttggttgattgttttattgtgagattttgtgtgttgttgtttagtagtgtttagacaagaacaatttatgtgtgaaggaattgttaggtttgggtccaaatggactctcatgggtagagaatgttttcaatgtatagaaggaatgatagtcttttcgatttttcagttttcaaaaaaaaaaaaaaaaa

SEQ ID NO: 612 - protein, 401 aa, Arabidopsis thaliana
  G802,PCF domain coordinates 60-140
MDLSDIRNNNNDTAAVATGGGARQLVDASLSIVPRSTPPEDSTLATTSSTATATTTKRSTKDRHTKVDGRGRRIRMPALCAARVFQLTRELGHKSDGETIEWLLQQAEPAIVAATGTGTIPANFSTLSVSLRSSGSTLSAPPSKSVPLYGALGLTHHQYDEQGGGGVFAAHTSPLLGFHHQLQHHQNQNQNQDPVETIPEGENFSRKRYRSVDLSKENDDRKQNENKSLKESETSGPTAAPMWAVAPPSRSGAGNTFWMLPVPTTAGNQMESSSNNNTAAGHRAPPMWPFVNSAGGGAGGGGGAATHFMAGTGFSFPMDQYRGSPLQLGSFLAQPQPTQNLGLSMPDSNLGMLAALNSAYSRGGNANANAEQANNAVEHQEKQQQSDHDDDSREENSNSSE

SEQ ID NO: 613 - DNA, 1231 bp, Arabidopsis thaliana
  G805,family:PCF
tatagagagaggaaaaaactatggctcacataaagatctaacagagacagtagtatagtcccacttcccccccaccaaagcttcgatcatcatcatcatcatcatcatggatccggatccggatcataaccatcgacccaacttccctctccagcttcttgattcttctacctcctcctcttccacttccttagccatcatctctactacttccgaacctaactccgaacctaagaagcctcctcctaaacgaacctctactaaagaccgacacaccaaagtcgaaggccgaggccgtcggatccgtatgcctgccatgtgtgctgcacgtgtctttcagctcacacgtgagcttggtcacaaatccgacggtgaaactattgagtggctactccaacaagcagaaccagcggttatagccgctacagggactggaaccattccggctaacttcacttctttaaacatctcacttcgtagctcaagatcttctctctctgctgctcatcttcgtacaactcctagtagctattactttcattcaccacatcagtccatgactcatcatcttcaacatcagcatcaggttcgtcccaagaacgagtcacattcttcgtcttcttcttcttcacagcttttagatcacaaccaaatgggtaactatctagtacaatcaactgctggatctttacctacgagtcagagtcctgcaacggcaccgttttggagtagtggtgacaacacacagaatctttgggcttttaatattaatcctcatcattccggtgttgtcgccggagatgtttacaaccccaacagtggtggtagtggcggcggtagtggagttcatttgatgaattttgcagctcctattgctttgttttctggacagcctttggcttctggttatggaggaggaggaggtggcggtggagaacatagccattatggagttttagcggcgttgaatgctgcttaccgaccggtggcggagacggggaaccataacaacaaccagcaaaaccgtgacggagatcatcatcacaaccatcaagaagatggaagcaccagtcatcattcctaggcaaacatacacaaacaaatatattctgtgagatttatttttctttttttgtcctttcgtttgtttgtttgttcttaacaagcgtgttttttttgcattgcttctttttcatatatttttatttatttctaaattctaataaaaaaa

SEQ ID NO: 614 - protein, 325 aa, Arabidopsis thaliana
  G805,PCF domain coordinates 51-114
MDPDPDHNHRPNFPLQLLDSSTSSSSTSLAIISTTSEPNSEPKKPPPKRTSTKDRHTKVEGRGRRIRMPAMCAARVFQLTRELGHKSDGETIEWLLQQAEPAVIAATGTGTIPANFTSLNISLRSSRSSLSAAHLRTTPSSYYFHSPHQSMTHHLQHQHQVRPKNESHSSSSSSSQLLDHNQMGNYLVQSTAGSLPTSQSPATAPFWSSGDNTQNLWAFNINPHHSGVVAGDVYNPNSGGSGGGSGVHLMNFAAPIALFSGQPLASGYGGGGGGGGEHSHYGVLAALNAAYRPVAETGNHNNNQQNRDGDHHHNHQEDGSTSHHS

SEQ ID NO: 615 - DNA, 1790 bp, Arabidopsis thaliana
  G807,family:HS
gagagagtctctgtctctgtaaaagatatttgagcttgagaagaacagaagaaacttccaggatcaatcaatcgatcaactttagtgaactaactcttgatttttcattcgaagttatggaatcggttcccgaatccgtaccatcgccgaactcgaatacaccgtcaataccaccgccggtgaactccgtaccgcctttcttgagtaaaacctacgacatggttgatgatccgttgaccaatgaggtcgtttcgtggagcagcgggaacaacagcttcgtcgtctggagtgccccggagttctcgaaggtgctcttgcccaagtatttcaagcacaacaacttctccagcttcgtcagacagttaaatacttatggtttcagaaaagttgatcctgaccgatgggaatttgcaaatgaaggatttcttagaggccgaaaacaactactgaagagtattgtcaggagaaaaccttcgcatgtgcagcagaatcagcaacaaactcaagttcagagctcatctgttggtgcttgtgtcgaggtggggaagtttggaatagaagaagaagtggaaagacttaagcgggataagaatgttcttatgcaagaactcgtcaggttaaggcagcaacagcaagctactgaaaaccaactgcagaatgtgggacagaaagttcaggtgatggagcaaaggcaacaacaaatgatgtcgtttttagcaaaggctgttcaaagtccaggtttcttaaaccagttagtacaacagaataataatgatggcaacagacaaattccaggaagcaacaaaaagaggagacttcctgtagatgagcaggagaatcgtggtgacaatgtggctaatggtcttaaccgccagattgttagatatcagccgtcgataaacgaagcagcacaaaatatgcttcgacagttcttaaatactagtacctcacctcggtatgaatcagtttcaaacaatcctgacagtttcctattgggtgatgttcccagttctacctctgtagacaatgggaacccttcaagtagagtttctggagtaacattggccgagttttcacccaacacagttcagtcagcaacgaatcaagtacccgaagcaagtttggctcatcatcctcaagctggtctggttcagccaaatataggtcaaagtccggctcaaggagcagcacctgcagactcttggagccctgaatttgatttagttggatgcgagacagatagtggagagtgttttgatccaataatggctgttttagatgagtcagaaggcgatgcaatttctcctgaaggtgagggcaagatgaatgagttactggagggagtccctaagctgcccggaatccaagatccattctgggaacagttcttttctgttgaactcccagcgattgcagatacagacgatattctatcaggatcagtggagaataatgacttggtattggaacaagaaccaaacgagtggacccgtaatgaacaacaaatgaagtatcttactgaacaaatgggactgctttcctcagaagcacagaggaaataaagattttcaggggaggttgcaaaaggagatatgaaggaacgaggaatatatcagatggtgtgtataccctttacatttttacttaaatgaaaaaaaaacagagagaagaaacataaaagatttaccaccaagcttgtgaatagttagtagagatcggtttttgtgttgtttatattatacttttgtgtgaaaacgttcatcttgttcaattatcaaaaaaaaaaaaaa

SEQ ID NO: 616 - protein, 481 aa, Arabidopsis thaliana
  G807,HS domain coordinates 27-118
MESVPESVPSPNSNTPSIPPPVNSVPPFLSKTYDMVDDPLTNEVVSWSSGNNSFVVWSAPEFSKVLLPKYFKHNNFSSFVRQLNTYGFRKVDPDRWEFANEGFLRGRKQLLKSIVRRKPSHVQQNQQQTQVQSSSVGACVEVGKFGIEEEVERLKRDKNVLMQELVRLRQQQQATENQLQNVGQKVQVMEQRQQQMMSFLAKAVQSPGFLNQLVQQNNNDGNRQIPGSNKKRRLPVDEQENRGDNVANGLNRQIVRYQPSINEAAQNMLRQFLNTSTSPRYESVSNNPDSFLLGDVPSSTSVDNGNPSSRVSGVTLAEFSPNTVQSATNQVPEASLAHHPQAGLVQPNIGQSPAQGAAPADSWSPEFDLVGCETDSGECFDPIMAVLDESEGDAISPEGEGKMNELLEGVPKLPGIQDPFWEQFFSVELPAIADTDDILSGSVENNDLVLEQEPNEWTRNEQQMKYLTEQMGLLSSEAQRK

SEQ ID NO: 617 - DNA, 1248 bp, Arabidopsis thaliana
  G811,family:HS
ccaccaccaacaacaaacatataaaccataaggaaaacagagaaagagagagatggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaacaccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttagcgtttagcttcacatgatatatgatctttagactttattatggttatattattattattatttattttttgtgtgtttgttcttaattattttatgtataccccaaagaaagaaagaaaataaggcagatccatagttgagtcagtagtcatcgtttgtagaaagttttgacagtatataatttctgattatatttgttaaaa

SEQ ID NO: 618 - protein, 330 aa, Arabidopsis thaliana
  G811,HS domain coordinates 17-108
MEDDNSNNNNNNNVIAPFIVKTYQMVNDPSTDWLITWGPAHNSFIVVDPLDFSQRILPAYFKHNNFSSFVRQLNTYGFRKVDPDRWEFANEHFLRGQKHLLNNIARRKHARGMYGQDLEDGEIVREIERLKEEQRELEAEIQRMNRRIEATEKRPEQMMAFLYKVVEDPDLLPRMMLEKERTKQQQQVSDKKKRRVTMSTVKSEEEEVEEDEGRVFRVMSSSTPSPSSTENLYRNHSPDGWIVPMTQGQFGSYETGLVAKSMLSNSTSSTSSSLTSTFSLPESVNGGGGGGCGSIQGERRYKETATFGGVVESNPPTTPPYPFSLFRGGF

SEQ ID NO: 619 - DNA, 952 bp, Arabidopsis thaliana
  G812,family:HS
tcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 620 - protein, 272 aa, Arabidopsis thaliana
  G812,HS domain coordinates 29-120
MMNPFLPEGCDPPPPPQPMEGLHENAPPPFLTKTFEMVDDPNTDHIVSWNRGGTSFVVWDLHSFSTILLPRHFKHSNFSSFIRQLNTYGFRKIEAERWEFANEEFLLGQRQLLKNIKRRNPFTPSSSPSHDACNELRREKQVLMMEIVSLRQQQQTTKSYIKAMEQRIEGTERKQRQMMSFLARAMQSPSFLHQLLKQRDKKIKELEDNESAKRKRGSSSMSELEVLALEMQGHGKQRNMLEEEDHQLVVERELDDGFWEELLSDESLASTS

SEQ ID NO: 621 - DNA, 1120 bp, Arabidopsis thaliana
  G818,family:HS
gtatttcttacaataaacgaccaaaaagttaatacaagaaatagaaacggtgtaggaagctactatgacggcaattccaaacgtcgtcgatattgaatcttcttcctcttcgctttgtcaagagacggcaacggagaccgtcaccgttgaaagaggctcgtctgattcatcttcaaagccagacgacgtcgttttactaatcaaggaagaggaggatgacgccgttaacttgtcacttggtttttggaaattgcacgagataggtttaataacaccgttcttgagaaagacgtttgagatcgtcgatgacaaagtaacagacccggttgtatcatggagcccgacccgtaaaagctttatcatttgggattcttacgagttctcagagaatctacttcccaaatacttcaagcacaagaacttctccagttttattcgtcagcttaactcttacggttttaaaaaggtcgattcagataggtgggaatttgctaacgaagggtttcaaggagggaagaaacatttgcttaagaacatcaagaggagaagcaaaaacactaaatgttgtaacaaggaagcgagtaccaccacgacagagactgaggttgagtcattgaaggaggaacagagtccaatgagattggagatgttgaagctgaaacaacaacaagaagaatctcaacatcagatggtcactgtgcaggagaagatccacggagttgataccgaacaacagcatatgcttagtttctttgcaaagttggctaaagatcaaagatttgtagagagactggtgaagaagagaaagatgaaaatacagagagagctagaagcagctgaattcgtgaagaagctcaagttgcttcaggatcaagaaactcaaaagaacttgttagatgtagaaagagaatttatggccatggctgcaacagaacacaatcccgagcctgacattttggtgaacaatcaaagcgggaatacgagatgtcagcttaactcagaggacctacttgttgacggtggctcaatggatgtaaatgggaggatagagatagagtagagcaaaaccggtaacatagcaatagagaaggtaccaaatcccaaggcttgagatccgaat

SEQ ID NO: 622 - protein, 331 aa, Arabidopsis thaliana
  G818,HS domain coordinates 71-162
MTAIPNVVDIESSSSSLCQETATETVTVERGSSDSSSKPDDVVLLIKEEEDDAVNLSLGFWKLHEIGLITPFLRKTFEIVDDKVTDPVVSWSPTRKSFIIWDSYEFSENLLPKYFKHKNFSSFIRQLNSYGFKKVDSDRWEFANEGFQGGKKHLLKNIKRRSKNTKCCNKEASTTTTETEVESLKEEQSPMRLEMLKLKQQQEESQHQMVTVQEKIHGVDTEQQHMLSFFAKLAKDQRFVERLVKKRKMKIQRELEAAEFVKKLKLLQDQETQKNLLDVEREFMAMAATEHNPEPDILVNNQSGNTRCQLNSEDLLVDGGSMDVNGRIEIE

SEQ ID NO: 623 - DNA, 2079 bp, Arabidopsis thaliana
  G831,family:AKR
ttctttcatcgttgtgtctattataaatatatgtcaatttggtttctaaaaaattctaccattgattgattgatttttttttctttaagagatgaatttatttacaagaatctcatctcggactaagaaggccaatctttactacgtaaccctagttgctcttctctgcatcgctagctaccttctcggtatttggcaaaacacggcggttaatccacgcgccgccttcgatgattcagacggtacaccgtgcgagggattcaccagacctaattctacgaaagatctcgacttcgacgcgcatcacaacattcaagatccacctccggtgacggaaaccgccgttagtttcccgtcgtgtgccgccgcgttgagcgagcacacgccatgcgaagacgcgaagcgatcgttgaaattctcgagggagagattggagtataggcaaaggcattgtcccgagagagaagaaatcttgaagtgcagaattccggcgccgtacggttacaaaacgccgttccgatggccggcgagtcgtgacgtggcgtggttcgctaatgtgcctcacacggagcttacggttgagaaaaagaatcagaattgggtccggtacgagaatgatcggttttggttccctggtggaggtacgatgtttccacgtggcgctgatgcttacattgatgatatcggacggttgattgatctcagcgacggctctatccgtacagccatcgataccggttgcggggtggctagcttcggtgcatatcttttatcaagaaacattacaacgatgtcatttgcaccaagagacacacacgaagctcaagtccagttcgcactcgagcgtggtgtgccggcgatgatcggaatcatggctacaatccgcctaccgtacccttctagagcctttgatttagcacattgctctcgttgccttattccgtggggccaaaacgatggggcttacttgatggaggtggatagggttttaagaccaggagggtactggatactttctggaccgccgattaattggcagaaacggtggaaagggtgggaacggaccatggatgatttgaatgcagagcagactcagatcgagcaggtcgcgagaagcttgtgttggaagaaagttgttcaaagagatgatcttgctatttggcaaaaaccctttaaccacattgactgtaagaaaaccagagaggttttgaaaaatccggagttttgtcgtcatgatcaagatcccgacatggcctggtatacgaagatggattcttgtttgacaccattacctgaagttgatgacgctgaggatctaaagacggtggccggagggaaggtagaaaagtggccggctagattaaacgcgattcctccgagagtaaacaaaggcgctctcgaggaaatcacacctgaagctttcttggagaacacgaaactgtggaaacagagagtttcttattacaagaagttagattaccagttgggtgaaaccgggagatacagaaacttagtcgacatgaacgcttacctcggtggattcgcggcggctctagcggatgatccggtctgggtcatgaacgttgtcccggtcgaggctaagctcaatacgctcggtgtcatctacgagcgtggtctaatcggaacgtatcaaaactggtgtgaagccatgtcgacgtatccaagaacgtatgattttatccatgctgactcggttttcacattgtaccaaggtcaatgtgaaccggaggagatattgttggagatggaccgaattcttagaccgggtggtggtgtgattataagagatgacgtggacgttttgatcaaggttaaggaattaaccaaaggattagaatgggaaggtagaattgctgaccacgagaagggtcctcatgaaagagagaagatttactatgcggtgaaacagtattggaccgttcctgcgcctgatgaagataaaaacaacactagtgctctctcctgatttttgagttttttttttcttacaatgttttttttttttttttttcaattttttatacaacaataaattctcaataattgttgtcgcggccg

SEQ ID NO: 624 - protein, 631 aa, Arabidopsis thaliana
  G831,AKR domain coordinates 96-612
MNLFTRISSRTKKANLYYVTLVALLCIASYLLGIWQNTAVNPRAAFDDSDGTPCEGFTRPNSTKDLDFDAHHNIQDPPPVTETAVSFPSCAAALSEHTPCEDAKRSLKFSRERLEYRQRHCPEREEILKCRIPAPYGYKTPFRWPASRDVAWFANVPHTELTVEKKNQNWVRYENDRFWFPGGGTMFPRGADAYIDDIGRLIDLSDGSIRTAIDTGCGVASFGAYLLSRNITTMSFAPRDTHEAQVQFALERGVPAMIGIMATIRLPYPSRAFDLAHCSRCLIPWGQNDGAYLMEVDRVLRPGGYWILSGPPINWQKRWKGWERTMDDLNAEQTQIEQVARSLCWKKVVQRDDLAIWQKPFNHIDCKKTREVLKNPEFCRHDQDPDMAWYTKMDSCLTPLPEVDDAEDLKTVAGGKVEKWPARLNAIPPRVNKGALEEITPEAFLENTKLWKQRVSYYKKLDYQLGETGRYRNLVDMNAYLGGFAAALADDPVWVMNVVPVEAKLNTLGVIYERGLIGTYQNWCEAMSTYPRTYDFIHADSVFTLYQGQCEPEEILLEMDRILRPGGGVIIRDDVDVLIKVKELTKGLEWEGRIADHEKGPHEREKIYYAVKQYWTVPAPDEDKNNTSALS

SEQ ID NO: 625 - DNA, 2579 bp, Arabidopsis thaliana
  G837,family:AKR
ggttctttctactagatccggatctggaactttctctactctctgctcataaagtttcattctttggggagatctgaggcaaccctttttctctggtgcatgtgactagggattgtgccgtgggtttaggatcatggcaatggggaagtattctcgtgtagacgggaagaagtcatcgggatatggcttaaccattaccatcgttttaattgtttctctatgtttggttggggcgtggatgttcatgtcttcatggtctgctccaactgagtctattgacttctctgcaaacgagaggacaaaagatgtagatactactaagagtgatttcaaaagtgaagaggttgatcgaggttccaagagttttccggatgaaaagaatgaggagacggaggttgtgacagagaccaacgaagagaagactgatcctgagaaatctggtgaggagaactctggtgagaaaacggagtcggctgaggaaagaaaggagtttgatgacaaaaatggtgatggggatagaaaaaatggagacggtgagaaagacacggaatcagaaagtgatgaaaccaagcaaaaagagaaaacacaactggaagagagctcagaagaaaacaaatctgaggatagtaatggaaccgaagagaatgctggtgaatctgaagaaaacaccgagaagaagtcagaagaaaacgctggtgaaactgaagagagcactgagaagagtaaggatgttttcccagctggtgaccaggctgaaatcacaaaggagtcaagcactggaagtggggcttggtctacccaattggtggaatcccagaacgagaagaaagcacaagtgtcctcaattaaatggaaagtctgcaatgtgacagctggaccagactacatcccttgccttgacaattggcaagctatcagaaagcttcattcgacaaagcattatgaacatcgtgagaggcattgtcccgaggagtctccacgctgccttgtttctcttcccgaagggtataagcgatccatcaagtggcctaagagcagagaaaagatctggtacaccaatattccacacaccaagcttgcagaagtcaagggacatcaaaactgggtgaagatgagtggtgaatacttaacattccctggtggaggtactcaattcaagaatggtgctcttcactacattgatttcctccaagagtcatatcctgatattgcttggggaaataggactcgtgttatattggatgttgggtgtggggttgctagctttgggggatatctttttgacagagatgtactcgctttgtcatttgcacccaaagacgaacacgaggcacaggtgcaatttgctctggaacgtggtattcctgcaatgtcaaatgttatgggaaccaagagattaccttttccaggatctgtttttgaccttatccattgtgctcgttgtagagttccttggcatatcgaaggtggtaaactacttttggagttgaaccgtgcattgaggccgggtggtttctttgtctggtcagcgactccagtctataggaagactgaggaagatgttggcatatggaaagctatgtcgaagctaacaaaggcaatgtgctgggaactgatgacgattaagaaagatgaactgaatgaagttggtgctgccatttaccagaagccaatgtcgaataaatgctacaatgaaagatctcaaaatgagccacctctctgcaaagactctgatgatcaaaatgccgcctggaatgttccacttgaggcatgtattcacaaagtaacagaagattcatcaaaacgcggagcagtttggcctgaaagttggccggaaagagtggagacggttcctcagtggttagattctcaggaaggagtatatggaaaacctgcacaagaggatttcacagcagaccatgaacgctggaagactattgtttcaaagtcatacctcaacggtatgggaatcgattggtcttatgttagaaatgtgatggacatgagagcagtctatggaggttttgctgctgcattgaaggatctgaaactgtgggtgatgaatgtagttcctatcgactcacctgatacccttccgattatatacgaacgtggtttgtttggaatctatcatgattggtgtgaatcattcagcacttaccctcggacttacgacctccttcacgctgatcatcttttctcttcactgaaaaagaggtgcaacttggtgggcgtgatggctgaagtagaccggattcttagaccacaaggaactttcatagtaagagatgacatggaaacgataggagaaattgagaagatggtgaaatcgatgaaatggaatgtaagaatgacacattccaaagatggagaaggattgctctctgttcagaagtcatggtggcgtcctacagaggccgagaccattcagtcggcaatagcttgagatcaaggaaacgaagaagagtgtgggttaatatagtcgacagttgttccttttacgatccaattgattgtttcttacatgtattagtcgaatatttgtatcccttttttgcattgaagaaagttgtatacaa

SEQ ID NO: 626 - protein, 770 aa, Arabidopsis thaliana
  G837,AKR domain coordinates 250-754
MAMGKYSRVDGKKSSGYGLTITIVLIVSLCLVGAWMFMSSWSAPTESIDFSANERTKDVDTTKSDFKSEEVDRGSKSFPDEKNEETEVVTETNEEKTDPEKSGEENSGEKTESAEERKEFDDKNGDGDRKNGDGEKDTESESDETKQKEKTQLEESSEENKSEDSNGTEENAGESEENTEKKSEENAGETEESTEKSKDVFPAGDQAEITKESSTGSGAWSTQLVESQNEKKAQVSSIKWKVCNVTAGPDYIPCLDNWQAIRKLHSTKHYEHRERHCPEESPRCLVSLPEGYKRSIKWPKSREKIWYTNIPHTKLAEVKGHQNWVKMSGEYLTFPGGGTQFKNGALHYIDFLQESYPDIAWGNRTRVILDVGCGVASFGGYLFDRDVLALSFAPKDEHEAQVQFALERGIPAMSNVMGTKRLPFPGSVFDLIHCARCRVPWHIEGGKLLLELNRALRPGGFFVWSATPVYRKTEEDVGIWKAMSKLTKAMCWELMTIKKDELNEVGAAIYQKPMSNKCYNERSQNEPPLCKDSDDQNAAWNVPLEACIHKVTEDSSKRGAVWPESWPERVETVPQWLDSQEGVYGKPAQEDFTADHERWKTIVSKSYLNGMGIDWSYVRNVMDMRAVYGGFAAALKDLKLWVMNVVPIDSPDTLPIIYERGLFGIYHDWCESFSTYPRTYDLLHADHLFSSLKKRCNLVGVMAEVDRILRPQGTFIVRDDMETIGEIEKMVKSMKWNVRMTHSKDGEGLLSVQKSWWRPTEAETIQSAIA

SEQ ID NO: 627 - DNA, 2353 bp, Arabidopsis thaliana
  G839,family:AKR
tctcaatttggttcttttgccttctctttgatcttatctcttacgattgtgcagatctcaatctctatatccttggttgtgtcagattctcttagggtttattttctctcccaattttgtttgattccttgtccaaagtttcttcctttccttttgacttttttttgtggtacattgaatcagaggtgtaagagtaatagtttcataactcaaatccccaagtgtacaaattttcctcttttggttctgggtttggttgattccttgttagaaatgtaaatttagggcttttgtatctgaaaccgatcttcagacttgtgtaatcttcttgatcttcatgcaagattgataattctacaagaagaagaagaagagaaaatggctactttgactgagccatcatcatctttgagtttcacatcttctcatttctcttatggttctattgggtccaatcacttctcatcaagctcagcttctaatcctgaagttgttagtctaaccaaactcagctccaatcttgagcagcttcttagtaattcagattgtgattacagtgatgcagagatcattgttgatggtgttccagttggtgttcatagatgcattttagctgcaagaagtaagtttttccaagatttgtttaagaaagaaaagaaaatttcgaaaactgagaaaccaaagtatcagttgagagagatgttaccttatggagctgttgctcatgaagctttcttgtatttcttgagttatatatatactgggagattaaagccttttccattggaggtttcgacttgtgttgatccagtttgttctcatgattgttgtcgacctgccattgattttgttgttcaattgatgtatgcttcctctgttctccaagtgcctgagctagtttcatcttttcagcggcggctttgtaactttgtggagaagacccttgttgagaatgttcttcccattcttatggttgctttcaattgtaagttgactcagcttcttgatcagtgtattgagagagtggcgaggtcagatctttacaggttctgtattgaaaaggaagttcctcccgaagtagcagagaagattaaacagcttcgacttatatccccgcaagacgaagaaaccagtcccaagatttcggagaaattgcttgaaagaatcggtaaaattctcaaggccttggattcagatgatgttgagcttgtgaagcttcttttgactgagtcagatatcactctagatcaagccaatggtctgcattattctgttgtgtatagtgatccgaaagttgttgccgagattcttgctctggatatgggtgatgtgaactacaggaattcccggggttacacggttcttcattttgctgcgatgcgtagagagccatcgatcattatatcgcttatcgataaaggcgccaatgcatctgagtttacatctgacggacgtagcgcagttaatatattaagaagactgacaaatccaaaggattatcataccaaaacagctaaagggcgtgaatctagtaaagccaggttatgcatcgatatcttggaaagagaaatcaggaagaaccccatggttctagatacaccaatgtgttccatttctatgcctgaagatctccagatgagactgttgtacctagaaaagagagtggggcttgctcagttgttctttccaacggaagctaaagttgctatggacattggtaacgtagaaggtacaagtgagttcacgggtttgtcacctccttcgagtgggttaaccggaaacttgagtcaggttgatttaaacgaaactcctcatatgcaaacccaaagacttcttactcgtatggtggctctaatgaaaacagttgagactggtcgaaggttttttccatatggttcagaggttctagataagtacatggctgagtatatagacgacgacatcctcgacgatttccattttgagaagggatctacacatgaaagaagattgaaaagaatgagatatagagagcttaaggatgatgtccaaaaggcatatagcaaagacaaagagtctaagattgcgcggtcttgtctttctgcttcatcttctccttcttcttcttccataagagatgacctgcacaacacaacatgaaactgcaccataagtcaaatgtaattagatatctttgttaaaagggttttttctttatggatgttactcagattttatacagatgctttaggttcagtttcaataaagagagatggatagatagatgtacaagattaggagtgctgattaacccaaaacgttctaactatacgcaatcttttgttttcaatacaaaaatctaatatttaggtta

SEQ ID NO: 628 - protein, 586 aa, Arabidopsis thaliana
  G839,AKR domain coordinates 60-185,290-353
MATLTEPSSSLSFTSSHFSYGSIGSNHFSSSSASNPEVVSLTKLSSNLEQLLSNSDCDYSDAEIIVDGVPVGVHRCILAARSKFFQDLFKKEKKISKTEKPKYQLREMLPYGAVAHEAFLYFLSYIYTGRLKPFPLEVSTCVDPVCSHDCCRPAIDFVVQLMYASSVLQVPELVSSFQRRLCNFVEKTLVENVLPILMVAFNCKLTQLLDQCIERVARSDLYRFCIEKEVPPEVAEKIKQLRLISPQDEETSPKISEKLLERIGKILKALDSDDVELVKLLLTESDITLDQANGLHYSVVYSDPKVVAEILALDMGDVNYRNSRGYTVLHFAAMRREPSIIISLIDKGANASEFTSDGRSAVNILRRLTNPKDYHTKTAKGRESSKARLCIDILEREIRKNPMVLDTPMCSISMPEDLQMRLLYLEKRVGLAQLFFPTEAKVAMDIGNVEGTSEFTGLSPPSSGLTGNLSQVDLNETPHMQTQRLLTRMVALMKTVETGRRFFPYGSEVLDKYMAEYIDDDILDDFHFEKGSTHERRLKRMRYRELKDDVQKAYSKDKESKIARSCLSASSSPSSSSIRDDLHNTT

SEQ ID NO: 629 - DNA, 1946 bp, Arabidopsis thaliana
  G843,family:MISC
gccgggaagaagtgcgagcttggtgccgatgggtcgttcgaaactagcttctcgtcctgctgaggaagacctgaatccaggaaaatcaaaaaggaaaaagatatcattgggtcctgagaatgctgcggcatcaatttccaccggaattgaagctgggaatgagaggaaacctggcctttactgttgtaactattgcgataaagatctgtctggtttggttcgtttcaaatgtgctgtttgtatggactttgatctttgtgtggaatgcttttctgtcggcgttgaacttaatcgtcacaagaacagtcacccatatcgtgttatggacaatttgtctttttcgcttgttacttctgattggaatgccgatgaagagatactccttcttgaggccattgcgacatacgggtttggcaattggaaagaagttgcagaccatgttggtagtaagacaacgacagaatgtattaaacacttcaattctgcttacatgcagtcaccatgctttccacttccggacttgtcccatactattggaaagagcaaagatgagctgcttgctatgagtaaagatagtgcagtcaaaacagaaatacctgcatttgtgaggctatctccaaaagaagagttacctgtgtcagctgaaatcaaacacgaagcttcagggaaggtcaatgaaatagatccacctttgtctgccttagctggagtcaagaagaaaggcaatgtaccgcaggctaaggacatcatcaagttggaagctgcaaaacaacaatctgacaggagtgtcggggagaagaaactcagacttcctggagagaaagttccattagtaacagagttatatggttacaatctaaagagggaagaatttgagatcgaacatgacaacgatgctgagcaactgcttgctgacatggaatttaaggattctgacacagatgctgagcgtgagcagaaactgcaggttcttcgtatttactcgaaaaggcttgatgagaggaagcggaggaaggaatttgttctggaaagaaacttgttgtaccctgatcaatatgagatgagcctttcagcagaggagagaaaaatatataaaagctgtaaagtgtttgcgcggttccaatccaaagaagagcacaaggaactgattaagaaagtcattgaagagcaccaaattctcagaagaatcgaggatcttcaggaagctagaactgctggttgcaggacaacttcagacgcaaatagatttatagaagagaagagaaagaaggaagctgaagaaagtatgctgctgcggcttaaccacggtgcaccaggcagtatagccggtaaaacactaaaaagtccaagagggttacccagaaatttgcatccctttggttctgactcactgccaaaggtcacacctccaagaatatacagcggtttggacacttgggatgttgatggtctccttggagctgacttactctcagagaccgaaaagaagatgtgcaatgagaccagaatactgcctgtacactatttgaagatgttggatatcttaacaagagaaataaagaaggggcagataaagaaaaagtctgatgcttatagcttcttcaaagtagagccgagtaaagtagacagagtatatgatatgctggttcataagggaataggtgactcaacatgactcatagcttcatggtcctaacatgtacttctcgaacatatattagccatgtaaatataaaggaaggtgatgctgattttggttacacatcttgttctctgttagtttcgacaacttgacaatgtctgattgttatgaccttcaaaggctgtttcagattttttgatacaacgtttaaactgaatattgtaatgccttcactcatctgattccttcaatttttgttatatgagatcagaaagtcttgagacaaaaaaaaaaaaaaaaaaaa

SEQ ID NO: 630 - protein, 548 aa, Arabidopsis thaliana
  G843,MISC domain coordinates 60-119,270-350
MGRSKLASRPAEEDLNPGKSKRKKISLGPENAAASISTGIEAGNERKPGLYCCNYCDKDLSGLVRFKCAVCMDFDLCVECFSVGVELNRHKNSHPYRVMDNLSFSLVTSDWNADEEILLLEAIATYGFGNWKEVADHVGSKTTTECIKHFNSAYMQSPCFPLPDLSHTIGKSKDELLAMSKDSAVKTEIPAFVRLSPKEELPVSAEIKHEASGKVNEIDPPLSALAGVKKKGNVPQAKDIIKLEAAKQQSDRSVGEKKLRLPGEKVPLVTELYGYNLKREEFEIEHDNDAEQLLADMEFKDSDTDAEREQKLQVLRIYSKRLDERKRRKEFVLERNLLYPDQYEMSLSAEERKIYKSCKVFARFQSKEEHKELIKKVIEEHQILRRIEDLQEARTAGCRTTSDANRFIEEKRKKEAEESMLLRLNHGAPGSIAGKTLKSPRGLPRNLHPFGSDSLPKVTPPRIYSGLDTWDVDGLLGADLLSETEKKMCNETRILPVHYLKMLDILTREIKKGQIKKKSDAYSFFKVEPSKVDRVYDMLVHKGIGDST

SEQ ID NO: 631 - DNA, 3115 bp, Arabidopsis thaliana
  G846,family:SWI/SNF
acaattggcttcacactctctcttttctcaattttgcttcttacttctttccccggctgattagaaacttgaccgcttgattctcttaaaggaggtcttgcgatggattccgctattgatatcagttctgatagtgatgtcgagatacaagaaactagaaccaggcctcaacatcccccacggatagctgaaggatctcatagaagagatctctctacgctgagaccgcactttcttagtgggagttcttccggtgcaaatggccacactaaaacaggacttacaaatctcgactcacgtaatggttttgaatccaagccactgcctcgggcagaacaccatacacatattccgggaaatgggagtatcgtaacttccagaattcccaatatctctgttggtgattatgagaaattttcatctcaacaagcttttaaaaggacacatccaccaacctttagtcgacctccttttcctcctagacctgatattggtacaagtaacgggaatgcgagtcactttcgtggtggagcacatgatgatctaggcatggggcgtgtgactaacggcactcggatcctacctccatctgtggcgcacggaacatctgcgtctccttcacattttaatggattaagtgatccaatgcataggaatggcataggcgaagaaaggaattcggaaaatgacgagaggctgatctatcaggctgcactacaggaactgaatcaacccaagtccgaggtcgatttacctgctggtcttctttcggttccccttatgaagcatcagaaaattgcattggcatggatgtttcagaaggaaactaatagtttgcactgtatgggagggatattagctgatgatcagggccttggtaagacagtctcgactattgcgcttatcctaaagcaaatgcacgaggcaaaattaaagtccaagaattcaggcaatcaagaggctgaagcattggatctggatgctgatgatgagtcagaaaatgcatttgagaaaccagagtctaaggcttcaaatggtagtggtgtgaatggtgattcaggcataaagaaagccaagggagaagaagcgagtacttcaacacgcaaattcaacagaaagagaccagctgctggtactttaattgtttgtccagcaagtgttgtgcggcagtgggcaagagaacttgatgagaaggttactgatgaagccaaactttctgttttaatataccacggcggtaacaggaccaaagatcctattgaactagcaaaatatgatgtggttatgacaacttacgccattgtttcaaatgaagttccaaagcaacccctggttgatgacgatgagaatgatgaaaaaaattctgaaaaatatggtctcgcttctggcttctccatcaataagaaacggaaaaatgtagtgggtactactaagaagagtaagaagaaaaaaggtaacaataatgctggcgattcatctgaccctgactctggtactctagcaaaagttgggtggttcagagttgtactagatgaagctcaaacaattaagaatcatagaacccaggtggcaagagcatgttgcggtcttcgagccaaaaggaggtggtgtttgtctggaacaccaatacaaaatacaatagatgatttatacagctatttcaggtttctaaaatatgatccatatgctgtgtacaagtcattctgccaccaaattaagggtccaatttccagaaattcccttcaagggtacaagaagcttcaggctgttctaagggctataatgctacgccgtacgaaaggaacattgcttgatggccagcctataattaatctaccaccaaagacaattaatttgagccaggtggacttttcggtagaggagcggtctttctacgtgaagcttgaatccgattcccgttctcagttcaaggcatatgctgctgcaggaactttgaatcaaaactatgcaaacattcttctcatgcttttgcgactacgccaagcttgtgaccacccccaacttgttaaaagatataactcagattctgttggaaaagtatcagaagaagctgttaaaaaactccctaaagaggatctagttagcctgctcagtcgcttagaatcgtctcccatctgttgtgtctgccatgatccaccagaagaccctgttgttactttgtgtggccatatattctgctatcagtgtgtatcagattatatcacaggggatgaggacacgtgccctgcgcctagatgcagagaacagcttgcgcatgatgttgttttctctaaatccacgcttagaagttgcgttgctgatgatttgggttgtagttcctcagaggataatagtcatgataaatcagtttttcagaatggcgagtttagttcatcaaagatcaaagctgtcttagatattctgcagtcgctttctaaccaaggcacttcaaactcaacacagaatggtcaaatggcttcttcctcgcagcagccgaatgatgatgatgatgatgatgatgatgatgtcaccattgtcgagaaaacgagtctgaagtcaactccttctaatggaggaccaataaaaacgattatattttctcagtggactggtatgcttgacttggtggagctatctctaattgaaaatagtatagaattcagaagattagatggtacaatgagtctaattgccagagacagagctgtgaaagaattcagcaacgatccagatgtaaaagtgatgataatgtctttaaaagctggaaatcttgggctgaatatgattgctgcatgtcatgtcattcttcttgatctatggtggaatccaactactgaagatcaggctattgatcgagcacatcgtattggacaaactcgacctgttactgtaactcgtattacgataaaaaatactgtggaggatagaattttggctctccaggaagagaaaagaaaaatggttgcgtctgcctttggtgaagatcatggtggaagctctgcaactcgattaacagttgatgatctcaaatatctattcatggtgtagctgttcttaaatcttgggttggcgaagtttcgcttctttcagaattttgatcatgagctgcattctt

SEQ ID NO: 632 - protein, 981 aa, Arabidopsis thaliana
  G846,SWI/SNF domain coordinates 222-531,679-719,840-923
MDSAIDISSDSDVEIQETRTRPQHPPRIAEGSHRRDLSTLRPHFLSGSSSGANGHTKTGLTNLDSRNGFESKPLPRAEHHTHIPGNGSIVTSRIPNISVGDYEKFSSQQAFKRTHPPTFSRPPFPPRPDIGTSNGNASHFRGGAHDDLGMGRVTNGTRILPPSVAHGTSASPSHFNGLSDPMHRNGIGEERNSENDERLIYQAALQELNQPKSEVDLPAGLLSVPLMKHQKIALAWMFQKETNSLHCMGGILADDQGLGKTVSTIALILKQMHEAKLKSKNSGNQEAEALDLDADDESENAFEKPESKASNGSGVNGDSGIKKAKGEEASTSTRKFNRKRPAAGTLIVCPASVVRQWARELDEKVTDEAKLSVLIYHGGNRTKDPIELAKYDVVMTTYAIVSNEVPKQPLVDDDENDEKNSEKYGLASGFSINKKRKNVVGTTKKSKKKKGNNNAGDSSDPDSGTLAKVGWFRVVLDEAQTIKNHRTQVARACCGLRAKRRWCLSGTPIQNTIDDLYSYFRFLKYDPYAVYKSFCHQIKGPISRNSLQGYKKLQAVLRAIMLRRTKGTLLDGQPIINLPPKTINLSQVDFSVEERSFYVKLESDSRSQFKAYAAAGTLNQNYANILLMLLRLRQACDHPQLVKRYNSDSVGKVSEEAVKKLPKEDLVSLLSRLESSPICCVCHDPPEDPVVTLCGHIFCYQCVSDYITGDEDTCPAPRCREQLAHDVVFSKSTLRSCVADDLGCSSSEDNSHDKSVFQNGEFSSSKIKAVLDILQSLSNQGTSNSTQNGQMASSSQQPNDDDDDDDDDVTIVEKTSLKSTPSNGGPIKTIIFSQWTGMLDLVELSLIENSIEFRRLDGTMSLIARDRAVKEFSNDPDVKVMIMSLKAGNLGLNMIAACHVILLDLWWNPTTEDQAIDRAHRIGQTRPVTVTRITIKNTVEDRILALQEEKRKMVASAFGEDHGGSSATRLTVDDLKYLFMV

SEQ ID NO: 633 - DNA, 2214 bp, Arabidopsis thaliana
  G849,family:BPF-1
aactcgagaattcttcatttcttttaaatcttagaatctcgagtttttgtataaatcgattctaatttttcctttgtacattgttttatatatacataaaacacacaaatcgggtatgggggaatttgggttttaagatagcgtgatctgtaataataagtggttcgcgatcgtgatcaagaaactggtggctgatagtgatatgcatatttgagagatggtgttcaagagaaagttagattgcctttccgtgggatttgattttcccaacattcccagagctcctcgttcatgcaggaggaaggttctaaacaagaggattgatcatgatgatgataacactcagatctgtgcaattgacttactagctttggctggaaagattctacaggaaagcgagagttcctctgcgtcttctaatgcatttgaagaaattaagcaagagaaagtagaaaattgcaagactattaaatctgagtcttctgaccaaggaaactctgtgtcaaagcctacttatgatatctctactgagaagtgtgtggtgaacagttgtttttcatttccggatagtgacggcgttttggagcggactccgatgtctgattacaagaagattcatggtttgatggatgtagggtgtgaaaacaagaatgtaaataatgggttcgagcaaggagaagcaaccgatcgcgtgggtgatggaggcttagtcactgatacttgcaacttagaggatgcaactgcgttaggtctgcagtttccgaaatcagtctgtgtgggtggtgatttaaaatcaccatccaccttggatatgacccctaatggttcctatgctagacatgggaaccatactaacctaggtagaaaagatgatgatgaaaaattctatagttaccataaacttagcaataaatttaagtcgtataggtctccaacaattcgaagaataagaaagtccatgtcgtccaaatactggaaacaagttccaaaagattttggatacagtagagctgatgtgggtgtgaagactctttatcgcaaaagaaaatcatgttatggttacaacgcatggcagcgtgagatcatttataagagaagaagatcacctgacagaagctcggtcgtaacttctgatggaggactcagtagtggaagtgtttccaagttacccaagaagggagatacagtaaagctaagcattaagtcctttaggattccagagctttttattgaagttccagaaactgcaacagtaggatcactaaagaggactgtgatggaggctgtcagtgttttactcagcggaggaatacgtgttggggtgttaatgcatgggaagaaggttagagatgaaaggaaaactctgtcccagactgggatctcatgtgatgaaaatctagacaaccttgggttcaccttggagcctagtcccagcaaagttcccctacctttgtgttctgaagatcctgctgtgccaaccgaccctacaagtttgtctgaacggtctgcggcgtctcctatgctagattctggaattccacatgcagatgacgtgattgattcaagaaatattgtggacagtaacctcgaattagttccatatcagggtgacatatctgttgatgaaccttcatcagattcaaaagagcttgtcccacttccagagttggaagtcaaggcgcttgccatagttccgttgaaccagaaacctaagcgtactgagctagcccagaggagaactaggagacccttctctgtgacagaggtagaagctcttgtacaagcagttgaggaactcgggactggaagatggcgtgatgtaaaattgcgtgctttcgaggatgcagatcatcggacttacgtggacttgaaggacaaatggaagacgctagttcacacagcaagtatatccccacagcaacgaagaggagagccggtgccacaagaactgctagacagagtcttgagggcatacgggtattggtcgcagcaccaaggaaaacatcaggcgagaggagcgtccaaagatccagacatgaacagaggtggagcttttgaatcaggtgtttcagtgtaaaaaaggaggtacgcattggtgggtgggtgtacagaagcaaacaacacaataaatggacaactcaatttctgcaaagtttaattgtctttatttctcgtttttttttttttttctcctacatacacttttttttttct

SEQ ID NO: 634 - protein, 619 aa, Arabidopsis thaliana
  G849,BPF-1 domain coordinates 324-403,505-591
MVFKRKLDCLSVGFDFPNIPRAPRSCRRKVLNKRIDHDDDNTQICAIDLLALAGKILQESESSSASSNAFEEIKQEKVENCKTIKSESSDQGNSVSKPTYDISTEKCVVNSCFSFPDSDGVLERTPMSDYKKIHGLMDVGCENKNVNNGFEQGEATDRVGDGGLVTDTCNLEDATALGLQFPKSVCVGGDLKSPSTLDMTPNGSYARHGNHTNLGRKDDDEKFYSYHKLSNKFKSYRSPTIRRIRKSMSSKYWKQVPKDFGYSRADVGVKTLYRKRKSCYGYNAWQREIIYKRRRSPDRSSVVTSDGGLSSGSVSKLPKKGDTVKLSIKSFRIPELFIEVPETATVGSLKRTVMEAVSVLLSGGIRVGVLMHGKKVRDERKTLSQTGISCDENLDNLGFTLEPSPSKVPLPLCSEDPAVPTDPTSLSERSAASPMLDSGIPHADDVIDSRNIVDSNLELVPYQGDISVDEPSSDSKELVPLPELEVKALAIVPLNQKPKRTELAQRRTRRPFSVTEVEALVQAVEELGTGRWRDVKLRAFEDADHRTYVDLKDKWKTLVHTASISPQQRRGEPVPQELLDRVLRAYGYWSQHQGKHQARGASKDPDMNRGGAFESGVSV

SEQ ID NO: 635 - DNA, 1782 bp, Arabidopsis thaliana
  G852,family:SCR
atggtggaacaaactgtggttagagaacatatcaaagcgagagtcatgtcattagtgaggtctgcagagccatcctcatataggaacccgaagctttacacgttgaatgagaatggtaataacaatggtgtcagttctgctcaaatctttgatccagataggtcaaagaatccttgtctgactgatgattcttacccaagccaaagttatgagaagtactttcttgattcgccaactgatgagtttgttcaacatcctattggctctggtgcctcggttagctcatttggctctttagactcatttccttatcagtcaagaccagttcttggatgttccatggaatttcagttaccgttggattcaacctctacttcatctacaaggcttttgggagattaccaagcggtttcttacagtccgagcatggatgtagtggaggagtttgatgatgagcaaatgagatcaaagattcaagagcttgaaagagcgcttctcggcgatgaagatgataaaatggttggaatagataacctcatggagattgacagcgaatggtcgtaccaaaacgaaagcgaacagcatcaagactcgcccaaagaatcatcgtctgcagattccaactctcatgtaagtagcaaagaagtggtgtctcaagccactccaaagcaaatcttgatatcttgtgctcgtgcgctatctgaaggaaaattagaagaagctttgtcaatggtaaatgagctgaggcagatagtttctatccaaggagacccttctcagagaatcgcagcttacatggtggaaggtctagctgcaagaatggccgcttcaggaaaattcatctacagagcattgaaatgcaaagagcctccttcggatgagaggcttgcagctatgcaagtcctgtttgaagtctgcccttgtttcaagttcgggtttttagcagctaatggtgcgatacttgaagcaatcaaaggtgaagaagaagttcacataatcgatttcgatataaaccaagggaaccaatacatgacactgatacgaagcattgctgagttgcctggtaaacgacctcgcctgaggttaacaggaattgatgaccctgaatcagtccaacgctccattggagggctaagaatcatcggtctaagactcgagcaactcgcagaggataatggagtatccttcaaattcaaagcaatgccttcaaagacttcgattgtctctccatcaacactcggttgcaaaccaggagaaaccttaatagtgaactttgcattccaacttcaccacatgcctgacgagagtgtcacaacagtaaaccagcgggacgagctacttcacatggtcaaaagcttaaacccaaagcttgtcacggtcgttgaacaagacgtgaacacaaacacttcaccgttctttcccagattcatagaggcttacgaatactactcagcagttttcgagtctctagacatgacacttccaagagaaagccaagagaggatgaatgtagaaagacagtgtctcgctagagacatagtcaacattgttgcttgcgaaggagaagaacggatagagagatacgaggctgcgggaaaatggagagcaaggatgatgatggctggattcaatccaaaaccaatgagtgctaaagtaaccaacaatatacaaaacctgataaagcaacaatattgcaataagtacaagcttaaagaagaaatgggtgagctccatttttgctgggaggagaaaagcttaatcgttgcttcagcttggaggtaa

SEQ ID NO: 636 - protein, 593 aa, Arabidopsis thaliana
  G852,SCR domain coordinates 299-364,427-515,519-592
MVEQTVVREHIKARVMSLVRSAEPSSYRNPKLYTLNENGNNNGVSSAQIFDPDRSKNPCLTDDSYPSQSYEKYFLDSPTDEFVQHPIGSGASVSSFGSLDSFPYQSRPVLGCSMEFQLPLDSTSTSSTRLLGDYQAVSYSPSMDVVEEFDDEQMRSKIQELERALLGDEDDKMVGIDNLMEIDSEWSYQNESEQHQDSPKESSSADSNSHVSSKEVVSQATPKQILISCARALSEGKLEEALSMVNELRQIVSIQGDPSQRIAAYMVEGLAARMAASGKFIYRALKCKEPPSDERLAAMQVLFEVCPCFKFGFLAANGAILEAIKGEEEVHIIDFDINQGNQYMTLIRSIAELPGKRPRLRLTGIDDPESVQRSIGGLRIIGLRLEQLAEDNGVSFKFKAMPSKTSIVSPSTLGCKPGETLIVNFAFQLHHMPDESVTTVNQRDELLHMVKSLNPKLVTVVEQDVNTNTSPFFPRFIEAYEYYSAVFESLDMTLPRESQERMNVERQCLARDIVNIVACEGEERIERYEAAGKWRARMMMAGFNPKPMSAKVTNNIQNLIKQQYCNKYKLKEEMGELHFCWEEKSLIVASAWR

SEQ ID NO: 637 - DNA, 1036 bp, Arabidopsis thaliana
  misc_feature (1012)..(1012): n is a, c, g, or t
  G859,family:MADS
gatttgtcattttttgtctagccaaaaaaaaaaaaaaaaaaggagagagagagagagagagagagagagagaaacgaagaaaaaaaaagaagcaaaaaacattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgattcagaagtttttacaaatttgtaaattataaaaagcttcataataatctcaacctttttatcttcctcgcgccaatgtggaaattaaggttaaaaataaaataaaacagaagctcatgcgaaagaattgtaaaactaagataaagctatagtagatctttattgtaccttcgtagacgatataagatttattcgtgtgtttgtcttcccctcnaaaaaaaaaaaaaaaaaaaaaaaa

SEQ ID NO: 638 - protein, 196 aa, Arabidopsis thaliana
  G859,MADS domain coordinates 1-57
MGRKKVEIKRIENKSSRQVTFSKRRNGLIEKARQLSILCESSIAVLVVSGSGKLYKSASGDNMSKIIDRYEIHHADELEALDLAEKTRNYLPLKELLEIVQSKLEESNVDNASVDTLISLEEQLETALSVTRARKTELMMGEVKSLQKTENLLREENQTLASQVGKKTFLVIEGDRGMSWENGSGNKVRETLPLLK

SEQ ID NO: 639 - DNA, 1210 bp, Arabidopsis thaliana
  misc_feature (1194)..(1196): n is a, c, g, or t
  G860,family:MADS
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttgtcacccttccgttgcattttagcttcccatccaaatcaatttgtaaaatgtgagttagtttgcagcatgaaagctgattaaatatcagtcccgttatcacaagaggtaaaaaannnaaaaaaaaaaaaaa

SEQ ID NO: 640 - protein, 240 aa, Arabidopsis thaliana
  G860,MADS domain coordinates 2-57
MGRGKIAIKRINNSTSRQVTFSKRRNGLLKKAKELAILCDAEVGVIIFSSTGRLYDFSSSSMKSVIERYSDAKGETSSENDPASEIQFWQKEAAILKRQLHNLQENHRQMMGEELSGLSVEALQNLENQLELSLRGVRMKKDQMLIEEIQVLNREGNLVHQENLDLHKKVNLMHQQNMELHEKVSEVEGVKIANKNSLLTNGLDMRDTSNEHVHLQLSQPQHDHETHSKAIQLNYFSFIA

SEQ ID NO: 641 - DNA, 1134 bp, Arabidopsis thaliana
  G861,family:MADS
cttcttcctcctcctccatctcttctctttactctctctttaatcatctctcattcttgaatcttgatccatcaaaatcaatcccgttctcgaaagatccattaaaatcaaaacctaagctctctctcttgcttctagggtttttttgttcgttgtgatggcgagagaaaagattcagatcaggaagatcgacaacgcaacggcgagacaagtgacgttttcgaaacgaagaagagggcttttcaagaaagctgaagaactctccgttctctgcgacgccgatgtcgctctcatcatcttctcttccaccggaaaactgttcgagttctgtagctccagcatgaaggaagtcctagagaggcataacttgcagtcaaagaacttggagaagcttgatcagccatctcttgagttacagctggttgagaacagtgatcacgcccgaatgagtaaagaaattgcggacaagagccaccgactaaggcaaatgagaggagaggaacttcaaggacttgacattgaagagcttcagcagctagagaaggcccttgaaactggtttgacgcgtgtgattgaaacaaagagtgacaagattatgagtgagatcagcgaacttcagaaaaagggaatgcaattgatggatgagaacaagcggttgaggcagcaaggaacgcaactaacggaagagaacgagcgacttggcatgcaaatatgtaacaatgtgcatgcacacggtggtgctgaatcggagaacgctgctgtgtacgaggaaggacagtcgtcggagtctattactaacgccggaaactctaccggagcgcctgttgactccgagagctccgacacttcccttaggctcggcttaccgtatggtggttagagatggaacaattcaaagaagttgatggagtgaggagagtaatgtaaatctttttaactcggtagtaacaagagacaatgtctaagtagtgaattctcaaatgtttgtgtaagtttctgcctatggaagaggctttcatttttatgattttcactatgtatgatctctcttcactgcatttctggttagtaacggcttgtcaccgataaactttctcgttatggaaagttagaataaaaaaaaaaaaaaaaaaa

SEQ ID NO: 642 - protein, 240 aa, Arabidopsis thaliana
  G861,MADS domain coordinates 2-57
MAREKIQIRKIDNATARQVTFSKRRRGLFKKAEELSVLCDADVALIIFSSTGKLFEFCSSSMKEVLERHNLQSKNLEKLDQPSLELQLVENSDHARMSKEIADKSHRLRQMRGEELQGLDIEELQQLEKALETGLTRVIETKSDKIMSEISELQKKGMQLMDENKRLRQQGTQLTEENERLGMQICNNVHAHGGAESENAAVYEEGQSSESITNAGNSTGAPVDSESSDTSLRLGLPYGG

SEQ ID NO: 643 - DNA, 1747 bp, Arabidopsis thaliana
  G864,family:AP2
tgcaaaaacattttcttgtctctcctctgcccaaattttttttctttccaggaatatttcctagaaaaacccaagcaaagctttaaccccttcctcctccaaaagtagcatcttcctctttttctatttctcctttcctcttcttatctctctctcgtttgtgaacgattccttaagaatataaccaaaagcccttttctcctttcttcaactttccgggaaaaatcttcacgcagcaaggtttctctctcggctctcgcagtgtttttcgggccttttgttctttctataaaaaaaaaattcgcgtcctttaagaaaactttttccacctagagaagaagaagagtatcactcttgttgttcaagtttctctctttaataaaaaatccatctttattctttgtcttctttcctttttgctttccctaatctctatgttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccggagaaagttttgtataccggtgacataaaatctcggttatgttcgtaatctttttttctttgttatatataaaaatatgaatgaaactgaattaatgtaagttaatggtgataattattaacgttttaagttttgaaaaaaaaaaaaaaaaaaaaaaaaaaa

SEQ ID NO: 644 - protein, 343 aa, Arabidopsis thaliana
  G864,AP2 domain coordinates 119-181
MEAEKKMVLPRIKFTEHKTNTTTIVSELTNTHQTRILRISVTDPDATDSSSDDEEEEHQRFVSKRRRVKKFVNEVYLDSGAVVTGSCGQMESKKRQKRAVKSESTVSPVVSATTTTTGEKKFRGVRQRPWGKWAAEIRDPLKRVRLWLGTYNTAEEAAMVYDNAAIQLRGPDALTNFSVTPTTATEKKAPPPSPVKKKKKKNNKSKKSVTASSSISRSSSNDCLCSPVSVLRSPFAVDEFSGISSSPVAAVVVKEEPSMTTVSETFSDFSAPLFSDDDVFDFRSSVVPDYLGGDLFGEDLFTADMCTDMNFGFDFGSGLSSWHMEDHFQDIGDLFGSDPLLAV

SEQ ID NO: 645 - DNA, 1126 bp, Arabidopsis thaliana
  G865,family:AP2
atccccacttgttgttcatcaccaagccaagctccatgtcctagtcactccacagattccctatcatcatcaattcgtttcaaacttagttcctttcaaagtcttgtacatatatacacacacacctattattctcttggtgtgtttgtgtgttacatatacgtgtgagtacatactttgttgtaaaagtggatcggaggtatggaaagggaccggttccaccggaaacatcggcggcggcggatgataattcgtcttggaacgagactgatgtcaccgccatggtctccgctctcagccgtgtcatagagaatccgacagacccgccggtcaaacaagagcttgataaatcggatcaacatcaaccagaccaagatcaaccaagaagaagacactatagaggcgtaaggcagagaccatggggtaaatgggcggcagaaatccgcgatccaaagaaagcagcccgtgtctggctcgggactttcgagacggcagaggaagctgctttagcctatgaccgagctgccctcaaattcaaaggcaccaaggctaaactgaacttccctgaacgggtccaaggccctactaccaccacaaccatttctcatgcaccaagaggagttagtgaatccatgaactcacctcctcctcgacctggtccaccttcaactactactacttcgtggccaatgacttataaccaggacatacttcaatacgctcagttgcttacgagtaacaatgaggttgatttatcatactacacgtcgactctcttcagtcaacctttttcaacgccttcttcatcttcttcttcctcccaacagacgcagcaacagcagctacaacaacaacaacagcagcgtgaagaagaagagaagaattatggttacaattattataactacccaagagaataatctaattattattgttggtcgaatcagttttataaatagctatcatagtttcatttttggtttccgtaacctttgttgcatggaaaatatgaatgaacgagggacatgtgtaacaatttgtttgtgtttcgtaaatgttagttgtatttggatttgctgaagtttgattttctgagcataaatcatttgacggtcaaaaaaaaaaa

SEQ ID NO: 646 - protein, 212 aa, Arabidopsis thaliana
  G865,AP2 domain coordinates 36-103
MVSALSRVIENPTDPPVKQELDKSDQHQPDQDQPRRRHYRGVRQRPWGKWAAEIRDPKKAARVWLGTFETAEEAALAYDRAALKFKGTKAKLNFPERVQGPTTTTTISHAPRGVSESMNSPPPRPGPPSTTTTSWPMTYNQDILQYAQLLTSNNEVDLSYYTSTLFSQPFSTPSSSSSSSQQTQQQQLQQQQQQREEEEKNYGYNYYNYPRE

SEQ ID NO: 647 - DNA, 1198 bp, Arabidopsis thaliana
  G866,family:WRKY
aaaaaaaacttgcacatcttctcagatcttcaagtttctcctctggtttctcatcatgaccgttgatattatgcgtttacctaagatggaagatcaaacggctatacaagaagctgcatcacaaggcttaaaaagcatggaacacttgattcgtgtcctctctaaccgtcccgaagaacgtaacgttgattgctctgagatcactgatttcacagtttctaagttcaagaaagttatctctcttcttaaccgttccggtcacgcccggtttagacgtggtccggttcattcccctccttcctcctccgttcctccaccggtgaaagtgacaactccggctcccactcagatctctgctccagcaccggttagcttcgttcaggcaaatcaacaaagcgtgacgttagatttcactagaccgagcgtttttggcgctaaaaccaagagctcggaggttgttgagtttgctaaagagagctttagcgtatcttctaactcttctttcatgtcttctgcgatcaccggtgatggaagtgtctctaaaggctcttcgatctttcttgctccggctccagcggtgccagtgacttcctccgggaaaccgccgctttctggtcttccttacaggaagagatgctttgaacatgaccactctgaaggcttttccggcaagatctctggctccggcaacggcaagtgccattgcaagaaaagccgaaaaaatcggatgaagagaaccgtgagagtaccggcggtaagtgcaaagatcgccgatataccaccagacgaatattcatggagaaagtatggacaaaaaccgatcaaaggctcaccacatccacggggttattacaagtgtagtacatttagaggatgtccagcgaggaaacacgtggaaagagctttggatgattcaacgatgttgattgtgacgtacgaaggagagcaccgtcatcaccagtccacgatgcaggagcatgtaactcctagcgtgagtggtttggtgtttggttcggcttgaagaattaattagtttggtagttttgtaatattttgagaaatagaggggttggttttgtaattttttttctataacaaaattagttttagatttttttttagtagtcttttgaatggattttaatcttactaccgagaaagaaaaaattcttactacattttcaaaaaaaaaaaaaaa

SEQ ID NO: 648 - protein, 321 aa, Arabidopsis thaliana
  G866,WRKY domain coordinates 43-300
MTVDIMRLPKMEDQTAIQEAASQGLKSMEHLIRVLSNRPEERNVDCSEITDFTVSKFKKVISLLNRSGHARFRRGPVHSPPSSSVPPPVKVTTPAPTQISAPAPVSFVQANQQSVTLDFTRPSVFGAKTKSSEVVEFAKESFSVSSNSSFMSSAITGDGSVSKGSSIFLAPAPAVPVTSSGKPPLSGLPYRKRCFEHDHSEGFSGKISGSGNGKCHCKKSRKNRMKRTVRVPAVSAKIADIPPDEYSWRKYGQKPIKGSPHPRGYYKCSTFRGCPARKHVERALDDSTMLIVTYEGEHRHHQSTMQEHVTPSVSGLVFGSA

SEQ ID NO: 649 - DNA, 1571 bp, Arabidopsis thaliana
  G869,family:AP2
aggaacagtgaaaggttcggttttttgggtttcgatctgataatcaacaagaaaaaagggtttgatttatgtcggctgggtttgaatcgactgtgattttgtctttgattcatatctcttctccgatttcatcatcatcttccccatcatcgtcgtctttgaaatcttgtcttctcaacgctcttcacttctgctgtaataagcagaggcttgttctggagactccttctctttccatgcgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttgttttttcgtttatgctttagtaatttaagacatacaaaagtgtgtgttccggattgtagtaagatcttaagacataaagccgggttttgcaattaggaatcgagttttaatgaagttttagtttatgtttg

SEQ ID NO: 650 - protein, 324 aa, Arabidopsis thaliana
  G869,AP2 domain coordinates 110-165
MVAIRKEQSLSGVSSEIKKRAKRNTLSSLPQETQPLRKVRIIVNDPYATDDSSSDEEELKVPKPRKMKRIVREINFPSMEVSEQPSESSSQDSTKTDGKIAVSASPAVPRKKPVGVRQRKWGKWAAEIRDPIKKTRTWLGTFDTLEEAAKAYDAKKLEFDAIVAGNVSTTKRDVSSSETSQCSRSSPVVPVEQDDTSASALTCVNNPDDVSTVAPTAPTPNVPAGGNKETLFDFDFTNLQIPDFGFLAEEQQDLDFDCFLADDQFDDFGLLDDIQGFEDNGPSALPDFDFADVEDLQLADSSFGFLDQLAPINISCPLKSFAAS

SEQ ID NO: 651 - DNA, 891 bp, Arabidopsis thaliana
  G872,family:AP2
ccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcgaactgtgagattttccttggagtcatggagaaatctggagattttttgtaacacggagctccaatgacccgggaatttctttcgtttcggatccgaatttgatgtggatcatattcacacctatattttttcatttttttgttgtaaagaaaaatcggataagattctagtaataaatgttaaaagtccatttcattaaaaaaaaaaaaaaaaaaa

SEQ ID NO: 652 - protein, 195 aa, Arabidopsis thaliana
  G872,AP2 domain coordinates 18-84
MVKQAMKEEEKKRNTAMQSKYKGVRKRKWGKWVSEIRLPHSRERIWLGSYDTPEKAARAFDAAQFCLRGGDANFNFPNNPPSISVEKSLTPPEIQEAAARFANTFQDIVKGEEESGLVPGSEIRPESPSTSASVATSTVDYDFSFLDLLPMNFGFDSFSDDFSGFSGGDRFTEILPIEDYGGESLLDESLILWDF

SEQ ID NO: 653 - DNA, 2603 bp, Arabidopsis thaliana
  G877,family:WRKY
caaagattagactaatccgactgtgtttttaatcaatcatcattttatttaggggagagaagttgtaaagttttgatttttttttctgggttttttctgtgagacccagaagaagaacagagagaggaagaaggagaagaaaaaaatatctctttctctccggctttcaacaaaatctctcttttttccttcatcagtgttaaattcggatccgggtcgggtgggttttcggtttttggtgttcggatcagagcacagttggatgttagcgacggaactgaggatttcagtttgcggctgcggcggctgtgacggtgtttgtgtgtcgtcttcttttatcaatcaggagtttcatcacagtttgatcagagattcagccaaattcttggatactaaatggctggttttgatgaaaatgttgctgtgatgggagaatgggtgcctcgtagtcctagtcccgggacacttttctcctctgctattggagaagagaagagctcgaaacgtgttcttgaaagagagttatctttgaatcatggtcaagttattggtttagaagaagacactagtagtaatcataacaaggattcttcacaaagcaatgtttttcgaggtggtctcagtgaaagaattgctgcaagagctggatttaatgctccaaggttgaacactgagaatatccgcaccaacaccgacttttccattgactctaaccttcgatctccttgcttaaccatctcttctcctggccttagccctgcaacactcttggaatctcctgttttcctttctaacccattggctcaaccttctccaactaccgggaaatttccatttcttcctggtgttaatggtaatgcattgtcttctgagaaagcgaaagacgagttctttgatgatattggagcatcattcagcttccatcctgtttcaagatcatcttcctctttcttccaaggcacaacagagatgatgtcagttgattatggtaactacaacaatagatcttcttctcatcaatccgcagaagaagtaaaacctggctctgaaaacatagaaagctccaatctttatgggattgaaactgacaatcaaaacgggcagaacaagacatctgatgtcactacaaacaccagtcttgaaaccgtggatcatcaagaggaagaagaagagcaaagacgcggtgattcgatggctggtggtgcgcctgcagaggatggatataactggaggaaatacggacaaaagttggtcaaaggaagtgagtatccgcgaagctattacaagtgcacaaacccgaattgtcaggtgaagaagaaagttgagagatcaagggaaggtcacatcacagagattatatacaaaggagctcataatcatcttaaacctccacctaatcgccgctcagggatgcaagtagatggaactgaacaagttgaacaacaacaacaacagagagattctgctgcaacgtgggttagttgtaataacactcaacaacaaggtggaagcaatgagaacaatgtcgaagagggatctacgagattcgagtatggaaaccaatctggatcaattcaagctcaaaccggaggtcaatacgagtcaggtgatcctgtggttgtggttgatgcttcttcaacattctctaatgatgaagatgaagatgatcgagggacacatggaagtgtttctttgggttacgatggaggaggaggaggtgggggaggagaaggagatgaatcagagtcgaaaagaaggaaactagaagcttttgcagcagagatgagtggatcaacaagagccatacgtgagccaagagttgttgtgcagacaacgagtgatgttgacattcttgatgatggttatcgctggcgaaaatatggtcagaaagttgtcaaaggcaatccaaatccaaggagttattacaaatgcacagctccaggatgtacagtgaggaaacatgttgaaagagcttctcatgatctcaaatccgttataacaacttacgaaggcaaacataaccatgacgtccccgctgcacgcaacagcagccacggaggcggtggtgatagtggtaacggtaacagcggcggttcagccgcagtttctcaccattaccacaacggtcatcactcagagccgccacgtgggagattcgacagacaagtcacaactaacaatcagtctccttttagccgtccctttagctttcagccacatttgggtcctccttctggtttctccttcggtttaggacaaaccggtttggttaatctttcaatgcctggtttagcgtatggtcaagggaaaatgccgggtttgcctcacccgtatatgacacaaccggttgggatgagtgaagcaatgatgcagagagggatggaaccaaaggttgaaccggtttcagattcaggacaatcggtatataaccagatcatgagtagattacctcagatttgaaatttactcttcttcttcttcttctgcatttggtcactccttataataacttttaatttctgcttcttcttcttctttcatttattggtttcaaactttggggaaggtaaaggctgttttattgttaaaaaaaaaaaaaaaaa

SEQ ID NO: 654 - protein, 687 aa, Arabidopsis thaliana
  G877,WRKY domain coordinates 272-328,487-603
MAGFDENVAVMGEWVPRSPSPGTLFSSAIGEEKSSKRVLERELSLNHGQVIGLEEDTSSNHNKDSSQSNVFRGGLSERIAARAGFNAPRLNTENIRTNTDFSIDSNLRSPCLTISSPGLSPATLLESPVFLSNPLAQPSPTTGKFPFLPGVNGNALSSEKAKDEFFDDIGASFSFHPVSRSSSSFFQGTTEMMSVDYGNYNNRSSSHQSAEEVKPGSENIESSNLYGIETDNQNGQNKTSDVTTNTSLETVDHQEEEEEQRRGDSMAGGAPAEDGYNWRKYGQKLVKGSEYPRSYYKCTNPNCQVKKKVERSREGHITEIIYKGAHNHLKPPPNRRSGMQVDGTEQVEQQQQQRDSAATWVSCNNTQQQGGSNENNVEEGSTRFEYGNQSGSIQAQTGGQYESGDPVVVVDASSTFSNDEDEDDRGTHGSVSLGYDGGGGGGGGEGDESESKRRKLEAFAAEMSGSTRAIREPRVVVQTTSDVDILDDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPFSFQPHLGPPSGFSFGLGQTGLVNLSMPGLAYGQGKMPGLPHPYMTQPVGMSEAMMQRGMEPKVEPVSDSGQSVYNQIMSRLPQI

SEQ ID NO: 655 - DNA, 2044 bp, Arabidopsis thaliana
  G878,family:WRKY
caaaaaaaatctctcccattaaaagactgcccaaagaaatattttatacaaaatgaaagagagaaacacgacacgaattttgtataattaagattacacaaaaaaaagtgttagaaagagaaatatcttcttcttttttctgtgtgagttgggtttgttaaagttttatcctttttgttctcaaaatcaagaatcgatggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcacttgacagagaagaagaatacgacggcgcttgagcttttgtgagtttaatgaatcttctttttggttaatgaacctgtttttgttgcctcaaaacaccacaggtttctctggacagaatctctgatattacagtttcaaaaggtatgttcttttatttcatgttggaatcttctgtgtaatcttaagaagctttaggaggtaatgtaaaaaaccagattcaaagttatgcccttatgtgaattcttttgtacatgggataaacaaaatttacaggtatcctttttgttcttgttgtaaaaaaaaaaaaaaa

SEQ ID NO: 656 - protein, 513 aa, Arabidopsis thaliana
  G878,WRKY domain coordinates 250-305,415-475
MAEKEEKEPSKLKSSTGVSRPTISLPPRPFGEMFFSGGVGFSPGPMTLVSNLFSDPDEFKSFSQLLAGAMASPAAAAVAAAAVVATAHHQTPVSSVGDGGGSGGDVDPRFKQSRPTGLMITQPPGMFTVPPGLSPATLLDSPSFFGLFSPLQGTFGMTHQQALAQVTAQAVQGNNVHMQQSQQSEYPSSTQQQQQQQQQASLTEIPSFSSAPRSQIRASVQETSQGQRETSEISVFEHRSQPQNADKPADDGYNWRKYGQKQVKGSDFPRSYYKCTHPACPVKKKVERSLDGQVTEIIYKGQHNHELPQKRGNNNGSCKSSDIANQFQTSNSSLNKSKRDQETSQVTTTEQMSEASDSEEVGNAETSVGERHEDEPDPKRRNTEVRVSEPVASSHRTVTEPRIIVQTTSEVDLLDDGYRWRKYGQKVVKGNPYPRSYYKCTTPDCGVRKHVERAATDPKAVVTTYEGKHNHDVPAARTSSHQLRPNNQHNTSTVNFNHQQPVARLRLKEEQIT

SEQ ID NO: 657 - DNA, 1152 bp, Arabidopsis thaliana
  G881,family:WRKY
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaaaaaaaaaaaaaaaaaa

SEQ ID NO: 658 - protein, 310 aa, Arabidopsis thaliana
  G881,WRKY domain coordinates 176-233
MDGSSFLDISLDLNTNPFSAKLPKKEVSVLASTHLKRKWLEQDESASELREELNRVNSENKKLTEMLARVCESYNELHNHLEKLQSRQSPEIEQTDIPIKKRKQDPDEFLGFPIGLSSGKTENSSSNEDHHHHHQQHEQKNQLLSCKRPVTDSFNKAKVSTVYVPTETSDTSLTVKDGFQWRKYGQKVTRDNPSPRAYFRCSFAPSCPVKKKVQRSAEDPSLLVATYEGTHNHLGPNASEGDATSQGGSSTVTLDLVNGCHRLALEKNERDNTMQEVLIQQMASSLTKDSKFTAALAAAISGRLMEQSRT

SEQ ID NO: 659 - DNA, 1195 bp, Arabidopsis thaliana
  G883,family:WRKY
ctctctcgtcttcgtcttcttcttcttcaacgttcctctccaaaatcctcagaccaagaaatcatcatggccgtcgatctaatgcgtttccctaagatagatgatcaaacggctattcaggaagctgcatcgcaaggtttacaaagtatggaacatctgatccgtgtcctctctaaccgtcccgaacaacaacacaacgttgactgctccgagatcactgacttcaccgtttctaaattcaaaaccgtcatttctctccttaaccgtactggtcacgctcggttcagacgcggaccggttcactccacttcctctgccgcatctcagaaactacagagtcagatcgttaaaaatactcaacctgaggctccgatagtgagaacaactacgaatcaccctcaaatcgttcctccaccgtctagtgtaacactcgatttctctaaaccaagcatcttcggcaccaaagctaagagcgccgagctggaattctccaaagaaaacttcagtgtttctttaaactcctcattcatgtcgtcggcgataaccggagacggcagcgtctccaatggaaaaatcttccttgcttctgctccgtcgcagcctgttaactcttccggaaaaccaccgttggctggtcatccttacagaaagagatgtctcgagcatgagcactcagagagtttctccggaaaagtctccggctccgcctacggaaagtgccattgcaagaaaaggaaaaatcggatgaagagaaccgtgagagtaccggcgataagtgcaaagatcgccgatattccaccggacgaatattcgtggaggaagtacggacaaaaaccgatcaagggctcaccacacccacgtggttactacaagtgcagtacattcagaggatgtccagcgaggaaacacgtggaacgagcattagatgatccagcgatgcttattgtgacatacgaaggagagcaccgtcataaccaatccgcgatgcaggagaatatttcttcttcaggcattaatgatttagtgtttgcctcggcttgacttttttttgtactatttgttttttgattttttgagtactttagatggattgaaatttgtaaatttttttattaagaaatcaatttaaatagagaaaaattagtggtggtgcaaaaaaaaaaaaaaaaaaaaaaaaaaaaaaaaaaaaaaaaaa

SEQ ID NO: 660 - protein, 324 aa, Arabidopsis thaliana
  G883,WRKY domain coordinates 245-302
MAVDLMRFPKIDDQTAIQEAASQGLQSMEHLIRVLSNRPEQQHNVDCSEITDFTVSKFKTVISLLNRTGHARFRRGPVHSTSSAASQKLQSQIVKNTQPEAPIVRTTTNHPQIVPPPSSVTLDFSKPSIFGTKAKSAELEFSKENFSVSLNSSFMSSAITGDGSVSNGKIFLASAPSQPVNSSGKPPLAGHPYRKRCLEHEHSESFSGKVSGSAYGKCHCKKRKNRMKRTVRVPAISAKIADIPPDEYSWRKYGQKPIKGSPHPRGYYKCSTFRGCPARKHVERALDDPAMLIVTYEGEHRHNQSAMQENISSSGINDLVFASA

SEQ ID NO: 661 - DNA, 1879 bp, Arabidopsis thaliana
  G884,family:WRKY
tttttttttgtttgttaattttggggatcgatgtcggaaaaggaagaagctccgtcgacatcgaagtccaccggagctccgtcgcgtccgactttatctcttcctccacggccgtttagtgagatgttctttaacggtggcgttggattcagtcctggtccgatgactctggtctctaatatgttccctgattccgatgagtttaggtctttctctcagcttctcgctggagccatgtcttctccagcgactgcagctgctgctgctgctgctgcgacggctagtgattaccagagacttggtgaagggactaatagctctagtggtgatgttgacccgagattcaagcaaaacagaccaaccggtttgatgatttctcaatctcaatcgccgtcgatgttcaccgtaccgcctggtttaagtccagctatgttgctcgattcaccaagctttttgggtcttttctctcccgttcagggatcatatggaatgacacatcagcaagctctagctcaagtcactgctcaagcagttcaagccaatgccaatatgcaaccacaaacagagtaccctcctccctctcaagttcaatcattttcatcgggtcaagcgcagatcccgacctcggctccactaccagctcaaagagaaacctcagatgtaaccatcatagagcacaggtcacaacagcctctaaatgttgacaaaccagctgatgatggctataactggcgaaaatatgggcaaaagcaagttaaaggtagcgagtttccacgaagctattacaagtgtactaatccaggatgtcctgtcaagaagaaggttgagagatctcttgatggacaagtaacggagattatctacaaaggtcagcacaatcatgaacctcctcaaaacactaagcgaggtaacaaagataacaccgcgaatataaatgggagttcgataaataacaatcgcgggagttctgaattgggggcatcacagtttcaaactaatagctccaacaagactaagagagagcaacatgaagcagtaagtcaagctacgacaacagagcacttgtctgaggcaagtgacggtgaagaagttggtaatggagaaactgatgtgagagagaaagatgagaatgagcctgatcccaagagaagaagtacagaagttcggatttcagaaccagctcctgctgcttcacatagaactgtgacagagcctagaattattgtccaaacgacgagtgaagttgatcttctagatgatggatataggtggcgtaaatatggacagaaagttgtcaaagggaatccttatccgaggagctactacaagtgcacaacaccaggatgtggtgtgaggaaacatgtagagagagcagcaacagatccaaaagctgtagtaacaacatatgaaggaaaacataaccatgaccttcccgctgctaaatcaagcagccatgccgctgcagcggcacagttaaggccagataatcgacctggcggtttggctaacttaaatcaacagcagcagcaacagcccgttgcgcggctaaggcttaaagaagagcaaacaacttgagagaagaaaactcttgaccgtttttcattacaaaagctttcaaattccactcacacacttgtctgaaaaatctagcagtttgcaggaaagaaacagcttcaagaggttgtagttcttctatgttctggtgtaaaacttaaaagctttttagggttttcagatttctgtttactaatactgtatgtgaattcttttgtacatgaggaagaaaattacagggggatattttgtgttgtatcttttgtgttattgtttcagtaaaagataggtcttacattttgtgtaaaaaaaaaaaaaaaaaaaa

SEQ ID NO: 662 - protein, 514 aa, Arabidopsis thaliana
  G884,WRKY domain coordinates 227-285,407-465
MSEKEEAPSTSKSTGAPSRPTLSLPPRPFSEMFFNGGVGFSPGPMTLVSNMFPDSDEFRSFSQLLAGAMSSPATAAAAAAAATASDYQRLGEGTNSSSGDVDPRFKQNRPTGLMISQSQSPSMFTVPPGLSPAMLLDSPSFLGLFSPVQGSYGMTHQQALAQVTAQAVQANANMQPQTEYPPPSQVQSFSSGQAQIPTSAPLPAQRETSDVTIIEHRSQQPLNVDKPADDGYNWRKYGQKQVKGSEFPRSYYKCTNPGCPVKKKVERSLDGQVTEIIYKGQHNHEPPQNTKRGNKDNTANINGSSINNNRGSSELGASQFQTNSSNKTKREQHEAVSQATTTEHLSEASDGEEVGNGETDVREKDENEPDPKRRSTEVRISEPAPAASHRTVTEPRIIVQTTSEVDLLDDGYRWRKYGQKVVKGNPYPRSYYKCTTPGCGVRKHVERAATDPKAVVTTYEGKHNHDLPAAKSSSHAAAAAQLRPDNRPGGLANLNQQQQQQPVARLRLKEEQTT

SEQ ID NO: 663 - DNA, 1137 bp, Arabidopsis thaliana
  G892,family:RING/C3H2C3
tataacaattccttccaacaatgtcattgagtcagccaataacacggaccgatagtgcacccaatggagcatttaggacttttggtctctactggtgctaccattgtgatcgtatggtcagaattgcatcctctaacccatcagagatcgcctgtcctcgatgtttgaggcaatttgtcgttgagattgaaacgagacaacggcctcggtttactttcaaccatgctactccgccttttgatgcttctcctgaggctcgtcttctcgaagctctctcgctcatgtttgagcctgcaaccataggtaggtttggtgcagacccatttcttagggcaagatccagaaacatcttggaacctgaatcaagaccccgaccgcaacatcgaagacgacacagccttgacaatgttaacaatggtggtttacctctaccaagaagaacatatgttattctccggcccaataatccgactagtccactcggaaacataattgcgccaccaaatcaagcaccaccacggcatgtgaactcacatgattactttactggagcatcaagcttagagcagctgattgaacaactaacacaagacgataggcctggaccaccacctgcgtcagaacccaccattaattccctaccatctgtgaaaataacaccacaacatctaactaacgacatgtcccaatgcacagtgtgcatggaagaattcattgttggtggggacgcaacggaattaccatgtaaacatatttaccataaagattgtatagtcccgtggcttaggcttaacaattcttgccctatctgccgccgtgacctgccacttgtcaacaccgttgctgaatctcgagaaaggagcaatcctattagacaagacatgcctgaaagaaggcgtccaaggtggatgcaactcggtaacatttggccatttagagcaagataccaaagggttagtccagaagaaacagcaaaccagaatcctcgagataacaggagctaactctgaatattccatgggaaataaaaatcgtgactatctatatgtatagactctatgagacattgtctatttgaatgtgcatgtatatctcagaaataaactcaagcgaaacatatttaacgactaaaaaaaa

SEQ ID NO: 664 - protein, 327 aa, Arabidopsis thaliana
  G892,RING/C3H2C3 domain coordinates 177-270
MSLSQPITRTDSAPNGAFRTFGLYWCYHCDRMVRIASSNPSEIACPRCLRQFVVEIETRQRPRFTFNHATPPFDASPEARLLEALSLMFEPATIGRFGADPFLRARSRNILEPESRPRPQHRRRHSLDNVNNGGLPLPRRTYVILRPNNPTSPLGNIIAPPNQAPPRHVNSHDYFTGASSLEQLIEQLTQDDRPGPPPASEPTINSLPSVKITPQHLTNDMSQCTVCMEEFIVGGDATELPCKHIYHKDCIVPWLRLNNSCPICRRDLPLVNTVAESRERSNPIRQDMPERRRPRWMQLGNIWPFRARYQRVSPEETANQNPRDNRS

SEQ ID NO: 665 - DNA, 1276 bp, Arabidopsis thaliana
  G896,family:Z-LSDlike
taatccgattcgtcttcatctgattccctcccttccgagaataataatgtacccgccacctccctcaagcatctacgctcctccgatgctggtgaattgctccggttgccggacgcctctccagctcccatccggcgcccgatctattcgctgcgctctctgccaggctgttactcatatcgccgaccctcgcaccgcccctcctccgcaaccttcctccgccccttctccgcctccccaaatccacgcgcctcccggtcagctgcctcacccccatggcaggaagagggccgtgatctgtggcatctcgtatcgtttctctcgccacgagctcaaaggctgcatcaacgacgccaagtgcatgcgtcaccttctcatcaacaaattcaaattctccccagattcaattctcatgcttaccgaggaagaaactgatccatatcgtatcccgaccaagcaaaacatgaggatggcattgtattggctcgtacagggatgcacagcaggcgactcacttgtcttccactactctggtcatggttcgcgtcaaagaaactacaacggtgatgaagttgatggctatgatgaaacactctgtcctctggattttgaaactcaggggatgattgtagacgatgagatcaacgcaaccattgtacgccctcttccacatggtgtcaagctccattcaattatcgatgcttgccatagtggtaccgttctggatttacccttcctatgcagaatgaacagagctgggcagtatgtgtgggaggatcatcggcctaggtcaggtttgtggaaaggaactgctggtggagaagccatttcaattagtggatgtgatgatgatcagacttcggccgacacatcagcgctgtcgaagatcacgtctacgggtgctatgactttctgttttattcaagcaattgaacgcagcgcacaaggcacaacctatggaagccttctgaattctatgcgcaccacaataaggaatacagggaatgatggtggtggtagtggtggagttgtgacgactgtgctgagcatgcttctgacagggggaagtgcgattgggggattaagacaggagcctcaactgactgcttgccaaacattcgatgtctatgcaaagcctttcactctctagtaaaggacaagtcactttttatgtatagcgagtgtgatttgagaatccgtccatataaccaccttttgtttcttatttttatttttctttcaaaagaataaaggaaaacattgatttggtgattcg

SEQ ID NO: 666 - protein, 367 aa, Arabidopsis thaliana
  G896,Z-LSDlike domain coordinates 18-39
MYPPPPSSIYAPPMLVNCSGCRTPLQLPSGARSIRCALCQAVTHIADPRTAPPPQPSSAPSPPPQIHAPPGQLPHPHGRKRAVICGISYRFSRHELKGCINDAKCMRHLLINKFKFSPDSILMLTEEETDPYRIPTKQNMRMALYWLVQGCTAGDSLVFHYSGHGSRQRNYNGDEVDGYDETLCPLDFETQGMIVDDEINATIVRPLPHGVKLHSIIDACHSGTVLDLPFLCRMNRAGQYVWEDHRPRSGLWKGTAGGEAISISGCDDDQTSADTSALSKITSTGAMTFCFIQAIERSAQGTTYGSLLNSMRTTIRNTGNDGGGSGGVVTTVLSMLLTGGSAIGGLRQEPQLTACQTFDVYAKPFTL

SEQ ID NO: 667 - DNA, 1083 bp, Arabidopsis thaliana
  G898,family:RING/C3HC4
gaaaaaaagattcaaaaaccctagatttcacaaaatcgattggctgtcaaatttctctccggcgattttcctcgagtgaaattcggctcaaggtgattatagcgatcatcgaatcaaattgattgaagaggtacaaaggttagttactttgagctgaaagatgaacacgtcagaggtgagagtacctcgaggaaatcgacggaggaaagctgtgattgatctgaatgcggtacctgttgatcaagaagggacctctgcttctgttagaactcttacggtgcctattacaccgtctcagcctgctcctacgatgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatgagtggtccggcaacatcaccagccaccctgtctaatggtttatcagactatcctcctattcactttggaacattgaagggacttcgttgacttggtatttttgaatattttgctttgttggaagagaaatattcagtgatcaagaagccagaaggccctatcattcgatggatatcattggtaataactctttgtttttagttgttgttctatgtaatttaggtctctgcaaacctctcagtcgatactcttctctcttgatagatgataagatatatggaaaaaaaaattaatattgaatctttactaaaa

SEQ ID NO: 668 - protein, 203 aa, Arabidopsis thaliana
  G898,RING/C3HC4 domain coordinates 148-185
MNTSEVRVPRGNRRRKAVIDLNAVPVDQEGTSASVRTLTVPITPSQPAPTMIDVDAIEDDVIESSASAFAEAKSKSRNARRRPLMVDVESGGTTRFPANISNKRRRIPSSESVIDCEHASVNDEVNMSSRVSRSKAPAPPPEEPKFTCPICMCPFTEEMSTKCGHIFCKGCIKMAISRQGKCPTCRKKVTAKELIRVFLPTTR

SEQ ID NO: 669 - DNA, 1673 bp, Arabidopsis thaliana
  G903,family:Z-C2H2
cccgggtcgacccacgcgtccgctctctctctctgaactatacaaaaacctacttttaatttctcttccaagaagtcaagaacccagaagaagacatgacaagtgaagttcttcaaacaatctcaagtggatcaggttttgctcagccacagagctcatcaaccctggatcatgatgaatctctcatcaatcctcctcttgttaagaaaaagagaaatctccctggaaatcctgatccggaagctgaagtgatagctttatcccccacgaccttgatggctacgaaccggttcctatgtgaggtatgtggcaaaggtttccaaagagaccaaaacttacagcttcatcggcgaggacataatcttccatggaagttgaagcagaggacaagcaaagaagtgagaaaacgtgtctacgtttgccccgagaagacatgtgtccaccatcactcctctagagctctaggcgatctcactggaatcaaaaagcatttttgccggaaacacggggagaagaagtggacgtgcgagaaatgtgctaagagatacgcagtccaatctgattggaaagctcattccaagacttgtggtactagagagtaccgttgcgattgtggcaccattttctcaaggcgagacagctttatcactcatagagctttctgcgatgccttagcggaagaaaccgctaagataaacgcagtgtctcatctcaacggtttagccgcggctggagccccaggatcagttaatctcaactatcaatatctcatgggaacattcatcccaccgcttcaaccatttgtaccacaaccgcaaacaaatccaaaccatcatcatcaacattttcagccaccaacttcttcgtcgctctctctatggatgggacaagatatcgcgccgcctcaaccgcaaccggactacgattgggtttttggaaacgctaaggcagcgtctgcttgcattgataataataatactcacgatgagcagattacgcaaaacgcaaacgcaagtttgaccactaccactactctctctgccccttctttattcagcagcgaccaaccacaaaacgcaaacgcaaattcaaacgtgaatatgtccgcgacagctttactacagaaagctgctgaaattggcgctacttctacaacaaccgcagcgaccaatgacccatcaacgtttcttcaaagtttcccgcttaaatccaccgatcaaaccaccagttatgacagtggcgaaaagttttttgctttgttcgggtctaacaacaacattgggttaatgagtcgtagtcatgatcatcaagagatcgagaacgctagaaatgacgttacggttgcgtctgccttggatgaattacagaattacccttggaaacgtagaagagttgatggtggaggtgaagtgggtggaggagggcaaactcgggatttcctcggggttggtgtacaaacgttgtgccatccatcgtctatcaatggatggatttgaaagagtttaaaaatttcggggttaatgcataaattacgtaaaagaagaaggaatcttttgtcatttccaccattttctaagataacatatgtatatggtaatggaagttgttttcttttattaattcaatattctaaaacttatgatatatgtataatgaatgtgtttatcttcaaa

SEQ ID NO: 670 - protein, 466 aa, Arabidopsis thaliana
  G903,Z-C2H2 domain coordinates 68-92
MTSEVLQTISSGSGFAQPQSSSTLDHDESLINPPLVKKKRNLPGNPDPEAEVIALSPTTLMATNRFLCEVCGKGFQRDQNLQLHRRGHNLPWKLKQRTSKEVRKRVYVCPEKTCVHHHSSRALGDLTGIKKHFCRKHGEKKWTCEKCAKRYAVQSDWKAHSKTCGTREYRCDCGTIFSRRDSFITHRAFCDALAEETAKINAVSHLNGLAAAGAPGSVNLNYQYLMGTFIPPLQPFVPQPQTNPNHHHQHFQPPTSSSLSLWMGQDIAPPQPQPDYDWVFGNAKAASACIDNNNTHDEQITQNANASLTTTTTLSAPSLFSSDQPQNANANSNVNMSATALLQKAAEIGATSTTTAATNDPSTFLQSFPLKSTDQTTSYDSGEKFFALFGSNNNIGLMSRSHDHQEIENARNDVTVASALDELQNYPWKRRRVDGGGEVGGGGQTRDFLGVGVQTLCHPSSINGWI

SEQ ID NO: 671 - DNA, 1005 bp, Arabidopsis thaliana
  G904,family:RING/C3H2C3
atggaatctctcatcaatcccagccatggcggaggaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaaccggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtga

SEQ ID NO: 672 - protein, 334 aa, Arabidopsis thaliana
  G904,RING/C3H2C3 domain coordinates 117-158
MESLINPSHGGGNYDSHSSSLDSLKPSVLVIILILLMTLLISVSICFLLRCLNRCSHRSVLPLSSSSSVATVTSDSRRFSGHRVSPETERSSVLDSLPIFKFSSVTRRSSSMNSGDCAVCLSKFEPEDQLRLLPLCCHAFHADCIDIWLVSNQTCPLCRSPLFASESDLMKSLAVVGSNNGGGENSFRLEIGSISRRRQTPIPESVEQHRTYSIGSFDYIVDDVDSEISESNFNRGKQEDATTTTATATAVTTNPTSFEASLAADIGNDGSRSWLKDYVDRLSRGISSRAMSFRSSGRFFTGSSRRSEELTVMDLEANHAGEEISELFRWLSGV

SEQ ID NO: 673 - DNA, 1197 bp, Arabidopsis thaliana
  G905,family:RING/C3H2C3
tacttccaccatcaaatcgtcaaaccatttgcaaccatcgatggtggtcatgtcacgagtaagcttctactcttctttcttgctactactgttagaggtcgttgtcgctagcagcgagtttgatgatgaaggaagaacatcgttcagtccaaccacggctataatcatgatcgtactcgttagtgttttcttcgcacttggatgtatctccgtctacatgaggaggtgtctccagcacgctctggggatggacagcggtggtggtccaggaaactggcttaacgtgaggcaaacgacggagcctgggctagacgcgtctgttatagaaacgtttccaacgtttccttactctacagtgaagacgttgaggatcggtaaagaagctttggagtgtcccgtttgtctcaacgagttcgaggacgacgaaacgctgcgtttgattcctcagtgttgtcacgtgtttcatcctggttgcattgatgcctggctccgttctcagaccacatgtcctctttgccgagccaatctcgttcctgtaccgggtgagtctgtttcttcggagatacccggtttagctagagaaaccggtcagaactctctcagaacgccgattgatgataaccggaaaagggttttaacttcacctgacgagcggttgattgactcagtggcttggacgggtaaccaaagcatgccacgtaaatccatgtctacaggttggaaactagctgaattgtacagcccggctagttcaccgggccaaccggaggagaatctcgaccggtatacgctgaggttaccacaagagatacatgaccagcttgtgaactccagcctgggaaagcaagggtcaaaaggccaactggccttacctcaagaaaggagctcggttagagggttcagaaccggaagcctagggactgaaaagaactatttctactttgaacggtttgatcaagacggtcggttggaccggagaccattttctataactcctccataccatacccggtcgatacagtctccggatgagattatcaacgctagtggtaattatcaggatcgtgctggtgcacctaaaggtttgcttctagcaataaggtcaccgtttgatcggttatttactgggaagaaaaatgccggtgagcgttcgtaccttcaatccggcgatgcgagccctgtctaggcgaattacta

SEQ ID NO: 674 - protein, 381 aa, Arabidopsis thaliana
  G905,RING/C3H2C3 domain coordinates 118-159
MVVMSRVSFYSSFLLLLLEVVVASSEFDDEGRTSFSPTTAIIMIVLVSVFFALGCISVYMRRCLQHALGMDSGGGPGNWLNVRQTTEPGLDASVIETFPTFPYSTVKTLRIGKEALECPVCLNEFEDDETLRLIPQCCHVFHPGCIDAWLRSQTTCPLCRANLVPVPGESVSSEIPGLARETGQNSLRTPIDDNRKRVLTSPDERLIDSVAWTGNQSMPRKSMSTGWKLAELYSPASSPGQPEENLDRYTLRLPQEIHDQLVNSSLGKQGSKGQLALPQERSSVRGFRTGSLGTEKNYFYFERFDQDGRLDRRPFSITPPYHTRSIQSPDEIINASGNYQDRAGAPKGLLLAIRSPFDRLFTGKKNAGERSYLQSGDASPV

SEQ ID NO: 675 - DNA, 1071 bp, Arabidopsis thaliana
  G910,family:Z-CO-like
atgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattctggtaagaatcagccttgtgttgtccgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtggaggagaaaaaagcttaa

SEQ ID NO: 676 - protein, 356 aa, Arabidopsis thaliana
  G910,Z-CO-like domain coordinates 14-37,77-103
MLCIIIIENMERVCEFCKAYRAVVYCIADTANLCLTCDAKVHSANSLSGRHLRTVLCDSGKNQPCVVRCFDHKMFLCHGCNDKFHGGGSSEHRRRDLRCYTGCPPAKDFAVMWGFRVMDDDDDVSLEQSFRMVKPKVQREGGFILEQILELEKVQLREENGSSSLTERGDPSPLELPKKPEEQLIDLPQTGKELVVDFSHLSSSSTLGDSFWECKSPYNKNNQLWHQNIQDIGVCEDTICSDDDFQIPDIDLTFRNFEEQFGADPEPIADSNNVFFVSSLDKSHEMKTFSSSFNNPIFAPKPASSTISFSSSETDNPYSHSEEVISFCPSLSNNTRQKVITRLKEKKRARVEEKKA

SEQ ID NO: 677 - DNA, 480 bp, Arabidopsis thaliana
  G911,family:RING/C3H2C3
atgggtcttcctgaagatttcatcaccgagcttcagattccaggttacatattaaagatactttacgtcatcggtttctttagagacatggtcgatgctctttgtccttacattggtctacctagttttctagaccacaacgagacctctggacccgatccgacccgacacgctctctctacgtcagcgagtcttgctaacgagttgatcccggtggttcggttctcggatcttccgaccgatccggaagattgttgtacggtttgtttgtcagattttgagtccgacgataaggttaggcagctacccaagtgtggacacgtgtttcatcatcattgtttagaccgttggatcgttgactacaacaagatgaaatgtccggtttgtcggcaccggttcttaccgaaagaaaagtacacgcaatgtgattggggttctggttcagattggtttagtgatgaagtggaaagtaccaactaa

SEQ ID NO: 678 - protein, 159 aa, Arabidopsis thaliana
  G911,RING/C3H2C3 domain coordinates 86-129
MGLPEDFITELQIPGYILKILYVIGFFRDMVDALCPYIGLPSFLDHNETSGPDPTRHALSTSASLANELIPVVRFSDLPTDPEDCCTVCLSDFESDDKVRQLPKCGHVFHHHCLDRWIVDYNKMKCPVCRHRFLPKEKYTQCDWGSGSDWFSDEVESTN

SEQ ID NO: 679 - DNA, 724 bp, Arabidopsis thaliana
  G912,family:AP2
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctgattctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 680 - protein, 224 aa, Arabidopsis thaliana
  G912,AP2 domain coordinates 51-118
MNPFYSTFPDSFLSISDHRSPVSDSSECSPKLASSCPKKRAGRKKFRETRHPIYRGVRQRNSGKWVCEVREPNKKSRIWLGTFPTVEMAARAHDVAALALRGRSACLNFADSAWRLRIPETTCPKEIQKAASEAAMAFQNETTTEGSKTAAEAEEAAGEGVREGERRAEEQNGGVFYMDDEALLGMPNFFENMAEGMLLPPPEVGWNHNDFDGVGDVSLWSFDE

SEQ ID NO: 681 - DNA, 890 bp, Arabidopsis thaliana
  G913,family:AP2
cattcaaaaacatcatatatatacacaaacacactttgatacaacaaaaaaaaacagaacacaaacaaaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattgttttccggtcgaatgagattttccccctttttttttttctttttgggtcgctgtt

SEQ ID NO: 682 - protein, 232 aa, Arabidopsis thaliana
  G913,AP2 domain coordinates 62-128
MSNNNNSPTTVNQETTTSREVSITLPTDQSPQTSPGSSSSPSPRPSGGSPARRTATGLSGKHSIFRGIRLRNGKWVSEIREPRKTTRIWLGTYPVPEMAAAAYDVAALALKGPDAVLNFPGLALTYVAPVSNSAADIRAAASRAAEMKQPDQGGDEKVLEPVQPGKEEELEEVSCNSCSLEFMDEEAMLNMPTLLTEMAEGMLMSPPRMMIHPTMEDDSPENHEGDNLWSYK

SEQ ID NO: 683 - DNA, 1797 bp, Arabidopsis thaliana
  G916,family:WRKY
aaaaaaaaaaacaatctaagatatctatcaagatcttaagatatctacatttatagagatgtttcgttttccggtaagtcttggaggaggtccacgtgagaatctgaagccatcagatgagcagcatcaacgtgcggtggtgaatgaggttgactttttccgatcagcggagaagagagatagggtttcacgtgaagaacaaaacattatcgccgatgagactcatagggttcatgtcaaaagggagaattcacgtgttgatgatcatgacgatcgttctactgatcacatcaatattggacttaatcttctcactgcgaatacgggaagcgacgagtcaatggtggatgatggattgtctgtggatatggaagagaaacgtacaaagtgtgagaatgcacaacttcgcgaagagctaaagaaggcgagtgaagataatcaaagactaaagcaaatgctaagtcaaacaaccaacaacttcaattccttgcagatgcaacttgttgctgtcatgaggcaacaagaagatcatcatcacctagctacgaccgagaacaatgacaatgtaaagaaccgacatgaagtgcctgaaatggttccaagacagttcatcgatttgggaccgcattctgacgaagtgtcgtccgaggagaggacgacggttcggtcgggatctcctccctcgcttctagagaaatctagctcacgtcaaaacggaaagagagtgcttgtaagagaagaaagcccggaaaccgaatccaacggctggagaaaccctaacaaagttcctaaacaccatgcatcatccagcatttgcggtggcaatggcagtgaaaatgcaagtagcaaggtcattgagcaagcggccgccgaagccaccatgcgtaaagcccgtgtctcggttcgtgctcgatccgaagctcccatgttaagcgatggatgtcaatggagaaaatacggacaaaaaatggcgaaaggaaacccgtgccctcgagcttattaccgttgcacaatggctgttggatgtcctgttcgcaagcaagtgcaacgttgcgcggaagatagaaccattctcataacaacctacgaaggaaaccataaccatccattacctcctgcggctatgaacatggcttcaactacaacagcagccgcaagcatgcttctctcaggctccaccatgtcgaaccaagacggtttaatgaacccaacaaatctcttggctcgaaccatattaccgtgttcctcaagcatggctactatctcagcctctgcaccattcccaaccattacattagacctcacagagtcacccaacgggaacaatccaaccaataacccgctgatgcaattctctcaacggtctggtttggtggagttgaaccaatcggttttgcctcatatgatgggtcaggctttgtactacaaccaacagtctaagttttcgggtttacatatgccgtctcagccgctaaacgctggtgagagtgttagcgccgctactgccgcaatcgcctccaatcccaactttgccgcggctctagctgcagccataacttcgattatcaacggttcgaacaatcagcagaatgggaacaacaataacagtaatgttacaacgagcaacgttgacaataggcaataacatttttttataagttttagttagggactttttatcggtcgattttgttttgtttttcttttattacattattttttagttacggcttttttttgttttttcttttctttcccaaacaacaagtattgagagcaattcccccccccccccct

SEQ ID NO: 684 - protein, 528 aa, Arabidopsis thaliana
  G916,WRKY domain coordinates 293-349
MFRFPVSLGGGPRENLKPSDEQHQRAVVNEVDFFRSAEKRDRVSREEQNIIADETHRVHVKRENSRVDDHDDRSTDHINIGLNLLTANTGSDESMVDDGLSVDMEEKRTKCENAQLREELKKASEDNQRLKQMLSQTTNNFNSLQMQLVAVMRQQEDHHHLATTENNDNVKNRHEVPEMVPRQFIDLGPHSDEVSSEERTTVRSGSPPSLLEKSSSRQNGKRVLVREESPETESNGWRNPNKVPKHHASSSICGGNGSENASSKVIEQAAAEATMRKARVSVRARSEAPMLSDGCQWRKYGQKMAKGNPCPRAYYRCTMAVGCPVRKQVQRCAEDRTILITTYEGNHNHPLPPAAMNMASTTTAAASMLLSGSTMSNQDGLMNPTNLLARTILPCSSSMATISASAPFPTITLDLTESPNGNNPTNNPLMQFSQRSGLVELNQSVLPHMMGQALYYNQQSKFSGLHMPSQPLNAGESVSAATAAIASNPNFAAALAAAITSIINGSNNQQNGNNNNSNVTTSNVDNRQ

SEQ ID NO: 685 - DNA, 642 bp, Arabidopsis thaliana
  G917,family:MADS
atgaggaaaggtaagagagtgataaaaaagatagaggagaaaataaagagacaagtgacattcgcaaagagaaagaagagtctaatcaagaaggcatatgaactctctgttctctgcgatgtccaccttggtctcatcatcttctctcactccaacaggctctacgatttctgctccaactctaccagcatggagaatctcatcatgagataccaaaaggaaaaagaaggtcaaaccactgcagaacacagtttccactcgtgttcagattgcgtgaagacgaaggaatcaatgatgagagagatagagaatcttaagctgaatcttcaattgtacgacggacatggcttgaatctcttgacctacgacgagctcctttcttttgagctccatctcgaatcttctctacaacatgctcgagctcgcaagtctgagttcatgcatcagcagcagcagcaacaaacagatcaaaagcttaagggaaaagaaaagggtcaaggaagctcttgggagcagctgatgtggcaagcagagagacagatgatgacgtgtcaaagacaaaaagatcctgcgccggcgaatgaaggaggagttccttttttacggtggggaacaacccaccgacgttcttcacctccttaa

SEQ ID NO: 686 - protein, 213 aa, Arabidopsis thaliana
  G917,MADS domain coordinates 2-57
MRKGKRVIKKIEEKIKRQVTFAKRKKSLIKKAYELSVLCDVHLGLIIFSHSNRLYDFCSNSTSMENLIMRYQKEKEGQTTAEHSFHSCSDCVKTKESMMREIENLKLNLQLYDGHGLNLLTYDELLSFELHLESSLQHARARKSEFMHQQQQQQTDQKLKGKEKGQGSSWEQLMWQAERQMMTCQRQKDPAPANEGGVPFLRWGTTHRRSSPP

SEQ ID NO: 687 - DNA, 1130 bp, Arabidopsis thaliana
  misc_feature (1100)..(1100): n is a, c, g, or t
  G921,family:WRKY
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatttgaatttgtcatgagtaagagaaagagagtagattataatccnttgtgatactgaaaaaaaaaaaaaaaaaaa

SEQ ID NO: 688 - protein, 302 aa, Arabidopsis thaliana
  G921,WRKY domain coordinates 146-203
MDQYSSSLVDTSLDLTIGVTRMRVEEDPPTSALVEELNRVSAENKKLSEMLTLMCDNYNVLRKQLMEYVNKSNITERDQISPPKKRKSPAREDAFSCAVIGGVSESSSTDQDEYLCKKQREETVVKEKVSRVYYKTEASDTTLVVKDGYQWRKYGQKVTRDNPSPRAYFKCACAPSCSVKKKVQRSVEDQSVLVATYEGEHNHPMPSQIDSNNGLNRHISHGGSASTPVAANRRSSLTVPVTTVDMIESKKVTSPTSRIDFPQVQKLLVEQMASSLTKDPNFTAALAAAVTGKLYQQNHTEK

SEQ ID NO: 689 - DNA, 1449 bp, Arabidopsis thaliana
  G922,family:SCR
atggtggctatgtttcaagaagataatggaacatcttctgtagcttcatcaccacttcaagtcttctcaactatgtcactcaacagaccgactctcctcgcttcttcatctccgtttcattgtctcaaagatctcaaaccagaggagcgtggtctctacttaatccacctcttgctaacttgtgccaaccacgtggcttcaggtagcctccaaaacgctaacgcagcgctcgagcagctctctcacctcgcttctcctgacggcgacacgatgcagcgaatcgctgcttacttcaccgaagcgcttgctaacagaatccttaagtcctggcctggtctttacaaggctcttaacgcaactcagacaagaactaacaatgtctctgaggagattcatgttagaagactcttctttgagatgttcccgatactcaaagtctcttacttgctcactaatcgagctatactcgaggctatggaaggagagaagatggttcatgtgattgatctcgatgcttctgagccagctcaatggcttgctttgcttcaagcttttaactctaggcctgaaggtccacctcatttgagaatcactggtgttcatcaccagaaggaagtgcttgaacaaatggctcatagactcattgaggaagcagagaaactcgatatcccgtttcagtttaatcccgttgtgagtaggttagactgtttaaatgtagaacagttgcgggttaaaacaggagaggccttagccgttagctcggttcttcaattgcataccttcttggcctctgatgatgatctcatgagaaagaactgcgctttacggtttcagaacaaccctagtggagttgacttgcagagagttctaatgatgagccatggctctgcagctgaggcacgtgagaatgatatgagtaacaacaatgggtatagccctagcggtgactcggcctcatctttgcctttaccaagttcaggaaggactgatagcttcctcaatgctatttggggtttgtctccaaaggtcatggtggtcactgagcaagactcagaccacaacggctccacactaatggagaggctattagaatcactttacacctacgcagcattgtttgattgcttggaaacaaaagttccaagaacgtctcaagataggatcaaagtggagaagatgctcttcggggaggagatcaagaacatcatatcctgcgagggatttgagagaagagaaagacacgagaagcttgagaaatggagccagaggatcgatttggctggttttgggaatgttcctcttagctattatgcgatgttgcaggctaggagattgcttcaagggtgcggttttgatgggtatagaatcaaggaagagagcgggtgcgcagtaatttgctggcaagatcgacctctatactcggtatcagcttggagatgcaggaagtga

SEQ ID NO: 690 - protein, 482 aa, Arabidopsis thaliana
  G922,SCR domain coordinates 134-199,332-401,405-478
MVAMFQEDNGTSSVASSPLQVFSTMSLNRPTLLASSSPFHCLKDLKPEERGLYLIHLLLTCANHVASGSLQNANAALEQLSHLASPDGDTMQRIAAYFTEALANRILKSWPGLYKALNATQTRTNNVSEEIHVRRLFFEMFPILKVSYLLTNRAILEAMEGEKMVHVIDLDASEPAQWLALLQAFNSRPEGPPHLRITGVHHQKEVLEQMAHRLIEEAEKLDIPFQFNPVVSRLDCLNVEQLRVKTGEALAVSSVLQLHTFLASDDDLMRKNCALRFQNNPSGVDLQRVLMMSHGSAAEARENDMSNNNGYSPSGDSASSLPLPSSGRTDSFLNAIWGLSPKVMVVTEQDSDHNGSTLMERLLESLYTYAALFDCLETKVPRTSQDRIKVEKMLFGEEIKNIISCEGFERRERHEKLEKWSQRIDLAGFGNVPLSYYAMLQARRLLQGCGFDGYRIKEESGCAVICWQDRPLYSVSAWRCRK

SEQ ID NO: 691 - DNA, 821 bp, Arabidopsis thaliana
  G926,family:CAAT
atgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagtagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataata

SEQ ID NO: 692 - protein, 272 aa, Arabidopsis thaliana
  G926,CAAT domain coordinates 172-229
MQSKPGRENEEEVNNHHAVQQPMMYAEPWWKNNSFGVVPQARPSGIPSNSSSLDCPNGSESNDVHSASEDGALNGENDGTWKDSQAATSSRSVDNHGMEGNDPALSIRNMHDQPLVQPPELVGHYIACVPNPYQDPYYGGLMGAYGHQQLGFRPYLGMPRERTALPLDMAQEPVYVNAKQYEGILRRRKARAKAELERKVIRDRKPYLHESRHKHAMRRARASGGRFAKKSEVEAGEDAGGRDRERGSATNSSGSEQVETDSNETLNSSGAP

SEQ ID NO: 693 - DNA, 1385 bp, Arabidopsis thaliana
  G927,family:CAAT
ggaatctgaagctcttctctactctctactctatcactccatctgtgaacatatctttcttattcttctaggcactatctatttttcactttttgtaattggaatttggagatggctatgcaaactgtgagagaaggtctcttctctgctccacagacttcttggtggactgcttttggatctcagccgttggctccggagagtctcgccggcgattctgactcattcgccggagttaaggtcggatctgtcggagagacaagacaacgtgtggataaacagagcaactctgcaacgcacttagctttctcacttggtgatgtaaagagtccaagacttgtgccaaagcctcatggagctactttctcaatgcaatcaccttgcttggaacttggattttctcagccaccgatctatacaaagtatccctatggagaacaacaatactatggagttgtttcagcctatggatctcagagcagggtaatgcttcctctaaacatggaaacggaagatagtaccatctatgtgaactcaaagcaataccatggaatcataaggagacgccaatcccgcgcaaaggctgctgctgttcttgatcagaagaaattgagtagtagatgccgcaagccatatatgcatcattcgcgccatctccatgcattgcggcgtcctagaggatccggtgggagattcttgaacactaaaagtcagaacttggaaaatagcggaaccaatgcaaagaaaggtgatggaagtatgcagattcagtctcagcctaagcctcagcaaagtaactctcagaattctgaagttgttcatccggaaaacgggaccatgaacttatcgaacggattaaatgtgtcgggatcagaagttactagcatgaactacttcctaagttctcccgttcattctcttggtggcatggtaatgcctagcaagtggatagcagcagcagcagcaatggataatggctgctgcaatttcaaaacctgatcctttaccgtttcacagtcaaacggagagagataaagaactcttgccttggtataaaggattttcctttttgccaatccgctttggctgtgaacaggcaaatcatctttggctcattctctattaaggtaacttcgccgtgaggtgaaaaaagctttgatatatttatcttcagtgtaaaagtagttaaaactggtgaagaacaatgatgtgtttggtcactaaacccacttgttccaactagtagtgtgtgttttaagaaaactctgttatctgattttgtagctctctctggctttgtgtgtttctcaaacaactgtaacaacttttaagttatgtggtttatgtaacatatttaagacctgtgtttttgtataaaaaaaaaa

SEQ ID NO: 694 - protein, 295 aa, Arabidopsis thaliana
  G927,CAAT domain coordinates 136-199
MAMQTVREGLFSAPQTSWWTAFGSQPLAPESLAGDSDSFAGVKVGSVGETRQRVDKQSNSATHLAFSLGDVKSPRLVPKPHGATFSMQSPCLELGFSQPPIYTKYPYGEQQYYGVVSAYGSQSRVMLPLNMETEDSTIYVNSKQYHGIIRRRQSRAKAAAVLDQKKLSSRCRKPYMHHSRHLHALRRPRGSGGRFLNTKSQNLENSGTNAKKGDGSMQIQSQPKPQQSNSQNSEVVHPENGTMNLSNGLNVSGSEVTSMNYFLSSPVHSLGGMVMPSKWIAAAAAMDNGCCNFKT

SEQ ID NO: 695 - DNA, 1516 bp, Arabidopsis thaliana
  G928,family:CAAT
ctcatggcgatgttggtttcccaggaaaggtaaaagagacggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggttgttggttgtgagaataattagcttgttaaggaagacgttatgatgcatcagatgttgaataagaaagattcagctactcattccactttgccataccttaatactagcatctcttggggagtggttccaactgattccgttgctaatcgtcgcggtcctgctgaatcactaagcttgaaggttgattcaagacctgggcatatacaaactacaaagcaaatcagttttcaggaccaagattcatcttcaacacagtccactggtcaatcttatactgaagttgctagtagtggtgatgataatccttccagacaaatctccttttcggctaaatcaggatctgaaataactcaacggaaggggtttgcaagtaatcctaaacaaggctcgatgactggatttccgaatattcactttgctcctgcacaggctaatttctcatttcactatgctgatccacattatggtggtttattagctgcaacttacctaccacaggcaccaacatgcaatcctcaaatggtgagtatgattcctggtcgtgttcctttaccagcagagctcacagaaactgatccagtctttgtcaatgcgaagcaataccacgcaattatgaggaggagacagcaacgtgctaagcttgaggctcaaaacaaactaatcagagcccgtaagccctatcttcatgagtctcgacatgttcatgctcttaaaaggccaagaggatctggtggaagattcctaaacaccaaaaaacttcttcaagaatccgaacaggctgctgctagagaacaagaacaggacaagttaggccaacaggtaaacagaaagaccaacatgtctagattcgaagctcatatgctgcagaacaacaaagaccgcagctcaaccacttctggctcagacatcacctctgtttccgacggtgctgatatctttggacacactgaattccagttttcaggtttcccaactccgataaaccgagccatgcttgttcatggtcagtctaatgacatgcatggaggtggagacatgcaccatttctctgtccatatctgagacagtggatcttggtgctgtgttcatgttcccaccaagaaggggaagtcatccttggctactactagttctttcgcttgttgtaacttcagtgtttttatttcatattatgtctgtgttagacatcacaagaacgaccaagatcttcactttgaaacactctattaccttttcatcttctgttaccatggatctcttgtctaaactagtgatatgattcttctgataaaaaaaaaaa

SEQ ID NO: 696 - protein, 340 aa, Arabidopsis thaliana
  G928,CAAT domain coordinates 179-238
MMHQMLNKKDSATHSTLPYLNTSISWGVVPTDSVANRRGPAESLSLKVDSRPGHIQTTKQISFQDQDSSSTQSTGQSYTEVASSGDDNPSRQISFSAKSGSEITQRKGFASNPKQGSMTGFPNIHFAPAQANFSFHYADPHYGGLLAATYLPQAPTCNPQMVSMIPGRVPLPAELTETDPVFVNAKQYHAIMRRRQQRAKLEAQNKLIRARKPYLHESRHVHALKRPRGSGGRFLNTKKLLQESEQAAAREQEQDKLGQQVNRKTNMSRFEAHMLQNNKDRSSTTSGSDITSVSDGADIFGHTEFQFSGFPTPINRAMLVHGQSNDMHGGGDMHHFSVHI

SEQ ID NO: 697 - DNA, 953 bp, Arabidopsis thaliana
  G929,family:CAAT
ggagagacctttaacaattttctgagggtaagatccagagattgattgaatcagcttactattttatataattcagtttgttgttcctcagacttgtaactaggacagtcttctcatgaatcatgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatcttgaggaaggtttctgcacaaccacaagtttagtttctattttgggtggatgttctcagggcatcatcgtctttagtgtttttggatacgctgtgtacaggttatttgctagggtaaactttgttttagcgattagaaataaaactaagcaaagaaatgaaaagtgtgattggaagtattgttgtaccaaattgatattctttgccaatgaactcatgttttggaaagtaaaaaaaaa

SEQ ID NO: 698 - protein, 198 aa, Arabidopsis thaliana
  G929,CAAT domain coordinates 98-157
MTSSVHELSDNNESHAKKERPDSQTRPQVPSGRSSESIDTNSVYSEPMAHGLYPYPDPYYRSVFAQQAYLPHPYPGVQLQLMGMQQPGVPLQCDAVEEPVFVNAKQYHGILRRRQSRAKLEARNRAIKAKKPYMHESRHLHAIRRPRGCGGRFLNAKKENGDHKEEEEATSDENTSEASSSLRSEKLAMATSGPNGRS

SEQ ID NO: 699 - DNA, 1180 bp, Arabidopsis thaliana
  G931,family:CAAT
ggaggttctttgacagacacatgtatcatcaatcttctctgttgaagcagagagagagagagctaattgttgcctctgagtcacatggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatctgagccggtggaatctggtaatgtgtacgttcctacaaaaaaagggaagtcatccttggctgctacttcgcttattagctagttcttatttcacacgctttgtccagatatc

SEQ ID NO: 700 - protein, 328 aa, Arabidopsis thaliana
  G931,CAAT domain coordinates 172-231
MDKKVSFTSSVAHSTPPYLSTSISWGLPTKSNGVTESLSLKVVDARPERLINTKNISFQDQDSSSTLSSAQSSNDVTSSGDDNPSRQISFLAHSDVCKGFEETQRKRFAIKSGSSTAGIADIHSSPSKANFSFHYADPHFGGLMPAAYLPQATIWNPQMTRVPLPFDLIENEPVFVNAKQFHAIMRRRQQRAKLEAQNKLIKARKPYLHESRHVHALKRPRGSGGRFLNTKKLQESTDPKQDMPIQQQHATGNMSRFVLYQLQNSNDCDCSTTSRSDITSASDSVNLFGHSEFLISDCPSQTNPTMYVHGQSNDMHGGRNTHHFSVHI

SEQ ID NO: 701 - DNA, 1519 bp, Arabidopsis thaliana
  G932,family:MYB-(R1)R2R3
ccacgcgtccgaccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtctttttaaaaaaaaaaaaaaaaa

SEQ ID NO: 702 - protein, 335 aa, Arabidopsis thaliana
  G932,MYB-(R1)R2R3 domain coordinates 14-118
MGRPPCCDKIGVKKGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKKMNDSCDSTINNGLDNKDFSISNKNTTSHQSSNSSKGQWERRLQTDINMAKQALCDALSIDKPQNPTNFSIPDLGYGPSSSSSSTTTTTTTTTTRNTNPYPSGVYASSAENIARLLQNFMKDTPKTSVPLPVAATEMAITTAASSPSTTEGDGEGIDHSLFSFNSIDEAEEKPKLIDHDINGLITQGSLSLFEKWLFDEQSHDMIINNMSLEGQEVLF

SEQ ID NO: 703 - DNA, 1199 bp, Arabidopsis thaliana
  G937,family:GARP
tggaaaaagtttgagtttttaattcgaatcgagaaaaaataaaaatgggttctttaggtgatgagcttagtttgggatcgatctttgggagaggagtttcgatgaatgttgtggcggttgagaaagttgatgaacatgttaagaagcttgaagaagagaagagaaagctcgaaagttgtcaacttgagcttcctctgtctttgcagattttaaacgatgcgattttgtatctgaaggataagagatgttcagagatggagactcaaccattgttgaaagatttcatttctgttaataaacctattcaaggagaaagaggaatagaattgctgaaaagagaggagctaatgagggagaagaagtttcagcaatggaaagctaatgatgatcacactagtaagatcaagagcaagcttgagattaagagaaatgaggagaaatctcctatgttgttgattccaaaggtggaaactggtttaggcctcggtttaagttcgagttcgataagaagaaaagggattgttgcctcatgtggctttacttctaactctatgccacaaccaccaacaccagcagtaccacaacaaccagcatttcttaagcagcaagctttacggaagcaaagaaggtgttggaatccagagttgcatcgccgatttgtcgatgcattgcaacagctaggtggaccgggagtggcaactcctaaacaaattagagaacatatgcaagaagaaggcttaaccaatgatgaagtcaagagtcatttacagaaatacaggttacacatcaggaagccaaattcgaatgcggagaaacaatcagcagttgttttagggtttaacttgtggaattcttcagcacaagatgaagaagagacatgtgaaggaggagaatcattgaagagaagcaatgcgcaatcagattctcctcaaggtcctttgcagttaccgtctacaacaacaacaactggtggagatagtagcatggaagatgttgaagatgctaagtctgagagctttcaactggagagattgagatcaccataaatctcaagaaaccaaactcttgatcacggttttgttattttggattcattactatatctattagtagtgaatgagaacaataattatagaaaggtttatagatatatatatagagaaaaagagagagtgaggatggttcaaattatttgcaga

SEQ ID NO: 704 - protein, 333 aa, Arabidopsis thaliana
  G937,GARP domain coordinates 197-246
MGSLGDELSLGSIFGRGVSMNVVAVEKVDEHVKKLEEEKRKLESCQLELPLSLQILNDAILYLKDKRCSEMETQPLLKDFISVNKPIQGERGIELLKREELMREKKFQQWKANDDHTSKIKSKLEIKRNEEKSPMLLIPKVETGLGLGLSSSSIRRKGIVASCGFTSNSMPQPPTPAVPQQPAFLKQQALRKQRRCWNPELHRRFVDALQQLGGPGVATPKQIREHMQEEGLTNDEVKSHLQKYRLHIRKPNSNAEKQSAVVLGFNLWNSSAQDEEETCEGGESLKRSNAQSDSPQGPLQLPSTTTTTGGDSSMEDVEDAKSESFQLERLRSP

SEQ ID NO: 705 - DNA, 1755 bp, Arabidopsis thaliana
  G938,family:EIL
atgatgatgtttaacgagatgggaatgtatggaaacatggatttcttctcttcctccacatctctcgatgtgtgtccattaccacaagctgaacaagaacctgtagttgaagatgtcgactacaccgatgatgagatggatgtggatgagcttgagaagaggatgtggagagacaaaatgcgtttgaaacgtctcaaggagcaacagagtaagtgtaaagaaggcgtcgatggttcgaaacagaggcagtcgcaagagcaagctaggaggaagaaaatgtctagagcccaagatgggatcttgaagtatatgttgaagatgatggaagtttgtaaagctcaaggctttgtttatggtattattcctgagaagggtaagcctgtgactggtgcttcggataatttgagggaatggtggaaagataaggttaggtttgatcgtaatggtccagctgctattgctaagtatcagtcagagaataatatttctggagggagtaatgattgtaacagcttggttggtccaacaccgcatacgcttcaggagcttcaggacacgactcttggttcgcttttatcggctttgatgcaacattgtgatccaccgcagagacggtttcctttggagaaaggagtttctccaccttggtggcctaatgggaatgaagagtggtggcctcagcttggtttaccaaatgagcaaggtcctcctccttataagaagcctcatgatttgaagaaagcttggaaagtcggtgttttaactgcggtgatcaagcatatgtcgccggatattgcgaagatccgtaagcttgtgaggcaatcaaaatgcttgcaggataagatgacggcgaaagagagtgctacttggcttgccattattaaccaagaagaggttgtggctcgggagctttatcccgagtcatgccctcctctttcttcttcttcatcattaggaagcgggtcgcttctcattaatgattgtagcgagtatgacgttgaaggtttcgagaaggaacaacatggtttcgatgtggaagagcggaaaccagagatagtgatgatgcatcctctagcaagctttggggttgctaaaatgcaacattttcccataaaggaggaggtcgccaccacggtaaacttagagttcacgagaaagaggaagcagaacaatgatatgaatgttatggtaatggacagatcagcaggttacacttgtgagaatggtcagtgtcctcacagcaaaatgaatcttggatttcaagacaggagttcaagggacaaccaccagatggtttgtccatatagagacaatcgtttagcgtatggagcatccaagtttcatatgggtggaatgaaactagtagttcctcagcaaccagtccaaccgatcgacctatcgggcgttggagttccggaaaacgggcagaagatgatcaccgagcttatggccatgtacgacagaaatgtccaaagcaaccaaacgcctcctactttgatggaaaaccaaagcatggtcattgatgcaaaagcagctcagaatcagcagctgaatttcaacagtggcaatcaaatgtttatgcaacaagggacgaacaacggggttaacaatcggttccagatggtgtttgattcgacaccattcgatatggcagcattcgattacagagatgattggcaaaccggagcaatggaaggaatggggaagcagcagcagcagcagcagcagcagcaagatgtatcaatatggttctga

SEQ ID NO: 706 - protein, 584 aa, Arabidopsis thaliana
  G938,EIL domain coordinates 96-104
MMMFNEMGMYGNMDFFSSSTSLDVCPLPQAEQEPVVEDVDYTDDEMDVDELEKRMWRDKMRLKRLKEQQSKCKEGVDGSKQRQSQEQARRKKMSRAQDGILKYMLKMMEVCKAQGFVYGIIPEKGKPVTGASDNLREWWKDKVRFDRNGPAAIAKYQSENNISGGSNDCNSLVGPTPHTLQELQDTTLGSLLSALMQHCDPPQRRFPLEKGVSPPWWPNGNEEWWPQLGLPNEQGPPPYKKPHDLKKAWKVGVLTAVIKHMSPDIAKIRKLVRQSKCLQDKMTAKESATWLAIINQEEVVARELYPESCPPLSSSSSLGSGSLLINDCSEYDVEGFEKEQHGFDVEERKPEIVMMHPLASFGVAKMQHFPIKEEVATTVNLEFTRKRKQNNDMNVMVMDRSAGYTCENGQCPHSKMNLGFQDRSSRDNHQMVCPYRDNRLAYGASKFHMGGMKLVVPQQPVQPIDLSGVGVPENGQKMITELMAMYDRNVQSNQTPPTLMENQSMVIDAKAAQNQQLNFNSGNQMFMQQGTNNGVNNRFQMVFDSTPFDMAAFDYRDDWQTGAMEGMGKQQQQQQQQQDVSIWF

SEQ ID NO: 707 - DNA, 1722 bp, Arabidopsis thaliana
  G939,family:EIL
cagattctatggatatgtataacaacaatatagggatgttccggagtttagtttgtagctcggcgcctccatttacagagggacatatgtgttctgattcgcatacggctttgtgcgatgatctgagtagtgatgaggaaatggaaatagaggagcttgagaagaagatctggagagacaagcagcgtttaaagcggctcaaggaaatggcgaagaacggtctaggaacaagattgttgttgaagcagcaacatgatgattttccagagcactctagtaagagaaccatgtacaaggcacaagatgggatcttgaagtacatgtcgaagacaatggagcgatataaagctcaaggttttgtttatgggattgtgttagagaatgggaaaacggtagcgggatcttctgataatctccgtgaatggtggaaagacaaagtgaggtttgataggaacggcccagctgctataatcaagcaccaaagggatatcaatctttctgatggaagtgattcagggtctgaggttggggattctaccgcacagaagttgcttgagcttcaagatactactcttggagctctgttatcggctctgtttcctcactgcaaccctcctcagaggcggtttccgttggagaaaggcgtgacaccgccatggtggccaacggggaaagaagattggtgggatcaactgtctttacccgttgattttcgaggtgttccgccaccttacaagaagcctcatgatctcaagaagctgtggaaaattggtgttttgattggtgtaatcagacatatggcttctgacattagcaacatacccaatctcgtgagacggtctagaagtttgcaggagaaaatgacgtcaagagaaggcgctttatggctcgctgctctttaccgagaaaaggctattgttgatcaaatagccatgtctagagaaaacaacaacacttctaactttcttgttcctgcaaccggtggagacccagatgttttgtttcctgaatctacagactatgatgttgaactgattggtggcactcatcggaccaatcagcagtatcctgaatttgaaaacaactacaactgtgtttacaagagaaagtttgaagaagattttgggatgccaatgcatccaacactcctaacatgtgagaacagtctctgtccttatagccaaccacatatgggatttcttgacaggaacttaagagagaatcaccaaatgacttgtccttataaagtcacttccttctaccaaccaactaaaccctatggtatgacgggtttaatggttccttgtccggattataacgggatgcagcagcaggttcagagctttcaagaccagtttaatcatcccaacgatctctacagaccaaaagctccacaaagaggcaacgatgacttggttgaggatttgaatccttctccttcgacgctgaatcagaatcttggtttagtcttacctactgacttcaatggaggtgaggaaacagtaggaacagagaacaatctgcataatcaagggcaagagttgcccacatcttggattcagtaaagaaagcttcagagttttctttttatgttttctagtctttatagctttgtctcttgcttattctctcattaaacacagtttttgatctctccatttcatagcccatgtagcaatggagaagattaggtttcataataagttaataaccaaattcaaa

SEQ ID NO: 708 - protein, 518 aa, Arabidopsis thaliana
  G939,EIL domain coordinates 97-106
MDMYNNNIGMFRSLVCSSAPPFTEGHMCSDSHTALCDDLSSDEEMEIEELEKKIWRDKQRLKRLKEMAKNGLGTRLLLKQQHDDFPEHSSKRTMYKAQDGILKYMSKTMERYKAQGFVYGIVLENGKTVAGSSDNLREWWKDKVRFDRNGPAAIIKHQRDINLSDGSDSGSEVGDSTAQKLLELQDTTLGALLSALFPHCNPPQRRFPLEKGVTPPWWPTGKEDWWDQLSLPVDFRGVPPPYKKPHDLKKLWKIGVLIGVIRHMASDISNIPNLVRRSRSLQEKMTSREGALWLAALYREKAIVDQIAMSRENNNTSNFLVPATGGDPDVLFPESTDYDVELIGGTHRTNQQYPEFENNYNCVYKRKFEEDFGMPMHPTLLTCENSLCPYSQPHMGFLDRNLRENHQMTCPYKVTSFYQPTKPYGMTGLMVPCPDYNGMQQQVQSFQDQFNHPNDLYRPKAPQRGNDDLVEDLNPSPSTLNQNLGLVLPTDFNGGEETVGTENNLHNQGQELPTSWIQ

SEQ ID NO: 709 - DNA, 840 bp, Arabidopsis thaliana
  G956,family:NAC
atggaggagacagaaaagaataagggcagcataagtatggttgaggctaatctacctcctggttttagattccatcctagagacgacgagctcgtctgtgactacttaatgagaagaaccgttcgcagcctctatcaaccagttgtcttgatcgacgtcgatcttaacaaatgcgagccttgggacattcctcaaacggcgagagtgggagggaaagaatggtacttttacagccaaaaagaccgtaaatacgcaacaggctacagaacaaaccgggctacggccaccggttattggaaagccaccgggaaagatagagcaatccaaagaaacggtggtcttgtgggtatgagaaagacacttgtgttttaccgaggtcgatcccctaaaggtcgtaaaactgattgggtcatgcatgagtttcgtctccaaggaaaacttcttcaccactcccctaattctctcgaggaagagtgggtattgtgtagagttttccacaagaacagcaacggagctgatatagacgacatcacaaggagctgctctgatgcaacagcttctgcattcatggactcttacatcaacttcgaccatcatcacatcatcaatcagcatgtaccctgcttctccaataatttgtcacataaccaaaccaaccaatccggtttaatctccaagaactccagcccattgtttaatgcttcccctgatcaaatgattctcagaactttgctaagtcaactcacaaaaaaagtcgaagaatcacagagtcgtggagacggaagctcagagagccaattgaccgacattggcatcccaagccatgcatggaattactga

SEQ ID NO: 710 - protein, 279 aa, Arabidopsis thaliana
  G956,NAC domain coordinates NA
MEETEKNKGSISMVEANLPPGFRFHPRDDELVCDYLMRRTVRSLYQPVVLIDVDLNKCEPWDIPQTARVGGKEWYFYSQKDRKYATGYRTNRATATGYWKATGKDRAIQRNGGLVGMRKTLVFYRGRSPKGRKTDWVMHEFRLQGKLLHHSPNSLEEEWVLCRVFHKNSNGADIDDITRSCSDATASAFMDSYINFDHHHIINQHVPCFSNNLSHNQTNQSGLISKNSSPLFNASPDQMILRTLLSQLTKKVEESQSRGDGSSESQLTDIGIPSHAWNY

SEQ ID NO: 711 - DNA, 1077 bp, Arabidopsis thaliana
  G957,family:NAC
atggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatga

SEQ ID NO: 712 - protein, 358 aa, Arabidopsis thaliana
  G957,NAC domain coordinates 12-182
MADNKVNLSINGQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQKIDDCPKITLSSLPDDTEEEKGPTFHNTQNVTGLDHVLLYMDRTGSNICMPESQTTTQHQDDVLFMQLPSLETPKSESPVDQSFLTPSKLDFSPVQEKITERPVCSNWASLDRLVAWQLNNGHHNPCHRKSFDEEEENGDTMMQRWDLHWNNDDNVDLWSSFTESSSSLDPLLHLSV

SEQ ID NO: 713 - DNA, 2022 bp, Arabidopsis thaliana
  G958,family:NAC
cgtcgacatgttcatatttgtttctagctaagaagtttgtataaggcagtggacatggctcctgtttcaatgcctccaggtttccggtttcatccaacagacgaagagcttgtcatatactacctcaagcgaaagattaatggtcggactattgagttagagataatacccgagattgatctttacaaatgcgaaccttgggatttacctgggaagtccttgctgccaagtaaagacctagaatggttctttttcagtcctcgagaccggaaatatccaaacggatcaagaacaaaccgggcgaccaaagcaggttactggaaagccaccgggaaagatcgtaaagtgacttcacattcacggatggttggaacaaagaaaacattagtttattaccgaggaagagcgcctcatggctctcgtaccgattgggtcatgcacgagtaccgtcttgaagaacaagaatgtgactctaaatccggtatacaggatgcctatgcactttgtcgagtatttaagaagagtgctttagccaacaaaattgaagaacaacaccatggtacgaagaagaacaaaggaacgactaatagtgaacaatctacttctagtacttgtttgtattctgatggaatgtatgaaaacctcgaaaactcggggtatccagtctcacctgagacaggaggcttaactcaactcggtaataattcgtcgtcggatatggaaacgatagagaataaatggagtcagtttatgtcgcatgacacgtccttcaacttcccacctcagtctcaatatggaacaatctcatatcctccctcgaaggttgatatagcgttagagtgtgcaagactacaaaatcgtatgttgccaccagtaccaccactttacgtagaaggtctcacacacaatgaatattttggaaacaatgtagctaacgatacagatgaaatgttgagcaagattatagcattggctcaagcctcacatgagccacgaaacagtctagactcatgggacggtggttctgcttccgggaacttccatggagactttaactattccggagaaaaagtctcatgcctagaggcgaacgtggaggctgtagatatgcaagaacaccatgtgaattttaaggaagaaagacttgttgaaaacttgagatgggtaggagtatcaagcaaggaacttgaaaagagcttcgttgaagaacactcaacggtaattcctatagaagatatttggagatatcataatgataatcaagaacaagaacatcatgatcaagatggtatggacgttaacaacaacaatggagatgtggatgatgctttcacactcgagttttcggaaaacgaacataacgagaatcttttggacaagaacgatcatgagacaacgagttcctcatgttttgaggtggtaaaaaaagttgaggttagccatggattgtttgtcacaactcgtcaggtaaccaacacattcttccaacagatagtaccatcgcaaaccgttatagtttatataaatccgacggatggcaatgagtgttgtcatagtatgacatcaaaagaggaggttcatgtccgtaaaaagataaatccgcgaatcaacggagtaagctcaacagttcttggacaatggagaaaattcgcgcatgttattggcttcattcctatgcttctattgatgcgttgtgttcatcgaggtaactctaacaaaaacagaggcagtgaaggttactcgaggcagcctacgagaggagattgtaacaatcggggaacaatactcatgatggaaaatgctgtcgtgagaagaaaaatttggaagaagaagaaagagaaaaatatggttgacgaacaaggttttcggtttcaagatagtttcgtattgaagaagttggggctttctcttgctatcatcttagctgtttctaccataagtcttatttgaatactgaggttcaatatatcatatatggcttttcacttttctattgtactcccatttgcctaggtcgtatgc

SEQ ID NO: 714 - protein, 631 aa, Arabidopsis thaliana
  G958,NAC domain coordinates 7-156
MAPVSMPPGFRFHPTDEELVIYYLKRKINGRTIELEIIPEIDLYKCEPWDLPGKSLLPSKDLEWFFFSPRDRKYPNGSRTNRATKAGYWKATGKDRKVTSHSRMVGTKKTLVYYRGRAPHGSRTDWVMHEYRLEEQECDSKSGIQDAYALCRVFKKSALANKIEEQHHGTKKNKGTTNSEQSTSSTCLYSDGMYENLENSGYPVSPETGGLTQLGNNSSSDMETIENKWSQFMSHDTSFNFPPQSQYGTISYPPSKVDIALECARLQNRMLPPVPPLYVEGLTHNEYFGNNVANDTDEMLSKIIALAQASHEPRNSLDSWDGGSASGNFHGDFNYSGEKVSCLEANVEAVDMQEHHVNFKEERLVENLRWVGVSSKELEKSFVEEHSTVIPIEDIWRYHNDNQEQEHHDQDGMDVNNNNGDVDDAFTLEFSENEHNENLLDKNDHETTSSSCFEVVKKVEVSHGLFVTTRQVTNTFFQQIVPSQTVIVYINPTDGNECCHSMTSKEEVHVRKKINPRINGVSSTVLGQWRKFAHVIGFIPMLLLMRCVHRGNSNKNRGSEGYSRQPTRGDCNNRGTILMMENAVVRRKIWKKKKEKNMVDEQGFRFQDSFVLKKLGLSLAIILAVSTISLI

SEQ ID NO: 715 - DNA, 1095 bp, Arabidopsis thaliana
  G961,family:NAC
atgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatggtagtggataa

SEQ ID NO: 716 - protein, 364 aa, Arabidopsis thaliana
  G961,NAC domain coordinates 12-180
MSKSMSISVNGQSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKKNLHKTLNSPVGGASLSGGGDTPKTTSSQIFNEDTLDQFLELMGRSCKEELNLDPFMKLPNLESPNSQAINNCHVSSPDTNHNIHVSNVVDTSFVTSWAALDRLVASQLNGPTSYSITAVNESHVGHDHLALPSVRSPYPSLNRSASYHAGLTQEYTPEMELWNTTTSSLSSSPGPFCHVSNGSG

SEQ ID NO: 717 - DNA, 1444 bp, Arabidopsis thaliana
  G962,family:NAC
cgtcgactctctactcaacaccactcaatttcatctctctttttcccttccattgttagtataaaaaccaagcaaacccttaatcacttttcatcatcatatatcaccttaatccacatgcatacacatatctagtctttttgatatatggcaattgtatcctccacaacaagcatcattcccatgagtaaccaagtcaacaataacgaaaaaggtatagaagacaatgatcatagaggcggccaagagagtcatgtccaaaatgaagatgaagctgatgatcatgatcatgacatggtcatgcccggatttagattccatcctaccgaagaagaactcatagagttttaccttcgccgaaaagttgaaggcaaacgctttaatgtagaactcatcactttcctcgatctttatcgctatgatccttgggaacttcctgctatggcggcgataggagagaaagagtggtacttctatgtgccaagagatcggaaatatagaaatggagatagaccgaaccgagtaacgacttcaggatattggaaagccaccggagctgataggatgatcagatcggagacttctcggcctatcggattaaagaaaaccctagttttctactctggtaaagcccctaaaggcactcgtactagttggatcatgaacgagtatcgtcttccgcaccatgaaaccgagaagtaccaaaaggctgaaatatcattgtgccgagtgtacaaaaggccaggagtagaagatcatccatcggtaccacgttctctctccacaagacatcataaccataactcatcgacatcatcccgtttagccttaagacaacaacaacaccattcatcctcctctaatcattccgacaacaaccttaacaacaacaacaacatcaacaatctcgagaagctctccaccgaatattccggcgacggcagcacaacaacaacgaccacaaacagtaactctgacgttaccattgctctagccaatcaaaacatatatcgtccaatgccttacgacacaagcaacaacacattgatagtctctacgagaaatcatcaagacgatgatgaaactgccattgttgacgatcttcaaagactagttaactaccaaatatcagatggaggtaacatcaatcaccaatactttcaaattgctcaacagtttcatcatactcaacaacaaaatgctaacgcaaacgcattacaattggtggctgcggcgactacagcgacaacgctaatgcctcaaactcaagcggcgttagctatgaacatgattcctgcaggaacgattccaaacaatgctttgtgggatatgtggaatccaatagtaccagatggaaacagagatcactatactaatattccttttaagtaatttaattagatcatgattattatccatgacaataattaatgctgctttgcgc

SEQ ID NO: 718 - protein, 414 aa, Arabidopsis thaliana
  G962,NAC domain coordinates 53-175
MAIVSSTTSIIPMSNQVNNNEKGIEDNDHRGGQESHVQNEDEADDHDHDMVMPGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEYRLPHHETEKYQKAEISLCRVYKRPGVEDHPSVPRSLSTRHHNHNSSTSSRLALRQQQHHSSSSNHSDNNLNNNNNINNLEKLSTEYSGDGSTTTTTTNSNSDVTIALANQNIYRPMPYDTSNNTLIVSTRNHQDDDETAIVDDLQRLVNYQISDGGNINHQYFQIAQQFHHTQQQNANANALQLVAAATTATTLMPQTQAALAMNMIPAGTIPNNALWDMWNPIVPDGNRDHYTNIPFK

SEQ ID NO: 719 - DNA, 897 bp, Arabidopsis thaliana
  G963,family:NAC
atgagtttgcctccaggattcaggtttcatcccactgatgaagaactggtggcttactatcttgataggaaggtcaacggccaagccattgagctcgagatcatcccagaagttgatctttataaatgcgagccatgggacttgcctgaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttga

SEQ ID NO: 720 - protein, 298 aa, Arabidopsis thaliana
  G963,NAC domain coordinates NA
MSLPPGFRFHPTDEELVAYYLDRKVNGQAIELEIIPEVDLYKCEPWDLPEKSFLPGNDMEWYFYSTRDKKYPNGSRTNRATRAGYWKATGKDRTVESKKMKMGMKKTLVYYRGRAPHGLRTNWVMHEYRLTHAPSSSLKESYALCRVFKKNIQIPKRKGEEEEAEEESTSVGKEEEEEKEKKWRKCDGNYIEDESLKRASAETSSSELTQGVLLDEANSSSIFALHFSSSLLDDHDHLFSNYSHQLPYHPPLQLQDFPQLSMNEAEIMSIQQDFQCRDSMNGTLDEIFSSSATFPASL

SEQ ID NO: 721 - DNA, 1221 bp, Arabidopsis thaliana
  G964,family:HB
atttctcttccacaaagagtcctaacttcgagttgaaacaaacaccatttctcatctctatctcagaaagaacaaaccatttcgtgttctttctttctctattctcataaggaaatataattcctgaaactgttgagttcttgtgaaaggaaataaaaaacatgatgatgggcaaagaagatctaggtttgagcctaagcttagggttttcacaaaatcacaatcctcttcagatgaatctgaatcctaactcttcattatcaaacaatctccagagactcccatggaaccaaacattcgatcctacatcagatcttcgcaagatagacgtgaacagttttccatcaacggttaactgcgaggaagacacaggagtttcgtcaccaaacagtacgatctcaagcaccattagcgggaagagaagtgagagagaaggaatctccggaaccggcgttggctccggcgacgatcacgacgagatcactccggatcgagggtactcacgtggaacctcagatgaagaagaagacgggggcgaaacgtcgaggaagaagctcaggttatcaaaagatcagtctgcttttctcgaagagactttcaaagaacacaacactctcaatcccaaacagaagctagctttggctaagaagctgaacttgacggcaagacaagtggaagtgtggttccaaaacagaagagctagaaccaagttaaagcaaacggaggtagattgcgaatacttgaaacggtgcgtagagaagctaacggaagagaaccggagacttcagaaagaggctatggagcttcgaactctcaagctgtctccacaattctacggtcagatgactccaccaactacactcatcatgtgtccttcgtgcgagcgtgtagctggtccatcatcatcgaaccatcaccacaatcacaggccggtttcgattaacccgtggattgcttgtgctggtcaggtggctcatgggctgaattttgaagccttgcgtccacgatcgtaatttttagtggtgggggaagggtgttttgggttttttcattatcgttatatagtctatctgtgtggggtcattgtaattttggatgattggccttctcatgaactagtcatatgtatgatgcaaccttaaaaatatttcaagtagcaaaacttaattacaaacttgctatattaaccaaaaattatgaaaaaaaaaaaaaaaaaaaaaa

SEQ ID NO: 722 - protein, 283 aa, Arabidopsis thaliana
  G964,HB domain coordinates 126-186
MMMGKEDLGLSLSLGFSQNHNPLQMNLNPNSSLSNNLQRLPWNQTFDPTSDLRKIDVNSFPSTVNCEEDTGVSSPNSTISSTISGKRSEREGISGTGVGSGDDHDEITPDRGYSRGTSDEEEDGGETSRKKLRLSKDQSAFLEETFKEHNTLNPKQKLALAKKLNLTARQVEVWFQNRRARTKLKQTEVDCEYLKRCVEKLTEENRRLQKEAMELRTLKLSPQFYGQMTPPTTLIMCPSCERVAGPSSSNHHHNHRPVSINPWIACAGQVAHGLNFEALRPRS

SEQ ID NO: 723 - DNA, 1983 bp, Arabidopsis thaliana
  G965,family:HB
gattctctgtgtatgtctgaatccttacaggatccaagagctttggaaaaaagatataatgaataacaagatatgggtttagctactacaacttcttctatgtcacaagattatcatcatcaccaaggaatcttttccttctctaatggattccaccgatcatcatcaaccactcatcaggaggaagtagatgaatccgccgtcgtctccggtgctcaaattccggtttatgaaaccgccggaatgttgtctgaaatgtttgcttaccctggcggaggtggcggcggttccggtggagagattcttgatcagtctactaaacagttgctagagcaacaaaaccgtcacaacaacaacaataactcaactcttcatatgttattaccaaatcatcatcaaggttttgctttcaccgacgaaaacactatgcagccgcagcaacaacaacactttacatggccatcttcctcctccgatcatcatcaaaaccgagatatgatcggaaccgtccacgtggaaggaggaaagggtttgtctttatctctctcatcttcattagccgcagctaaagccgaggaatatagaagcatttattgtgcagccgttgatggaacttcttcttcttctaacgcatccgctcatcatcatcaattcaatcagttcaagaatcttcttcttgagaattcttcttctcaacatcatcaccatcaagttgttggacattttggttcatcatcatcatctcccatggcggcttcttcatccattggagggatctacacgttgaggaattcgaaatatacgaaaccggctcaagagttgttggaagagttttgtagtgttggaagaggacatttcaagaagaacaaacttagtaggaacaactcaaaccctaatactaccggtggaggaggaggcggagggtcctcgtcatcggccggaacagctaatgatagtcctcctttgtctccggctgatcggattgaacatcaaagaagaaaagtcaagctactatctatgcttgaagaggtggaccgacggtacaaccactactgcgaacaaatgcaaatggtagtgaactcattcgaccaagtaatgggttacggcgcggcggttccgtacacgacattagctcaaaaggcaatgtctaggcatttccggtgtttgaaagacgcggtagcggttcagcttaaacgcagctgtgagcttctaggggataaagaggcggcaggggctgcatcctcggggttaaccaaaggggaaacgccgcgattgcgtttgctagagcagagtttgcgtcagcaacgagcgtttcatcatatgggtatgatggagcaagaggcatggagaccgcaacgtggtttgcctgaacgctccgttaatatccttagagcttggctattcgagcattttcttaatccgtacccaagcgatgctgataagcacctcttagcacgacagactggtttatccagaaatcaggtgtcaaattggttcataaatgctagggttcgcctatggaaaccaatggtggaagagatgtatcaacaagaagcaaaagaaagagaagaagcagaagaagaaaatgaaaatcaacaacaacaaagaagacagcaacaaacaaacaacaacgacacgaaacccaacaacaatgaaaacaacttcactgtcataaccgcacaaactccaacgacgatgacatcgacacatcacgaaaacgactcttcattcctctcttccgtcgccgccgcttctcacggcggttcagacgcgttcaccgtcgccacgtgtcagcaagacgtcagtgacttccacgtcgacggagatggtgtgaacgtcataagattcgggaccaaacagactggtgacgtgtctcttacgcttggtctacgccactctggcaatattcctgataagaacacttctttctccgttagagactttggagatttttagtcttctttgtttctcaatttattcatc

SEQ ID NO: 724 - protein, 627 aa, Arabidopsis thaliana
  G965,HB domain coordinates 423-486
MGLATTTSSMSQDYHHHQGIFSFSNGFHRSSSTTHQEEVDESAVVSGAQIPVYETAGMLSEMFAYPGGGGGGSGGEILDQSTKQLLEQQNRHNNNNNSTLHMLLPNHHQGFAFTDENTMQPQQQQHFTWPSSSSDHHQNRDMIGTVHVEGGKGLSLSLSSSLAAAKAEEYRSIYCAAVDGTSSSSNASAHHHQFNQFKNLLLENSSSQHHHHQVVGHFGSSSSSPMAASSSIGGIYTLRNSKYTKPAQELLEEFCSVGRGHFKKNKLSRNNSNPNTTGGGGGGGSSSSAGTANDSPPLSPADRIEHQRRKVKLLSMLEEVDRRYNHYCEQMQMVVNSFDQVMGYGAAVPYTTLAQKAMSRHFRCLKDAVAVQLKRSCELLGDKEAAGAASSGLTKGETPRLRLLEQSLRQQRAFHHMGMMEQEAWRPQRGLPERSVNILRAWLFEHFLNPYPSDADKHLLARQTGLSRNQVSNWFINARVRLWKPMVEEMYQQEAKEREEAEEENENQQQQRRQQQTNNNDTKPNNNENNFTVITAQTPTTMTSTHHENDSSFLSSVAAASHGGSDAFTVATCQQDVSDFHVDGDGVNVIRFGTKQTGDVSLTLGLRHSGNIPDKNTSFSVRDFGDF

SEQ ID NO: 725 - DNA, 1303 bp, Arabidopsis thaliana
  G971,family:AP2
ttttttttcttccctcttttagaactctctctctctctcgtttttgacacttatcctctctcttttttctctctccctctctctctggccggaaaaaagaacaacgtcgtttatagctaaagattcgatcatgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccataggatcgttctacactctcttaactaatatatatttttactctatctgattattgtatacaaggataaaatttgattctttccttaatgagtgagaaatattggaagtgttaaaaaaaaaaaaaaaaaaaaaaa

SEQ ID NO: 726 - protein, 346 aa, Arabidopsis thaliana
  G971,AP2 domain coordinates 120-186
MLDLNLKIFSSYNEDQDRKVPLMISTTGEEESNSSSSSTTDSAARDAFIAFGILKRDDDLVPPPPPPPHKETGDLFPVVADARRNIEFSVEDSHWLNLSSLQRNTQKMVKKSRRGPRSRSSQYRGVTFYRRTGRWESHIWDCGKQVYLGGFDTAYAAARAYDRAAIKFRGLDADINFVVDDYRHDIDKMKNLNKVEFVQTLRRESASFGRGSSKYKGLALQKCTQFKTHDQIHLFQNRGWDAAAIKYNELGKGEGAMKFGAHIKGNGHNDLELSLGISSSSESIKLTTGDYYKGINRSTMGLYGKQSSIFLPMATMKPLKTVAASSGFPFISMTSSSSSMSNCFDP

SEQ ID NO: 727 - DNA, 1430 bp, Arabidopsis thaliana
  G974,family:AP2
aaaaaaaaagttgatatactttctggttttctccttaacttttattctttacaaatccatcccccttagatctgtttatttcccgctactttgattcatttctgttagtaatctgtctttcgtatagaagaaaactgatttcttggtttgtattttcttaaagagatcaatctttttttatttttgatcttcttgtgtttttttttctttgtagaattaatcgtttgtgagggtatttttttaattccctcctctcagaaatctacacagaggttttttattttataaacctctttttcgattttcttgaaaacaaaaaatcctgttctttactttttttacaagaacaagggaaaaaaatttctttttattagaaatgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaattagatgttgccataggggtattttagggactttagagctctctgcgatggagtttttggtcattgcagagattttattattattaagggggtttgttatgttaatatcaaataagtttatctactttgatgttaattagtgttaatctctgcgtcggtccaagctgtttttttttggcatgcttcgaccgtgtgagatttcttatgtaatttttgtagttccttgattttcttagttcaagttaaattggcacaaaaaaaaaaaaaaaaaa

SEQ ID NO: 728 - protein, 261 aa, Arabidopsis thaliana
  G974,AP2 domain coordinates 80-147
MTTSMDFYSNKTFQQSDPFGGELMEALLPFIKSPSNDSSAFAFSLPAPISYGSDLHSFSHHLSPKPVSMKQTGTSAAKPTKLYRGVRQRHWGKWVAEIRLPRNRTRLWLGTFDTAEEAALAYDKAAYKLRGDFARLNFPDLRHNDEYQPLQSSVDAKLEAICQNLAETTQKQVRSTKKSSSRKRSSTVAVKLPEEDYSSAGSSPLLTESYGSGGSSSPLSELTFGDTEEEIQPPWNENALEKYPSYEIDWDSILQCSSLVN

SEQ ID NO: 729 - DNA, 768 bp, Arabidopsis thaliana
  G975,family:AP2
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctattttcattgctgatttacagccaaaataatcaattataccgtgtattttatagatgttttatattaaaaggttgttagatata

SEQ ID NO: 730 - protein, 199 aa, Arabidopsis thaliana
  G975,AP2 domain coordinates 4-71
MVQTKKFRGVRQRHWGSWVAEIRHPLLKRRIWLGTFETAEEAARAYDEAAVLMSGRNAKTNFPLNNNNTGETSEGKTDISASSTMSSSTSSSSLSSILSAKLRKCCKSPSPSLTCLRLDTASSHIGVWQKRAGSKSDSSWVMTVELGPASSSQETTSKASQDAILAPTTEVEIGGSREEVLDEEEKVALQMIEELLNTN

SEQ ID NO: 731 - DNA, 963 bp, Arabidopsis thaliana
  G976,family:AP2
cttatatataacaaataaacacataagttgacatatatactatatacaagtatattaattatacatatatggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattgatcgattgaaagcagtttaatatcttttttggatcctttgttcacgtttatgctagtcatctttgtttctttatcctatgattgttagagatgatttgttaaatatataatcgtaatgattttcacttttttttattcaaaaaaaaaaa

SEQ ID NO: 732 - protein, 248 aa, Arabidopsis thaliana
  G976,AP2 domain coordinates 87-153
MADPNNPITEPKAIIQSSTSSSVTIVPVPTCGDSLSDSATCENPCPLDTITTTTTTVCFAAPSSTASGNDINTLMATDTDISRRKKNPVYRGIRCRSGKWVSEIREPKKTTRVWLGTYPTPEMAAAAYDVAALALKGGDTLLNFPDSLGSYPIPLSSSAAHIRCAAAAAAATRGAAGAAVKVGQKKEDKVYDTAESSTMGFVDEEELLNMPGLLADMAKGMMVAPPWMGSPPSDDSPENSDGESLWSY

SEQ ID NO: 733 - DNA, 833 bp, Arabidopsis thaliana
  misc_feature (810)..(810): n is a, c, g, or t
  G977,family:AP2
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttcatttttatttttgtttccacaaaaacggcgtcgtaagtgatgagagtagtagtgagagaaggctaatttcaagacattttgatctgaattggcctcttttgaaacactgattctagtttctataagagcaatcgatcatatgctatgttatgtatagtattataaaaaaatgttattttctgattnaaaaaaaaaaaaaaaaaaaaaaa

SEQ ID NO: 734 - protein, 181 aa, Arabidopsis thaliana
  G977,AP2 domain coordinates 5-72
MARPQQRFRGVRQRHWGSWVSEIRHPLLKTRIWLGTFETAEDAARAYDEAARLMCGPRARTNFPYNPNAIPTSSSKLLSATLTAKLHKCYMASLQMTKQTQTQTQTQTARSQSADSDGVTANESHLNRGVTETTEIKWEDGNANMQQNFRPLEEDHIEQMIEELLHYGSIELCSVLPTQTL

SEQ ID NO: 735 - DNA, 1530 bp, Arabidopsis thaliana
  misc_feature (1499)..(1500): n is a, c, g, or t
  misc_feature (1503)..(1503): n is a, c, g, or t
  misc_feature (1505)..(1505): n is a, c, g, or t
  misc_feature (1507)..(1507): n is a, c, g, or t
  misc_feature (1512)..(1512): n is a, c, g, or t
  misc_feature (1514)..(1514): n is a, c, g, or t
  misc_feature (1518)..(1518): n is a, c, g, or t
  G979,family:AP2
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttnnaangntncaagntnaaanaaaaaaaaaaaa

SEQ ID NO: 736 - protein, 430 aa, Arabidopsis thaliana
  G979,AP2 domain coordinates 63-139,165-233
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 737 - DNA, 4011 bp, Arabidopsis thaliana
  G987,family:SCR
atgggttcttactcagctggcttccctggatccttggactggtttgattttcccggtttaggaaacggatcctatctaaatgatcaacctttgttagatattggatctgttcctcctcctctagacccatatcctcaacagaatcttgcttctgcggatgctgatttctctgattctgttttgaagtacataagccaagttcttatggaagaggacatggaagataagccttgtatgtttcatgatgctttatctcttcaagcagctgagaagtctctctatgaagctctcggcgagaagtacccggttgatgattctgatcagcctctgactactactactagccttgctcaattggttagtagtcctggtggttcttcttatgcttcaagcaccacaaccacttcctctgattcacaatggagttttgattgtttggagaataataggccttcttcttggttgcagacaccgatcccgagtaacttcatttttcagtctacatctactagagccagtagcggtaacgcggttttcgggtcaagttttagcggtgatttggtttctaatatgtttaatgatactgacttggcgttacaattcaagaaagggatggaggaagctagtaaattccttcctaagagctctcagttggttatagataactctgttcctaacagattaaccggaaagaagagccattggcgcgaagaagaacatttgactgaagaaagaagtaagaaacaatctgctatttatgttgatgaaactgatgagcttactgatatgtttgacaatattctgatatttggcgaggctaaggaacaacctgtatgcattcttaacgagagtttccctaaggaacctgcgaaagcttcaacgtttagtaagagtcctaaaggcgaaaaaccggaagctagtggtaacagttatacaaaagagacacctgatttgaggacaatgctggtttcttgtgctcaagctgtttcgattaacgatcgtagaactgctgacgagctgttaagtcggataaggcaacattcttcatcttacggcgatggaacagagagattggctcattattttgctaacagtcttgaagcacgtttggctgggataggtacacaggtttatactgccttgtcttccaagaaaacatctacttctgacatgttgaaagcttatcagacatatatatcagtctgtccgttcaagaaaatcgcaatcatattcgccaaccatagtattatgcggttggcttcaagtgctaatgccaaaaccatccacatcatagattttggaatatctgatggtttccagtggccttctctgattcatcgacttgcttggagacgtggttcatcttgtaagcttcggataaccggtatagagttgcctcaacgtggttttagaccagccgagggagttattgagactggtcgtcgcttggctaagtattgtcagaagttcaatattccgtttgagtacaatgcgattgcgcagaaatgggaatcaatcaagttggaggacttgaagctaaaagaaggcgagtttgttgcggtaaactctttatttcggtttaggaatcttctagatgagacggtggcagtgcatagcccgagagatacggttttgaagctgataaggaagataaagccagacgtgttcatccccgggatcctcagcggatcctacaacgcgcctttctttgtcacgaggtttagagaagttctgtttcattactcatctctgtttgacatgtgtgacacgaatctaacacgggaagatccaatgagggttatgtttgagaaagagttctatgggcgggagatcatgaacgtggtggcgtgtgaggggacggagagagtggagaggccagagagttataagcagtggcaggcgagggcgatgagagccgggtttagacagattccgctggagaaggaactagttcagaaactgaagttgatggtggaaagtggatacaaacccaaagagtttgatgttgatcaagattgtcactggttgcttcagggctggaaaggtagaattgtatacggttcatctatttgggttcctttctttttctatgtgggcagagcaactagggttttgatcatggatccaaacttctctgaatctctaaacggctttgagtattttgatggtaaccctaatttgcttactgatccaatggaagatcagtatccaccaccatctgatactctgttgaaatacgtgagtgagattcttatggaagagagtaatggagattataagcaatctatgttctatgattcattggctttacgaaaaactgaagaaatgttgcagcaagtcattactgattctcaaaatcagtcctttagtcctgctgattcattgattactaattcttgggatgcaagcggaagcatcgatgaatcggcttattcggctgatccgcaacctgtgaatgaaattatggttaagagtatgtttagtgatgcagaatcagctttacagtttaagaaaggggttgaagaagctagtaaattccttcccaatagtgatcaatgggttatcaatctggatatcgagagatccgaaaggcgcgattcggttaaagaagagatgggattggatcagttgagagttaagaagaatcatgaaagggattttgaggaagttaggagtagtaagcaatttgctagtaatgtagaagatagtaaggttacagatatgtttgataaggttttgcttcttgacggtgaatgcgatccgcaaacattgttagacagcgagattcaagcgattcggagtagtaagaacataggagagaaagggaagaagaagaagaagaagaagagtcaagtggttgattttcgtacacttctcactcattgtgcacaagccatttccacaggagataaaaccacggctcttgagtttctgttacagataaggcaacagtcttcgcctctcggtgacgcggggcaaagactagctcattgtttcgctaacgcgcttgaagctcgtctacagggaagtaccggtcctatgatccagacttattacaatgctttaacctcgtcgttgaaggatactgctgcggatacaattagagcgtatcgagtttatctttcttcgtctccgtttgttaccttgatgtatttcttctccatctggatgattcttgatgtggctaaagatgctcctgttcttcatatagttgattttgggattctatacgggtttcaatggccgatgtttattcagtctatatcagatcgaaaagatgtaccgcggaagctgcggattactggtatcgagcttcctcagtgcgggtttcggcccgcggagcgaatagaggagacaggacggagattggctgagtattgtaaacggtttaatgttccgtttgagtacaaagccattgcgtctcagaactgggaaacaatccggatagaagatctcgatatacgaccaaacgaagtcttagcggttaatgctggacttagactcaagaaccttcaagatgaaacaggaagcgaagagaattgcccgagagatgctgtcttgaagctaataagaaacatgaacccggacgttttcatccacgcgattgtcaacggttcattcaacgcacccttctttatctcgcggtttaaagaagcggtttaccattactccgctctcttcgacatgtttgattcgacgttgcctcgggataacaaagagaggattaggttcgagagggagttttacgggagagaggctatgaacgtgatagcgtgcgaggaagctgatcgagtggagaggcctgagacttacaggcaatggcaggttagaatggttagagccgggtttaagcagaaaacgattaagcctgagctggtagagttgtttagaggaaagctgaagaaatggcgttaccataaagactttgtggttgatgaaaatagtaaatggttgttacaaggctggaaaggtcgaactctctatgcttcttcttgttgggttcctgcctag

SEQ ID NO: 738 - protein, 1336 aa, Arabidopsis thaliana
  G987,SCR domain coordinates 395-462,525-613,1027-1102,1162-1255
MGSYSAGFPGSLDWFDFPGLGNGSYLNDQPLLDIGSVPPPLDPYPQQNLASADADFSDSVLKYISQVLMEEDMEDKPCMFHDALSLQAAEKSLYEALGEKYPVDDSDQPLTTTTSLAQLVSSPGGSSYASSTTTTSSDSQWSFDCLENNRPSSWLQTPIPSNFIFQSTSTRASSGNAVFGSSFSGDLVSNMFNDTDLALQFKKGMEEASKFLPKSSQLVIDNSVPNRLTGKKSHWREEEHLTEERSKKQSAIYVDETDELTDMFDNILIFGEAKEQPVCILNESFPKEPAKASTFSKSPKGEKPEASGNSYTKETPDLRTMLVSCAQAVSINDRRTADELLSRIRQHSSSYGDGTERLAHYFANSLEARLAGIGTQVYTALSSKKTSTSDMLKAYQTYISVCPFKKIAIIFANHSIMRLASSANAKTIHIIDFGISDGFQWPSLIHRLAWRRGSSCKLRITGIELPQRGFRPAEGVIETGRRLAKYCQKFNIPFEYNAIAQKWESIKLEDLKLKEGEFVAVNSLFRFRNLLDETVAVHSPRDTVLKLIRKIKPDVFIPGILSGSYNAPFFVTRFREVLFHYSSLFDMCDTNLTREDPMRVMFEKEFYGREIMNVVACEGTERVERPESYKQWQARAMRAGFRQIPLEKELVQKLKLMVESGYKPKEFDVDQDCHWLLQGWKGRIVYGSSIWVPFFFYVGRATRVLIMDPNFSESLNGFEYFDGNPNLLTDPMEDQYPPPSDTLLKYVSEILMEESNGDYKQSMFYDSLALRKTEEMLQQVITDSQNQSFSPADSLITNSWDASGSIDESAYSADPQPVNEIMVKSMFSDAESALQFKKGVEEASKFLPNSDQWVINLDIERSERRDSVKEEMGLDQLRVKKNHERDFEEVRSSKQFASNVEDSKVTDMFDKVLLLDGECDPQTLLDSEIQAIRSSKNIGEKGKKKKKKKSQVVDFRTLLTHCAQAISTGDKTTALEFLLQIRQQSSPLGDAGQRLAHCFANALEARLQGSTGPMIQTYYNALTSSLKDTAADTIRAYRVYLSSSPFVTLMYFFSIWMILDVAKDAPVLHIVDFGILYGFQWPMFIQSISDRKDVPRKLRITGIELPQCGFRPAERIEETGRRLAEYCKRFNVPFEYKAIASQNWETIRIEDLDIRPNEVLAVNAGLRLKNLQDETGSEENCPRDAVLKLIRNMNPDVFIHAIVNGSFNAPFFISRFKEAVYHYSALFDMFDSTLPRDNKERIRFEREFYGREAMNVIACEEADRVERPETYRQWQVRMVRAGFKQKTIKPELVELFRGKLKKWRYHKDFVVDENSKWLLQGWKGRTLYASSCWVPA

SEQ ID NO: 739 - DNA, 1742 bp, Arabidopsis thaliana
  G988,family:SCR
aaaataatatttattattgccattgaaaaagactcatttgatcgagagagaaaaagaatcatttgaaccaaaagcatctttttctatcttttcaaatgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatgatccaaagagaaggacaaaaaaacctatatatctaggtatatagtagacaaaaaaaaagatcgataatttttggtgttagggcaaaaaatgattaagcagatgatggaagaggacgatggctccggcgaagattgtcgacgccggcggattcttgggatgtgtgtctttttgtttcttgggaagctcaaacaaagagacaacctaatcttttgtgtttttaacctactaatatttactaatatctatattttttttgtcaaactcaatcttaggtgtatcgttttgacatatataatcccattctgtctc

SEQ ID NO: 740 - protein, 445 aa, Arabidopsis thaliana
  G988,SCR domain coordinates 150-217,277-366,371-444
MLTSFKSSSSSSEDATATTTENPPPLCIASSSAATSASHHLRRLLFTAANFVSQSNFTAAQNLLSILSLNSSPHGDSTERLVHLFTKALSVRINRQQQDQTAETVATWTTNEMTMSNSTVFTSSVCKEQFLFRTKNNNSDFESCYYLWLNQLTPFIRFGHLTANQAILDATETNDNGALHILDLDISQGLQWPPLMQALAERSSNPSSPPPSLRITGCGRDVTGLNRTGDRLTRFADSLGLQFQFHTLVIVEEDLAGLLLQIRLLALSAVQGETIAVNCVHFLHKIFNDDGDMIGHFLSAIKSLNSRIVTMAEREANHGDHSFLNRFSEAVDHYMAIFDSLEATLPPNSRERLTLEQRWFGKEILDVVAAEETERKQRHRRFEIWEEMMKRFGFVNVPIGSFALSQAKLLLRLHYPSEGYNLQFLNNSLFLGWQNRPLFSVSSWK

SEQ ID NO: 741 - DNA, 1218 bp, Arabidopsis thaliana
  G989,family:SCR
atgactacaaaacgcatagacagagatctcccatcttccgacgatccttcctccgctaaacgccgtatcgaattccccgaagaaacactcgaaaacgacggtgctgccgcaatcaaactccttagcttactcctccaatgcgccgaatacgtagctactgatcatctccgtgaagcttcaacacttttatccgaaatctccgagatatgttctccgttcggttcctcgccggagcgagtcgtcgcttacttcgctcaagcgctacaaacgcgcgtgatcagctcttacctctccggcgcgtgttctcccctctccgagaaaccactcactgttgttcagtctcagaaaatcttctccgccttgcagacttataactccgttagtcctctgatcaaattctcacatttcacggcgaatcaagccatttttcaggcgcttgacggagaagattccgttcatatcatcgatctcgatgttatgcaaggtcttcaatggccggctctatttcacatcctcgcttcacgtcctcgaaaactccgatcaattcgaatcaccggatttggttcctcctccgatctactcgcttcaactggccggagactcgccgatttcgcatcatcgttaaacctccctttcgaatttcatccaattgaaggcataatcggaaacctaatcgatccgagccaactcgcaacgagacaaggagaagctgtggtggttcattggatgcagcaccggttatatgatgttacagggaacaatctcgagacgttggagattctacggaggctgaaaccgaatctgatcacggtggtggagcaagaattgagctacgacgatggaggaagctttttaggaagattcgtggaggctttgcattattatagcgcgttgtttgacgcgctaggagatggattgggtgaagagagtggtgagagattcacggtggagcagattgttttggggacggagataagaaacattgtggcgcacggaggaggaagaaggaagagaatgaagtggaaagaagaactgagccgggtcgggtttagacctgtttcgcttcggggtaacccggcgacacaagcgggtttattgttgggtatgttaccgtggaatggatatactttggttgaagagaatggaaccctccgtcttggctggaaggatctctcgcttttgactgcctctgcctggaaatctcagccgttcgattga

SEQ ID NO: 742 - protein, 405 aa, Arabidopsis thaliana
  G989,SCR domain coordinates 121-186,238-326,327-399
MTTKRIDRDLPSSDDPSSAKRRIEFPEETLENDGAAAIKLLSLLLQCAEYVATDHLREASTLLSEISEICSPFGSSPERVVAYFAQALQTRVISSYLSGACSPLSEKPLTVVQSQKIFSALQTYNSVSPLIKFSHFTANQAIFQALDGEDSVHIIDLDVMQGLQWPALFHILASRPRKLRSIRITGFGSSSDLLASTGRRLADFASSLNLPFEFHPIEGIIGNLIDPSQLATRQGEAVVVHWMQHRLYDVTGNNLETLEILRRLKPNLITVVEQELSYDDGGSFLGRFVEALHYYSALFDALGDGLGEESGERFTVEQIVLGTEIRNIVAHGGGRRKRMKWKEELSRVGFRPVSLRGNPATQAGLLLGMLPWNGYTLVEENGTLRLGWKDLSLLTASAWKSQPFD

SEQ ID NO: 743 - DNA, 789 bp, Arabidopsis thaliana
  G991,family:IAA
gaaaaatggaagaagaaaagagattggagctaaggctagctcctccttgtcaccaattcacttccaacaacaacatcaatggatctaaacaaaaaagctcgaccaaagaaacatcattcctttccaataacagggttgaggtagctccagtggtgggatggccgccggtgagatcatcccggagaaacctaacggcacaactaaaggaggagatgaagaagaaggagagtgatgaagagaaggaattgtacgttaagatcaacatggaaggagttccaataggaagaaaagtcaacctttcagcttataacaactaccaacagctttcacatgccgttgaccaactcttctctaagaaagattcgtgggatctaaacagacaatacactttggtctacgaagacactgaaggagataaagttctggtcggggatgttccttgggagatgtttgtatctactgtaaagaggttgcatgttttaaagacctcccacgccttctcactctcacctagaaaacatggcaaggaatagagagaggttggccaaaatcatcagttcgatggtttgtttttaatgtaatttttgtggaaactaatggggtttggctttgatttactggttttctttttcacttatgtactaggtttttgcttgctatgttatttcttgttttggttgtaaatatgctgttcgtttaagaaatcgggggttagtatgttatcgtgtgtataaaaatagtgtaagcacgtaagttgattacaaaaaaaaaaaaaaaaaaaaaaaaaaa

SEQ ID NO: 744 - protein, 175 aa, Arabidopsis thaliana
  G991,IAA domain coordinates 7-14,48-59,82-115,128-164
MEEEKRLELRLAPPCHQFTSNNNINGSKQKSSTKETSFLSNNRVEVAPVVGWPPVRSSRRNLTAQLKEEMKKKESDEEKELYVKINMEGVPIGRKVNLSAYNNYQQLSHAVDQLFSKKDSWDLNRQYTLVYEDTEGDKVLVGDVPWEMFVSTVKRLHVLKTSHAFSLSPRKHGKE

SEQ ID NO: 745 - DNA, 1239 bp, Arabidopsis thaliana
  G993,family:AP2
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattctttttttttggtttttttcttcaatttgtttctcctttttcaatattttgtattgaaatgacaagttgtaaattaggacaagacaagaaaaaatgacaactagacaaaatagtttttgtttaaaaaaaaaaaaaaaaaaaa

SEQ ID NO: 746 - protein, 361 aa, Arabidopsis thaliana
  G993,AP2 domain coordinates 69-134,191-290
MEYSCVDDSSTTSESLSISTTPKPTTTTEKKLSSPPATSMRLYRMGSGGSSVVLDSENGVETESRKLPSSKYKGVVPQPNGRWGAQIYEKHQRVWLGTFNEEEEAASSYDIAVRRFRGRDAVTNFKSQVDGNDAESAFLDAHSKAEIVDMLRKHTYADEFEQSRRKFVNGDGKRSGLETATYGNDAVLRAREVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFERSTGPDRQLYIHWKVRSSPVQTVVRLFGVNIFNVSNEKPNDVAVECVGKKRSREDDLFSLGCSKKQAIINIL

SEQ ID NO: 747 - DNA, 1095 bp, Arabidopsis thaliana
  G994,family:MYB-(R1)R2R3
tgtatatatagttagttagttgagataaacttggttaccacttttgtgtggtctttctttttctttttctccattttccatttatcgaccccttgggtgtagctaattactttcgcgattttcaaatccaataaagttttaatttgatgaagctttttttaaaccatataatataaataatgggtggtcgtaaaccatgttgtgatgaggttggattaagaaagggtccatggacagtggaagaagatgggaaactagttgatttcttaagggcacgtggcaactgcggtggtggtggaggaggatggtgctggagagacgtgccaaaactggcggggctaaggaggtgtggcaaaagttgccgtctccggtggactaattatctccggccagatctcaagagaggtctttttactgaagaagaaatccaactagtcattgatcttcatgctcgccttggcaatagatggtcgaagattgcagtggagttaccaggaagaacagacaacgatatcaaaaattattggaacactcatataaagaggaagcttataagaatgggtattgatccaaacacacatcgtcgatttgaccaacaaaaagtcaacgaggaggaaacgatattggtcaacgatccaaagcctctgtctgagaccgaggtatctgttgctttgaagaatgacacgtcagcagtgttatcaggaaatctaaaccaattggctgacgtggacggtgatgatcagccgtggagctttctaatggaaaatgacgaaggaggaggtggcgacgccgccggagagcttacgatgctattgtccggtgacattacgtcatcatgttcttcttcgtcatctttgtggatgaagtatggagaattcggatacgaagatttagaacttggatgtttcgatgtttagagattcaagtatgtttaattaggccgtaggttgattaatcataaggttcattgacttcattctagaattgtgtagttggaccagtataaagaatcaaagttatgaaacattgtaatttgatttccaaattaatctaatgaataaatgtgctttgcaaaaaaaaaaaaaaaaaaaaaaa

SEQ ID NO: 748 - protein, 245 aa, Arabidopsis thaliana
  G994,MYB-(R1)R2R3 domain coordinates 14-123
MGGRKPCCDEVGLRKGPWTVEEDGKLVDFLRARGNCGGGGGGWCWRDVPKLAGLRRCGKSCRLRWTNYLRPDLKRGLFTEEEIQLVIDLHARLGNRWSKIAVELPGRTDNDIKNYWNTHIKRKLIRMGIDPNTHRRFDQQKVNEEETILVNDPKPLSETEVSVALKNDTSAVLSGNLNQLADVDGDDQPWSFLMENDEGGGGDAAGELTMLLSGDITSSCSSSSSLWMKYGEFGYEDLELGCFDV

SEQ ID NO: 749 - DNA, 1082 bp, Arabidopsis thaliana
  G996,family:MYB-(R1)R2R3
cgatcgatcttgaattgattctttgtagtattttatttacatatatatatagatgggaagacattcatgttgttacaaacagaaactgaggaaaggactttggtctcctgaagaagatgagaagcttcttcgttacatcactaagtatggtcatggttgctggagctctgtccctaaacaagctggtttacagagatgtggaaaaagttgtagattaagatggataaattatttaagaccagatttgaagagaggagcattttctcaagatgaagaaaatctcattattgaacttcatgccgttcttggcaatagatggtctcagatagctgcacagcttcctggaagaaccgacaatgaaatcaagaatctttggaattcttgtttgaagaagaaattgaggctgagaggaattgacccggttacacacaagctcttaaccgaaatcgaaaccggtacagatgacaaaacaaaaccggttgagaagagtcaacagacctacctcgttgagactgatggctcctctagtaccactacttgtagtactaaccaaaacaacaacactgatcatctttataccggaaatttcggttttcaacggttaagtctagaaaacggttcaagaatcgcagccggttctgacctcggtatctggattccccaaaccggaagaaaccatcatcatcatgtcgatgaaaccatccctagtgcagtggtactacccggttcaatgttctcatccggtttaaccggttatagatcctccaatctcggtttaattgaattggaaaactcattctcaaccgggccaatgatgacagagcatcagcaaattcaagagagtaactacaacaattcaacattctttggaaatgggaatctgaattggggattaacaatggaggaaaatcaaaatccattcacaatatcgaatcattcaaattcgtccttatacagtgatataaaatcagagaccaatttttttggcacagaggctacaaatgttggtatgtggccatgtaaccagcttcagcctcagcaacatgcatatggccatatataaatcttcttgtatattataa

SEQ ID NO: 750 - protein, 336 aa, Arabidopsis thaliana
  G996,MYB-(R1)R2R3 domain coordinates 14-114
MGRHSCCYKQKLRKGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKKKLRLRGIDPVTHKLLTEIETGTDDKTKPVEKSQQTYLVETDGSSSTTTCSTNQNNNTDHLYTGNFGFQRLSLENGSRIAAGSDLGIWIPQTGRNHHHHVDETIPSAVVLPGSMFSSGLTGYRSSNLGLIELENSFSTGPMMTEHQQIQESNYNNSTFFGNGNLNWGLTMEENQNPFTISNHSNSSLYSDIKSETNFFGTEATNVGMWPCNQLQPQQHAYGHI

SEQ ID NO: 751 - DNA, 913 bp, Arabidopsis thaliana
  G1006,family:AP2
gataaatcaatcaacaaaacaaaaaaaactctatagttagtttctctgaaaatgtacggacagtgcaatatagaatccgactacgctttgttggagtcgataacacgtcacttgctaggaggaggaggagagaacgagctgcgactcaatgagtcaacaccgagttcgtgtttcacagagagttggggaggtttgccattgaaagagaatgattcagaggacatgttggtgtacggactcctcaaagatgccttccattttgacacgtcatcatcggacttgagctgtctttttgattttccggcggttaaagtcgagccaactgagaactttacggcgatggaggagaaaccaaagaaagcgataccggttacggagacggcagtgaaggcgaagcattacagaggagtgaggcagagaccgtgggggaaattcgcggcggagatacgtgatccggcgaagaatggagctagggtttggttagggacgtttgagacggcggaagatgcggctttagcttacgatatagctgcttttaggatgcgtggttcccgcgctttattgaattttccgttgagggttaattccggtgaacctgacccggttcggatcacgtctaagagatcttcttcgtcgtcgtcgtcgtcgtcctcttctacgtcgtcgtctgaaaacgggaagttgaaacgaaggagaaaagcagagaatctgacgtcggaggtggtgcaggtgaagtgtgaggttggtgatgagacacgtgttgatgagttattggtttcataagtttgatcttgtgtgttttgtagttgaatagttttgctataaatgttgaggcaccaagtaaaagtgttcccgtgatgtaaattagttactaaacagagccatatatcttcaatcaaaaaaaaaaaaaaaa

SEQ ID NO: 752 - protein, 243 aa, Arabidopsis thaliana
  G1006,AP2 domain coordinates 113-177
MYGQCNIESDYALLESITRHLLGGGGENELRLNESTPSSCFTESWGGLPLKENDSEDMLVYGLLKDAFHFDTSSSDLSCLFDFPAVKVEPTENFTAMEEKPKKAIPVTETAVKAKHYRGVRQRPWGKFAAEIRDPAKNGARVWLGTFETAEDAALAYDIAAFRMRGSRALLNFPLRVNSGEPDPVRITSKRSSSSSSSSSSSTSSSENGKLKRRRKAENLTSEVVQVKCEVGDETRVDELLVS

SEQ ID NO: 753 - DNA, 923 bp, Arabidopsis thaliana
  G1007,family:AP2
attccttcttgcctaggaactaattgttgcacacttcggtacacaattttttgagcacttcgacatcaaaacgagagagaaaagaatggtggattctcatggctccgacacggaatgttcctccaagaagaaaaaggagaaaacgaaagaaaagggggtatatcgtggggctcgcatgaggagctgggggaaatgggtctcggagattcgggagccccgtaagaaatcaagaatctggctcgggactttccccacggcggagatggcagcgcgtgcccatgatgttgcggcattgagtatcaaaggaagttccgcaatccttaacttccctgagctcgcggattttctgccaagaccagtctcgctcagccaacaggatatccaggccgcagccgccgaagccgctcttatggatttcaaaactgtaccattccatcttcaggatgactcaacgccgttgcaaactaggtgtgatactgagaagatcgaaaagtggtcatcctcatcgtcctcagcctcatcctcatcctcatcttcgtcctcgtcctcatcatctatgctttcgggggagctaggagatattgtggagttgccgagtcttgaaaacaatgtaaaatacgattgtgcgctgtatgactcgttggaggggctggtgtcgatgcccccatggttagatgctaccgaaaatgattttaggtatggagatgattcggtactgttggacccatgtctcaaagaaagctttttgtggaattatgagtaaggtttttttttggaaagaaatgtggttttttgtttcctcctctcttttatactttcgatctttttttctaagcatatatatcttctacatatgtaatacttttccattagtaaacaatgattcggtttcgggtacaaaaaaaaaaaaaaaaaaaaaaaaa

SEQ ID NO: 754 - protein, 225 aa, Arabidopsis thaliana
  G1007,AP2 domain coordinates 23-90
MVDSHGSDTECSSKKKKEKTKEKGVYRGARMRSWGKWVSEIREPRKKSRIWLGTFPTAEMAARAHDVAALSIKGSSAILNFPELADFLPRPVSLSQQDIQAAAAEAALMDFKTVPFHLQDDSTPLQTRCDTEKIEKWSSSSSSASSSSSSSSSSSSSMLSGELGDIVELPSLENNVKYDCALYDSLEGLVSMPPWLDATENDFRYGDDSVLLDPCLKESFLWNYE

SEQ ID NO: 755 - DNA, 803 bp, Arabidopsis thaliana
  G1011,family:MADS
cttgtttagggtttcaatctttacagatcttgtggcagaaaaaatcaagtcaaagcaagaaaaatggttagaggaaagatagagatgaagaaaatagaaaacgcaacgagtagacaagtgactttctcaaaaagaagaaatggtttgttgaagaaagcttatgagctctcagtactctgcgatgctcaactctctctcatcatcttctcccagagaggaaggctttatgaattctctagctctgatatgcagaagacgatcgaacgctaccgcaagtacacaaaagatcatgaaaccagcaatcacgactcacaaattcacttgcagcaattgaaacaagaagcaagccacatgataacaaagattgaactccttgagtttcacaagcggaagctattgggacaaggaattgcttcttgttctctagaagagcttcaagaaatcgatagtcaactccaaagaagtctgggaaaggtccgagaaagaaaggctcaattgttcaaggagcagttggagaaactaaaagcaaaggagaaacaattgttagaagagaacgtcaagttacatcaaaagaatgttattaatccatggagaggatcatcgactgatcagcagcaagagaaatacaaagttatagatttgaatttggaagttgaaactgacttattcatcggtttgccaaatagaaactgctagtaacattatataatatgtttatttatttatcatgaaatattcaaaatcattcaataaattgtgaggtaatgatttgggatagtaaaaaaaaaaaaaaaaaaaaaaaa

SEQ ID NO: 756 - protein, 210 aa, Arabidopsis thaliana
  G1011,MADS domain coordinates 2-57
MVRGKIEMKKIENATSRQVTFSKRRNGLLKKAYELSVLCDAQLSLIIFSQRGRLYEFSSSDMQKTIERYRKYTKDHETSNHDSQIHLQQLKQEASHMITKIELLEFHKRKLLGQGIASCSLEELQEIDSQLQRSLGKVRERKAQLFKEQLEKLKAKEKQLLEENVKLHQKNVINPWRGSSTDQQQEKYKVIDLNLEVETDLFIGLPNRNC

SEQ ID NO: 757 - DNA, 476 bp, Arabidopsis thaliana
  G1012,family:WRKY
aacacacaattcgttgattcatcatatctcctcttcattaatgaatggcctcgtcgactcttctcgagataagaagatgaaaaatccgcgattttcgtttcgcacaaagagtgatgcagatattctcgatgatggttatcgatggagaaagtacggtcagaaatccgtcaagaacagcttgtatcccaggagctattatagatgcacacaacacatgtgtaacgtgaagaagcaagttcagaggctgtcgaaggagacgagcattgtggagacaacttatgaaggaatccataaccatccttgtgaggagctcatgcaaaccctaactcctcttcttcatcaattgcagttcctctctaagttcacctaattatgtttgtatatatattaacgttctaagagcatctccaatggaagtatctcaatgagatacctaacaaaagaaaaaaaatttaaaaaaaaaaaaaaaaaaaaaa

SEQ ID NO: 758 - protein, 109 aa, Arabidopsis thaliana
  G1012,WRKY domain coordinates 30-86
MNGLVDSSRDKKMKNPRFSFRTKSDADILDDGYRWRKYGQKSVKNSLYPRSYYRCTQHMCNVKKQVQRLSKETSIVETTYEGIHNHPCEELMQTLTPLLHQLQFLSKFT

SEQ ID NO: 759 - DNA, 825 bp, Arabidopsis thaliana
  G1013,family:WRKY
atggaagaagaaggttatcagtgggcaagaaggtgtggaaacaacgccgttgaagatccttttgtttatgagccacctcttttctttctgcctcaagaccaacatcatatgcatgggctcatgccaaatgaagatttcattgccaacaagttcgtcacatcaacactttactccggtccacgaatccaagatattgcaaacgctctggccttggtcgaacccctgacccacccagtccgagaaatctctaaatcaacagttcctcttttggaaagaagtactttgagcaaggtggataggtacactttaaaggtgaagaacaatagtaatggaatgtgtgatgatggatacaaatggagaaaatatggccaaaaatcaatcaaaaatagccctaacccaaggagttattacaagtgcacaaacccaatatgcaatgcaaagaagcaagtggagagatcaattgatgagtctaacacatatatcattacctacgaaggtttccacttccactatacttaccctttcttcctacccgataagacacgtcaatggcccaataaaaaaacgaaaatacataaacataatgctcaagatatgaacaaaaaatctcaaacccaagaagagagcaaagaagcacaattaggtgagctcaccaaccaaaatcatccagtcaataaagcccaagaaaacacaccggcaaatctcgaagagggattgttttttccggttgatcagtgtcggccgcaacaagggcttctagaagatgtggtagctccggcaatgaaaaatattcctaccagggacagtgttttgacagcttcttga

SEQ ID NO: 760 - protein, 274 aa, Arabidopsis thaliana
  G1013,WRKY domain coordinates 114-170
MEEEGYQWARRCGNNAVEDPFVYEPPLFFLPQDQHHMHGLMPNEDFIANKFVTSTLYSGPRIQDIANALALVEPLTHPVREISKSTVPLLERSTLSKVDRYTLKVKNNSNGMCDDGYKWRKYGQKSIKNSPNPRSYYKCTNPICNAKKQVERSIDESNTYIITYEGFHFHYTYPFFLPDKTRQWPNKKTKIHKHNAQDMNKKSQTQEESKEAQLGELTNQNHPVNKAQENTPANLEEGLFFPVDQCRPQQGLLEDVVAPAMKNIPTRDSVLTAS

SEQ ID NO: 761 - DNA, 2126 bp, Arabidopsis thaliana
  G1017,family:ARF
gaatttgggggttacacaacttcgtctagatggagcaagagaaaagcttggatccacaactatggcatgcttgtgcaggatcaatggttcaaatcccttcactgaattcaacggttttttacttcgctcaaggccacacagagcacgctcacgcgcctcctgattttcacgcgccgcgcgttccacctcttatcctctgtcgtgtcgtctccgtgaagttcctcgccgacgctgaaacagacgaagtttttgctaaaattacgcttttgccacttccgggaaacgacttggatctagaaaacgacgccgttttgggtctaactcctccttcttctgacggtaacggtaacggtaaagagaaaccggcgtctttcgctaaaacgttaacgcagtctgacgctaataacggcggtggtttctccgttccacgttattgcgccgagacgattttcccgcggcttgattactcggcggagccaccggttcaaaccgtgattgctaaagacatccacggcgagacttggaaattccggcatatttacagaggaacacctcgccgtcatctcctaaccaccggttggagcactttcgttaaccagaagaaactaatcgccggagactcaatcgtcttcctccgttctgaatccggtgacctctgcgtcggaatccgccgcgctaaacgcggcggtctcggatctaacgcaggatccgacaatccttaccctggattctccggtttcctccgtgacgacgagtcaacaacaacaacatcgaagctaatgatgatgaaacgcaacggaaacaacgacggaaacgccgcggctacagggagggttagagtagaagcagtagcggaagcggtggcgcgtgcagcgtgtggacaagcgtttgaggttgtttattatccacgcgctagtacaccggagttttgcgtaaaagcagctgatgttagatcagcaatgaggataagatggtgtagtggtatgcgttttaaaatggcgtttgaaacagaggattcttctagaatcagttggtttatgggtactgtctccgccgttcaagtcgctgatccaattcgttggcctaattcaccatggcgtctccttcaggtagcttgggacgaaccggatttgttacaaaacgttaagcgggttagtccgtggttagtcgaattggtatcgaacatgcctacaatacatttatctccattctctccgaggaagaagattaggattccgcagccatttgagtttccattccacggtactaaattcccgattttctccccgggattcgccaacaatggcggtggcgagtccatgtgttatctgtcaaacgacaacaataatgctcctgcaggaatacagggagccaggcaagctcaacaactcttcggatcaccatctccgtctttgttgtctgatctcaatcttagtagttacaccggtaacaacaagttacattctccggcgatgtttctatcgagtttcaacccgaggcatcatcattatcaggctagggatagtgagaatagtaataacatttcgtgttctttaactatggggaatcctgctatggttcaggataagaagaagtctgttggttcggttaagactcatcagttcgtgttgttcggtcaaccgattttaaccgaacagcaagttatgaaccgaaaacggtttttggaagaagaggcggaagcggaggaggagaaaggtttagtggctcgtgggttaacatggaattatagtttgcaaggacttgagacgggtcattgtaaagttttcatggaatctgaggatgttggacgcacactcgatctctcggttattggctcgtaccaagaattgtaccggaaattggctgagatgtttcatatagaagagaggtcggatttgttgactcatgttgtgtaccgggatgcaaatggtgttatcaaacgtattggagacgaacctttcagtgatttcatgaaagcaactaaacggctaacaatcaagatggatattggtggcgacaacgtgagaaagacgtggataaccggaatcaggactggtgaaaatggtatagacgcttctacgaagactggtccgctcagcatcttcgcttgaacttgaagcatattg

SEQ ID NO: 762 - protein, 693 aa, Arabidopsis thaliana
  G1017,ARF domain coordinates 9-382
MEQEKSLDPQLWHACAGSMVQIPSLNSTVFYFAQGHTEHAHAPPDFHAPRVPPLILCRVVSVKFLADAETDEVFAKITLLPLPGNDLDLENDAVLGLTPPSSDGNGNGKEKPASFAKTLTQSDANNGGGFSVPRYCAETIFPRLDYSAEPPVQTVIAKDIHGETWKFRHIYRGTPRRHLLTTGWSTFVNQKKLIAGDSIVFLRSESGDLCVGIRRAKRGGLGSNAGSDNPYPGFSGFLRDDESTTTTSKLMMMKRNGNNDGNAAATGRVRVEAVAEAVARAACGQAFEVVYYPRASTPEFCVKAADVRSAMRIRWCSGMRFKMAFETEDSSRISWFMGTVSAVQVADPIRWPNSPWRLLQVAWDEPDLLQNVKRVSPWLVELVSNMPTIHLSPFSPRKKIRIPQPFEFPFHGTKFPIFSPGFANNGGGESMCYLSNDNNNAPAGIQGARQAQQLFGSPSPSLLSDLNLSSYTGNNKLHSPAMFLSSFNPRHHHYQARDSENSNNISCSLTMGNPAMVQDKKKSVGSVKTHQFVLFGQPILTEQQVMNRKRFLEEEAEAEEEKGLVARGLTWNYSLQGLETGHCKVFMESEDVGRTLDLSVIGSYQELYRKLAEMFHIEERSDLLTHVVYRDANGVIKRIGDEPFSDFMKATKRLTIKMDIGGDNVRKTWITGIRTGENGIDASTKTGPLSIFA

SEQ ID NO: 763 - DNA, 813 bp, Arabidopsis thaliana
  G1020,family:AP2
ctgttcacaagaaagctccccaaaaggagcgttgctttactctcctataaaaagaagctcttctacttcttctcgttaccacaaaactctttcaccgatcttctcgttccattcttcttcctaattacaccatgcccaacatcaccatgggtttgaaacccgacccggttgctccaacgaacccgactcatcatgagagtaatgctgccaaagagattcgttacagaggcgttaggaaacgtccatggggaagatacgccgctgagatccgagatccggttaagaaaactcgagtctggctcggtacgttcgacaccgctcagcaggcggcgcgtgcttacgacgcagccgcgcgtgactttcgtggtgttaaggctaagaccaatttcggtgttatcgttggtagtagtcctactcagagtagcaccgtcgtcgactctcccacggcggcacggtttataacacctccgcacctcgagctcagcttaggcggcggcggcgcgtgtcgtcgtaagatcccgcttgtgcatccggtttactactataacatggcgacgtatccaaagatgacgacgtgtggtgtccagagcgagtctgaaacgtcgtcggtcgttgatttcgaaggtggagctgggaagatatctccgccgttagatctggatcttaacttagctcctccggcggaataggccgtgagttttttttttcttatgtcgtttctttagacaaaaaaaaataacgtttcctttttttttctgcctaagaaaaaaatattatccgttttttagaagaaaaaaaaaaaaaaaaaaaaaa

SEQ ID NO: 764 - protein, 185 aa, Arabidopsis thaliana
  G1020,AP2 domain coordinates 28-95
MPNITMGLKPDPVAPTNPTHHESNAAKEIRYRGVRKRPWGRYAAEIRDPVKKTRVWLGTFDTAQQAARAYDAAARDFRGVKAKTNFGVIVGSSPTQSSTVVDSPTAARFITPPHLELSLGGGGACRRKIPLVHPVYYYNMATYPKMTTCGVQSESETSSVVDFEGGAGKISPPLDLDLNLAPPAE

SEQ ID NO: 765 - DNA, 1693 bp, Arabidopsis thaliana
  G1023,family:AP2
tcgtcttcttaatcgctttctgctctgtttttctcgttcatcaagctacatctactagctctctcagtgattgatttctcacagtttcatcgatttccatgcgtttaagacctaaaaggacttgttctggggtaaaggacttttcttgttcttgagagagttcattttgaggcttttctgggaattttgagaggttttttagggtttaagggggtttggttttgaatttcgcacaccaagtgttcgataaaatggctgaacgaaagaaacgctcttctattcaaaccaataaacccaacaaaaaacccatgaagaagaaaccttttcagctaaatcacctcccaggtttatctgaagatttgaagactatgagaaaactccgtttcgttgtgaatgatccttacgctactgactactcatcaagcgaagaagaagaaaggagtcagagaaggaaacgttatgtctgtgagatcgatcttcctttcgctcaagctgctactcaagcagaatctgaaagctcatattgtcaggagagtaacaataatggtgtaagcaagactaaaatctcagcttgtagcaaaaaggttttacgcagcaaagcatctccggtcgttggacgttcttctactactgtctcgaagcctgttggtgttaggcagaggaaatggggtaaatgggctgctgagattagacatccaatcaccaaagtaagaacttggttgggtacttacgagacgcttgaacaagcagctgatgcttatgctaccaagaagcttgagtttgatgctctggctgcagccacttctgctgcttcctctgttttgtcaaatgagtctggttctatgatctcagcctcagggtcaagcattgatcttgacaagaagctagttgattcgactcttgatcaacaagctggtgaatcgaagaaagcgagttttgatttcgactttgcagatctacagattcctgaaatgggttgcttcattgatgactcattcatcccaaatgcttgtgagcttgattttctcttaacagaagagaacaacaaccaaatgttggatgattactgtggcatagatgatctggacatcattggtcttgaatgtgacggtccaagcgaacttccagactatgatttctcagatgtggagatcgatcttggtctcattggaaccaccattgacaagtatgctttcgttgatcatatcgcaacaactactcccactcctcttaatatcgcgtgcccataagttttgcagctaggtgttattattagctataggagcaacgtaaaaagctcgttgttactcggttttgtcttaagttattaaagtatagcagaggcagttaatctcaagggaagcaaaaaccctaaagatagaagcagatgcagttttgtgtgttggtgttactaaagaaagttttgttgacataatggttttgatgttgtggagaagatagagaggtgtgatcgaaattgtaaatctcaggtggttttttttgaaggcaattgtttctcatttagggtttttttctatatgaggattgtctttgaaaagcctttagatgttttctaattcgtaagctctctcaatctttgtaagttttgcctgttgagttattgatacatatgtgagacctactttatttgttttgtgctacatacattgttgatggtttcgtcaaaaaaaaa

SEQ ID NO: 766 - protein, 332 aa, Arabidopsis thaliana
  G1023,AP2 domain coordinates 128-196
MAERKKRSSIQTNKPNKKPMKKKPFQLNHLPGLSEDLKTMRKLRFVVNDPYATDYSSSEEEERSQRRKRYVCEIDLPFAQAATQAESESSYCQESNNNGVSKTKISACSKKVLRSKASPVVGRSSTTVSKPVGVRQRKWGKWAAEIRHPITKVRTWLGTYETLEQAADAYATKKLEFDALAAATSAASSVLSNESGSMISASGSSIDLDKKLVDSTLDQQAGESKKASFDFDFADLQIPEMGCFIDDSFIPNACELDFLLTEENNNQMLDDYCGIDDLDIIGLECDGPSELPDYDFSDVEIDLGLIGTTIDKYAFVDHIATTTPTPLNIACP

SEQ ID NO: 767 - DNA, 874 bp, Arabidopsis thaliana
  G1033,family:HMG
tttttcttttgattctgcttttttccgctaggtttctgagatcttccattcgtctcgaattaagttgctacgatgaaaacagcaaaggggaaagataaagttaagaccacaaaggaagccttgaagccagttgatgacagaaaggtgggaaagaggaaggcaccggctgagaagcctactaaacgagagactcgtaaagagaagaaggctaaaaaggacccaaacaaaccaaaaagagctcctagtgccttctttgtctttctagaagattttagggtcacgttcaagaaagaaaatccaaatgtgaaggccgtctctgctgttgggaaagctggagggcagaaatggaagtcaatgtctcaagctgaaaaagctccatatgaagagaaagctgcaaaaaggaaagctgaatatgagaagcaaatggatgcatacaacaaaaacttggaggaagggagtgatgaatctgaaaagtctagatctgagataaatgatgaagatgaagccagtggggaggaagaactattagagaaggaagcggcaggtgatgatgaagaagaagaagaggaagaagatgtcgatgatgatgacgacgaggaagaagactaaatcagggatagaaatcagattttgtatctcaagcttaactgcagatccttaagcagaagtaagtattttgtaatttgtgtgtggacgagaactatagatctaaaatcgtgtgtttttttgtttttcttttcctaagaaagcgaaacagttgttagcatctctcaggatgtctgtttcagctttttgccgcaacaaacaatgtatcaatgtctgcgttagtgatcatccaaaccaaaacataaactaatgaacatataaaaaaaaa

SEQ ID NO: 768 - protein, 178 aa, Arabidopsis thaliana
  G1033,HMG domain coordinates 49-121
MKTAKGKDKVKTTKEALKPVDDRKVGKRKAPAEKPTKRETRKEKKAKKDPNKPKRAPSAFFVFLEDFRVTFKKENPNVKAVSAVGKAGGQKWKSMSQAEKAPYEEKAAKRKAEYEKQMDAYNKNLEEGSDESEKSRSEINDEDEASGEEELLEKEAAGDDEEEEEEEDVDDDDDEEED

SEQ ID NO: 769 - DNA, 1722 bp, Arabidopsis thaliana
  G1037,family:GARP
atgactgttgaacaaaatttagaagctttggatcagtttcctgtaggaatgagagttcttgctgttgatgatgaccaaacttgtctcaaaatccttgaatctctccttcgtcactgccaataccatgtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataatgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatccgaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagaaggctatgcctaaaaagattttggatctgatgaatgttgagaagctcactagagaaaatgtggccagtcatcttcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatagctcttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtga

SEQ ID NO: 770 - protein, 573 aa, Arabidopsis thaliana
  G1037,GARP domain coordinates 11-134,200-248
MTVEQNLEALDQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVRSRFDKNRGSNNNGDKRDGSGNEGVGNSDPNNGKGNRKRKDQYNEDEDEDRDDNDDSCAQKKQRVVWTVELHKKFVAAVNQLGYEKAMPKKILDLMNVEKLTRENVASHLQKFRLYLKRISGVANQQAIMANSELHFMQMNGLDGFHHRPIPVGSGQYHGGAPAMRSFPPNGILGRLNSSSGIGVRSLSSPPAGMFLQNQTDIGKFHHVSSLPLNHSDGGNILQGLPMPLEFDQLQTNNNKSRNMNSNKSIAGTSMAFPSFSTQQNSLISAPNNNVVVLEGHPQATPPGFPGHQINKRLEHWSNAVSSSTHPPPPAHNSNSINHQFDVSPLPHSRPDPLEWNNVSSSYSIPFCDSANTLSSPALDTTNPRAFCRNTDFDSNTNVQPGVFYGPSTDAMALLSSSNPKEGFVVGQQKLQSGGFMVADAGSLDDIVNSTMKQV

SEQ ID NO: 771 - DNA, 2031 bp, Arabidopsis thaliana
  G1038,family:GARP
gctcgttttcaaattaaaaacagggagaaatttggaaattccagtacgacgggagataaaacctaacatacgccatggtgaccgttatctaaactacgccaaaatatttgaagtgtcgtcgtttcataataaaacgcaaacaaaaacccactcccactttctcctttccaaaaaaagaactctcgccactttctctgctcttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataatgatgtcggtggacggcgaaacaagccgagtgatgaagggagtgcacacgggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacaaagctggtcccaagaagatattggatctcatgaatgttccatggctcactagagaaaatgttgcaagccaccttcagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgaccccaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaatttctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaaggcgattctgaagaagcttgaactggggaacttccagaatcacatcattctgtttctttagacactgacttagacttgacttggcttcaaggcgagcgtttcttgcaaacaccgactccagtttcaagatacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaattacaccaaacaggttgatgacagtgataaggccacatgtttcacaccgtcgcttaagatctttactgtcacctggaaggaaa

SEQ ID NO: 772 - protein, 444 aa, Arabidopsis thaliana
  G1038,GARP domain coordinates 198-247
MEKSGFSPVGLRVLVVDDDPTWLKILEKMLKKCSYEVTTCGLAREALRLLRERKDGYDIVISDVNMPDMDGFKLLEHVGLELDLPVIMMSVDGETSRVMKGVHTGACDYLLKPIRMKELKIIWQHVLRKKLQEVRDIEGCGYEGGADWITRYDEAHFLGGGEDVSFGKKRKDFDFEKKLLQDESDPSSSSSKKARVVWSFELHHKFVNAVNQIGCDHKAGPKKILDLMNVPWLTRENVASHLQKYRLYLSRLEKGKELKCYSGGVKNADSSPKDVEVNSGYQSPGRSSYVFSGGNSLIQKATEIDPKPLASASLSDPNTDVIMPPKTKKTRIGFDPPISSSAFDSLLPWNDVPEVLESKPVLYENSFLQQQPLPSQSSYVAISAPSLMEEEMKPPYETPAGGSSVNADEFLMPQDKIPTVTLQDLDPSAMKLQEFNTEGDSEEA

SEQ ID NO: 773 - DNA, 1057 bp, Arabidopsis thaliana
  G1040,family:GARP
ctttgatctccactatttaagtagacaagaatcataaagaaaatagtgagatgatgatgttagagtcaagaaacagtatgagagcttcaaactcagtcccagatctgtctcttcagatcagtcttcctaactatcacgccggaaaacctcttcacggcggtgaccggagctccacaagcagtgattctggaagcagcctcagtgacctgagccatgagaacaacttcttcaacaaacctctcttgagcttaggatttgaccatcatcatcaaaggcgctcaaacatgttccaacctcaaatctacggtcgagatttcaagagaagctcatcatcaatggttggtcttaaacgaagcattcgtgctccaagaatgagatggacttctactcttcatgctcacttcgtccatgctgttcaacttcttggcggccatgaaagagcaacgcctaaatcagtgttggagctcatgaatgtgaaggatctaaccctagctcatgtcaagagtcacttgcagatgtatagaacagtgaaatgcactgataaaggatcaccaggagaaggaaaggtagagaaagaggcagagcagaggatagaggacaataataataatgaagaagctgatgaaggaactgacacaaattcgccaaactcatcatctgtgcaaaagacccaaagagcttcatggtcatcgacaaaggaagtatctaggagcatatctacacaagcatattctcacttgggaacaactcatcacactaaggccaatgaagagaaagaggataccaacattcatctcaatttggatttcacattgggcggcctagttgggggatggaatatgcggaaccctccagtgatttaacccttctcaagtgctaattgccttaagctacaacaaataagtcagcttaggttaccagttttaacataattttaacttgttttgatcatatgagcttcggaagaatcatattatcatcatatatgaacttctttccaagaatgttctatgagttttttgatatgtataatcaagagaatcgtttgaagtaaaaa

SEQ ID NO: 774 - protein, 270 aa, Arabidopsis thaliana
  G1040,GARP domain coordinates 109-158
MMMLESRNSMRASNSVPDLSLQISLPNYHAGKPLHGGDRSSTSSDSGSSLSDLSHENNFFNKPLLSLGFDHHHQRRSNMFQPQIYGRDFKRSSSSMVGLKRSIRAPRMRWTSTLHAHFVHAVQLLGGHERATPKSVLELMNVKDLTLAHVKSHLQMYRTVKCTDKGSPGEGKVEKEAEQRIEDNNNNEEADEGTDTNSPNSSSVQKTQRASWSSTKEVSRSISTQAYSHLGTTHHTKANEEKEDTNIHLNLDFTLGGLVGGWNMRNPPVI

SEQ ID NO: 775 - DNA, 1099 bp, Arabidopsis thaliana
  G1043,family:WRKY
aaataagataccactcaccaaaaacttcctcaaaactaacaaatggatactaataaagcaaaaaagcttaaagttatgaaccaactcgttgaaggccatgacttaacaactcagcttcagcaactcctctctcaacccgggtccggtctagaggatctagtggctaaaatcttagtgtgtttcaataacaccatctccgttcttgataccttcgaacccatctcctcctcctcatccctcgccgccgttgagggatctcaaaatgcttcatgtgataacgacggcaagtttgaagattccggcgatagtcggaaaagattgggacccgttaagggtaaaagaggatgctacaaaagaaaaaagagatcggagacgtgtactatagagtcgactatacttgaggacgcattttcttggaggaaatatggacaaaaggagattcttaatgccaaattcccaagaagttactttagatgcacacacaagtatacccaagggtgcaaggcaacaaagcaagtccagaaggttgagctcgaacccaagatgttcagtatcacatacataggaaaccacacgtgtaacaccaacgcagaaactcccaagagcaagacttgtgaccatcatgatgagatcttcatggattccgaagatcacaagagtcctagtttatctacctcaatgaaggaagaagacaatcctcatcgtcatcatggttcgtccacggagaatgacttgtcattggtgtggccagaaatggttttcgaagaagattatcatcatcaggccagttacgtcaatgggaaaacgagtacatctatcgatgttttgggttctcaggatctcatggtgtttggaggtggcggcgatttcgagtttagcgaaaatgagcacttctctatcttcagttcatgttcgaatctatcttgagtttaccactactataggactaagaccatgagttttaatcattaattaggccatgtagagtggaaaacatataatacatattttgcccttttctctaatgagtgtatgtactgtacatatagtactataaataaaactcttgctggattaaaacaaaaaaaaaaaaaaaaaa

SEQ ID NO: 776 - protein, 294 aa, Arabidopsis thaliana
  G1043,WRKY domain coordinates 120-179
MDTNKAKKLKVMNQLVEGHDLTTQLQQLLSQPGSGLEDLVAKILVCFNNTISVLDTFEPISSSSSLAAVEGSQNASCDNDGKFEDSGDSRKRLGPVKGKRGCYKRKKRSETCTIESTILEDAFSWRKYGQKEILNAKFPRSYFRCTHKYTQGCKATKQVQKVELEPKMFSITYIGNHTCNTNAETPKSKTCDHHDEIFMDSEDHKSPSLSTSMKEEDNPHRHHGSSTENDLSLVWPEMVFEEDYHHQASYVNGKTSTSIDVLGSQDLMVFGGGGDFEFSENEHFSIFSSCSNLS

SEQ ID NO: 777 - DNA, 715 bp, Arabidopsis thaliana
  G1047,family:bZIP
caattttaaaccggtcattatgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttgaaagaaaaaaaaa

SEQ ID NO: 778 - protein, 227 aa, Arabidopsis thaliana
  G1047,bZIP domain coordinates 129-180
MMSTVPAFTFTEPGLVNQLSDFQTGFTPWELNCSDLFSTIHLEPVVPSPCSGESDAGSVKINTDFNGFDESCIGSIKTNSGSDDSNLFHGVPSPQSDELDSKNTKIRSNATNHNRNKLNRSVLQVTDDRKRKRMESNRESAKRSRMRKQRHIDNLKDEANRLGLENRELANRLRIVLYNIALMCTDNNQLLSEQEILRRRFLEMRQILIFRQLQLNPSLIINHHHMI

SEQ ID NO: 779 - DNA, 1035 bp, Arabidopsis thaliana
  G1048,family:bZIP
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctctctcttgttttgtatttcgctgttgaaagttttctgtctaatatcgataagttaacagtgaaaaaaaaaaaaaaaaa

SEQ ID NO: 780 - protein, 295 aa, Arabidopsis thaliana
  G1048,bZIP domain coordinates 138-190
MAEEFGSIDLLGDEDFFFDFDPSIVIDSLPAEDFLQSSPDSWIGEIENQLMNDENHQEESFVELDQQSVSDFIADLLVDYPTSDSGSVDLAADKVLTVDSPAAADDSGKENSDLVVEKKSNDSGSEIHDDDDEEGDDDAVAKKRRRRVRNRDAAVRSRERKKEYVQDLEKKSKYLERECLRLGRMLECFVAENQSLRYCLQKGNGNNTTMMSKQESAVLLLESLLLGSLLWLLGVNFICLFPYMSHTKCCLLRPEPEKLVLNGLGSSSKPSYTGVSRRCKGSRPRMKYQILTLAA

SEQ ID NO: 781 - DNA, 725 bp, Arabidopsis thaliana
  G1049,family:bZIP
ctaactttcttcccaagtaaacttcaaaatgcagccgcaaacagacgttttcagcctccataactacctaaactcatcgatactgcagtctccgtatccttctaatttcccgatatctacgccatttccaaccaacggtcaaaacccgtacctcctctacggattccaaagccctacaaacaatccacaatccatgagcctaagcagcaacaactcaacatcagatgaagcagaagagcagcagacgaacaacaatataatcaacgagcggaagcagagaaggatgatttcaaaccgagaatccgcaaggagatcgcgtatgaggaagcaaagacaccttgacgagctttggtcacaagtgatgtggttaaggatcgagaatcatcagttgcttgataagcttaacaatctctctgagtctcacgacaaggttcttcaagagaatgctcagcttaaagaagaaacatttgagcttaagcaagtgatcagcgatatgcaaattcaaagccctttctcttgctttagagacgatataatccccattgaataaagcatttttccccgattcatatttatgaaaattttcttcaagagtatgtttctttgtatgtatatgtggagatgtatttcagggttttgataatatgaccctttacgacgacgtttttagattgtagtaaatttataaactaaagaagattagtgttaatgaagaacaaatataa

SEQ ID NO: 782 - protein, 173 aa, Arabidopsis thaliana
  G1049,bZIP domain coordinates 77-132
MQPQTDVFSLHNYLNSSILQSPYPSNFPISTPFPTNGQNPYLLYGFQSPTNNPQSMSLSSNNSTSDEAEEQQTNNNIINERKQRRMISNRESARRSRMRKQRHLDELWSQVMWLRIENHQLLDKLNNLSESHDKVLQENAQLKEETFELKQVISDMQIQSPFSCFRDDIIPIE

SEQ ID NO: 783 - DNA, 1766 bp, Arabidopsis thaliana
  G1050,family:bZIP
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtggtaatggaggactttctttctggacca

SEQ ID NO: 784 - protein, 519 aa, Arabidopsis thaliana
  G1050,bZIP domain coordinates 372-425
MGGGGDTTDTNMMQRVNSSSGTSSSSIPKHNLHLNPALIRSHHHFRHPFTGAPPPPIPPISPYSQIPATLQPRHSRSMSQPSSFFSFDSLPPLNPSAPSVSVSVEEKTGAGFSPSLPPSPFTMCHSSSSRNAGDGENLPPRKSHRRSNSDVTFGFSSMMSQNQKSPPLSSLERSISGEDTSDWSNLVKKEPREGFYKGRKPEVEAAMDDVFTAYMNLDNIDVLNSFGGEDGKNGNENVEEMESSRGSGTKKTNGGSSSDSEGDSSASGNVKVALSSSSSGVKRRAGGDIAPTGRHYRSVSMDSCFMGKLNFGDESSLKLPPSSSAKVSPTNSGEGNSSAYSVEFGNSEFTAAEMKKIAADEKLAEIVMADPKRVKRILANRVSAARSKERKTRYMAELEHKVQTLQTEATTLSAQLTHLQRDSMGLTNQNSELKFRLQAMEQQAQLRDALSEKLNEEVQRLKLVIGEPNRRQSGSSSSESKMSLNPEMFQQLSISQLQHQQMQHSNQCSTMKAKHTSND

SEQ ID NO: 785 - DNA, 1291 bp, Arabidopsis thaliana
  G1051,family:bZIP
cctgtaaattcagatttgctttctttggtaatcttttggatcaagatccatctattttttcttcaatggcacaactccctcctaaaatccccaacatgacacaacattggcctgatttctcttcccaaaagctctctcctttctctaccccaaccgcaaccgctgtcgccaccgctacaaccaccgtacaaaacccctcatgggtcgacgaattcctcgacttctcagcgtctcgccgtggcaaccaccgtcgttccatcagcgactctatcgcattcctcgaagctccaacagtcagcatcgaagaccaccaattcgacaggttcgatgacgaacagttcatgtcgatgttcaccgacgacgacaaccttcatagcaatccttcccatatcaacaacaaaaataacaatgtggggcccacgggatcttcctcgaacacatccacgccgtccaatagcttcaacgacgataacaaagaattaccaccgtccgatcataacatgaacaataatatcaacaacaactataacgatgaagtccaaagccaatgcaagatggagccagaagatggtacggcgtcgaataacaattccggtgatagctccggcaaccggattctcgatcccaaaagggttaagagaatattagcaaatcggcaatcagcacagagatcaagggtgaggaaactgcaatacatatcagagctcgaacgtagcgtcacttcgttgcaggcggaagtgtcagtgttatcgccaagagttgcattcttggatcatcaacgtttgcttcttaacgttgacaacagcgctctcaagcaacgaatcgctgctttatctcaagacaagcttttcaaagacgcacatcaagaagcattgaagagagaaatagagagacttcgacaagtgtataatcaacaaagcctcacgaatgtggaaaatgcaaatcatttatcggcgaccggagccggtgctactccggccgtcgacatcaagtcgtccgttgaaacagagcagctcctcaatgtctcataaattaaccatcatgcatcatcatcaacatttctctcttttagcttcttggcaaaagttcttgactataaaatctctttcgggtaagaaattcaggagatatacattttttattctaatcacattgtttttaagttgtgatgaattcagtttgatgtatcttatttattttgtttatgtcgtctttttttcttggggttgatggaagggaatcatcaattgttgtttgtacaaagaactagttgaatttttttttttttttt

SEQ ID NO: 786 - protein, 321 aa, Arabidopsis thaliana
  G1051,bZIP domain coordinates 189-250
MAQLPPKIPNMTQHWPDFSSQKLSPFSTPTATAVATATTTVQNPSWVDEFLDFSASRRGNHRRSISDSIAFLEAPTVSIEDHQFDRFDDEQFMSMFTDDDNLHSNPSHINNKNNNVGPTGSSSNTSTPSNSFNDDNKELPPSDHNMNNNINNNYNDEVQSQCKMEPEDGTASNNNSGDSSGNRILDPKRVKRILANRQSAQRSRVRKLQYISELERSVTSLQAEVSVLSPRVAFLDHQRLLLNVDNSALKQRIAALSQDKLFKDAHQEALKREIERLRQVYNQQSLTNVENANHLSATGAGATPAVDIKSSVETEQLLNVS

SEQ ID NO: 787 - DNA, 1304 bp, Arabidopsis thaliana
  G1052,family:bZIP
tgatcatctaaaactttcaatttctctcttgatcctcacttgaattttttgttgtttctctcaaatctttgatcctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaagaaattaatttatcaaagaagatggccttttttatttgatctaatcacatttttttaagttgtgatgaatttgcttttgatgtatctgtttttttttttttttttt

SEQ ID NO: 788 - protein, 329 aa, Arabidopsis thaliana
  G1052,bZIP domain coordinates 201-261
MAQLPPKIPTMTTPNWPDFSSQKLPSIAATAAAAATAGPQQQNPSWMDEFLDFSATRRGTHRRSISDSIAFLEPPSSGVGNHHFDRFDDEQFMSMFNDDVHNNNHNHHHHHSINGNVGPTRSSSNTSTPSDHNSLSDDDNNKEAPPSDHDHHMDNNVANQNNAAGNNYNESDEVQSQCKTEPQDGPSANQNSGGSSGNRIHDPKRVKRILANRQSAQRSRVRKLQYISELERSVTSLQTEVSVLSPRVAFLDHQRLLLNVDNSAIKQRIAALAQDKIFKDAHQEALKREIERLRQVYHQQSLKKMENNVSDQSPADIKPSVEKEQLLNV

SEQ ID NO: 789 - DNA, 549 bp, Arabidopsis thaliana
  G1053,family:bZIP
gaaactcttacatactcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactcaaa

SEQ ID NO: 790 - protein, 166 aa, Arabidopsis thaliana
  G1053,bZIP domain coordinates 74-120
MIPAEINGYFQYLSPEYNVINMPSSPTSSLNYLNDLIINNNNYSSSSNSQDLMISNNSTSDEDHHQSIMVLDERKQRRMLSNRESARRSRMRKQRHLDELWSQVIRLRNENNCLIDKLNRVSETQNCVLKENSKLKEEASDLRQLVCELKSNKNNNNSFPREFEDN

SEQ ID NO: 791 - DNA, 2026 bp, Arabidopsis thaliana
  G1062,family:HLH/MYC
caaaaaaaaagtttcaatttttgaaagctctgagaaatgaaatctatcattctctctctctatctctatcttccttttcagatttcgcttcttcaattcatgaaatcctcgtgattctactttaatgcttctctttttttacttttccaagtctctgaatattcaaagtatatatcttttgttttcaaacttttgcagaattgtcttcaagcttccaaatttcagttaaaggtctcaactttgcagaattttcctctaaaggttcagactttggggtaaaggtgtcaactttggcgatgggtcttgacggaaacaatggtggaggggtttggttaaacggtggtggtggagaaagggaagagaacgaggaaggttcatggggaaggaatcaagaagatggttcttctcagtttaagcctatgcttgaaggtgattggtttagtagtaaccaaccacatccacaagatcttcagatgttacagaatcagccagatttcagatactttggtggttttccttttaaccctaatgataatcttcttcttcaacactctattgattcttcttcttcttgttctccttctcaagcttttagtcttgacccttctcagcaaaatcagttcttgtcaactaacaacaacaagggttgtcttctcaatgttccttcttctgcaaacccttttgataatgcttttgagtttggctctgaatctggttttcttaaccaaatccatgctcctatttcgatggggtttggttctttgacacaattggggaacagggatttgagttctgttcctgatttcttgtctgctcggtcacttcttgcgccggaaagcaacaacaacaacacaatgttgtgtggtggtttcacagctccgttggagttggaaggttttggtagtcctgctaatggtggttttgttgggaacagagcgaaagttctgaagcctttagaggtgttagcatcgtctggtgcacagcctactctgttccagaaacgtgcagctatgcgtcagagctctggaagcaaaatgggaaattcggagagttcgggaatgaggaggtttagtgatgatggagatatggatgagactgggattgaggtttctgggttgaactatgagtctgatgagataaatgagagcggtaaagcggctgagagtgttcagattggaggaggaggaaagggtaagaagaaaggtatgcctgctaagaatctgatggctgagaggagaaggaggaagaagcttaatgataggctttatatgcttagatcagttgtccccaagatcagcaaaatggatagagcatcaatacttggagatgcaattgattatctgaaggaacttctacaaaggatcaatgatcttcacaatgaacttgagtcaactcctcctggatctttgcctccaacttcatcaagcttccatccgttgacacctacaccgcaaactctttcttgtcgtgtcaaggaagagttgtgtccctcttctttaccaagtcctaaaggccagcaagctagagttgaggttagattaagggaaggaagagcagtgaacattcatatgttctgtggtcgtagaccgggtctgttgctcgctaccatgaaagctttggataatcttggattggatgttcagcaagctgtgatcagctgttttaatgggtttgccttggatgttttccgcgctgagcaatgccaagaaggacaagagatactgcctgatcaaatcaaagcagtgcttttcgatacagcagggtatgctggtatgatctgatctgatcctgacttcgagtccattaagcatctgttgaagcagagctagaagaactaagtccctttaaatctgcaattttcttctcaactttttttcttatgtcataacttcaatctaagcatgtaatgcaattgcaaatgagagttgtttttaaattaagcttttgagaacttgaggttgttgttgttggatacataacttcaaccttttattagcaatgttaacttccatttatgtttcatctt

SEQ ID NO: 792 - protein, 494 aa, Arabidopsis thaliana
  G1062,HLH/MYC domain coordinates 300-357
MGLDGNNGGGVWLNGGGGEREENEEGSWGRNQEDGSSQFKPMLEGDWFSSNQPHPQDLQMLQNQPDFRYFGGFPFNPNDNLLLQHSIDSSSSCSPSQAFSLDPSQQNQFLSTNNNKGCLLNVPSSANPFDNAFEFGSESGFLNQIHAPISMGFGSLTQLGNRDLSSVPDFLSARSLLAPESNNNNTMLCGGFTAPLELEGFGSPANGGFVGNRAKVLKPLEVLASSGAQPTLFQKRAAMRQSSGSKMGNSESSGMRRFSDDGDMDETGIEVSGLNYESDEINESGKAAESVQIGGGGKGKKKGMPAKNLMAERRRRKKLNDRLYMLRSVVPKISKMDRASILGDAIDYLKELLQRINDLHNELESTPPGSLPPTSSSFHPLTPTPQTLSCRVKEELCPSSLPSPKGQQARVEVRLREGRAVNIHMFCGRRPGLLLATMKALDNLGLDVQQAVISCFNGFALDVFRAEQCQEGQEILPDQIKAVLFDTAGYAGMI

SEQ ID NO: 793 - DNA, 1148 bp, Arabidopsis thaliana
  G1063,family:HLH/MYC
gttaaagaagatggatgggccacaagttgctatataaatccttccacttcttgttgtatactattgcttgagttctgattgggcacagtagtaccattgccatttctctcacacataccgtctctttctctcatcatcaatcatcaatcatccaaaagaaaaaaccctaaaatttcacttgtaagcttttcaccagtttctctccatacccattttatcagcttctccatatctttctctatggattctgacataatgaacatgatgatgcatcagatggagaagcttcctgagttttgtaaccctaattcctctttcttctctcccgaccacaacaacacttacccttttctctttaactccactcattaccagtccgatcactcaatgaccaacgaaccaggtttccgctacggttccggtttactcactaacccttcttctatctctcccaacacagcttactcttccgtttttcttgacaaaagaaacaacagtaacaacaacaataatggcacgaacatggcagctatgcgagagatgatcttccgtatcgccgtgatgcaaccgatccatatcgatcccgaggcggttaagccaccgaagaggaggaacgtcaggatctctaaagatcctcaaagcgtggcggctaggcatagaagggagagaataagcgagaggattcggattttgcaacggcttgttcctggtgggacgaagatggatacagcttcgatgctcgatgaagcaattcattatgtgaagtttttaaagaaacaggtgcagtctctggaggagcaggcggtggttactggcggagggggaggaggaggaggaagggttttgatcggtggaggtggaatgacggcggcgagtggtggtggtggcggcgggggagtggttatgaaagggtgtggaacagtggggactcatcagatggtgggcaatgcacagattcttagatgatgatgatttttaattttattattattatattaatgttggagaaaaagagaaaaatgattctggagagggaagccaagtaatttatgtgagagtctttaatttaactttattttcttgtttagataatgtgtaatgatggtttttaaagccaaagactctccatggttgttggagcgagtttg

SEQ ID NO: 794 - protein, 241 aa, Arabidopsis thaliana
  G1063,HLH/MYC domain coordinates 125-182
MDSDIMNMMMHQMEKLPEFCNPNSSFFSPDHNNTYPFLFNSTHYQSDHSMTNEPGFRYGSGLLTNPSSISPNTAYSSVFLDKRNNSNNNNNGTNMAAMREMIFRIAVMQPIHIDPEAVKPPKRRNVRISKDPQSVAARHRRERISERIRILQRLVPGGTKMDTASMLDEAIHYVKFLKKQVQSLEEQAVVTGGGGGGGGRVLIGGGGMTAASGGGGGGGVVMKGCGTVGTHQMVGNAQILR

SEQ ID NO: 795 - DNA, 1728 bp, Arabidopsis thaliana
  G1064,family:PCF
ctttattttttttcccctcttgtcgaaaacatcacatataaataaaaaaccaaaaaccctaatttataaaatatatataaaatagttatagctccccacttatatatgcaaaagccaacatcaagtatcttaaatgtcataatggacggtggagacagcgtcggaggaggaggaggagatgatcaccaccgtcacctccaccatcaccaccgccctactttcccttttcaactactcggaaaacacgaccccgacgacaaccatcaacaacaaccttccccttcctcctcctcctctctattttctctccatcaacaccaacaattatctcaatcgcaacctcaatcgcaatcgcaaaagtcacaaccgcagacaacgcaaaaagagttattacaaacgcaagaggaatctgcggtggtggcagctaaaaagccaccgttgaaacgagcgtcgacgaaagaccgacacacgaaagtagacggaagagggaggagaataaggatgccggcgttatgtgcagctagggtttttcagctaacgcgagagctaggtcataaatccgacggtgagacaatagagtggcttcttcaacaagctgaaccatctgtaatcgccgccaccggaaccggaacaatcccggcgaatttcacttctttaaacatctctctccgttcttcaggctcttccatgtctcttccttctcatttccgctccgccgcttccacttttagccctaataacatattttctccggcgatgcttcaacaacaacaacaacaacaacgtggtggtggtgttgggtttcatcatccccatctacagggacgtgcacctacgtcgtctttgtttcctggtattgataacttcacaccaacgacgtcgtttttgaactttcataatccaacaaagcaagaaggagatcaagattctgaagagttaaactcggagaagaaaagaagaatccaaacgacgtcggatttgcatcaacaacaacaacaacaccaacatgatcaaatcggaggatatacacttcaatctagcaacagtggatctacggccaccgcagccgccgcgcaacaaataccgggaaatttctggatggttgcggcggctgcggctgcaggtggtggtggtggtaataacaaccaaacaggtggtcttatgacagcttctattggtactggtggcggcggtggagagcctgtttggacgtttccttccattaacacggcagcggcagcgttatatagaagtggcgtttcgggcgttccaagcggcgcggtttctagcggtttacattttatgaatttcgcagcgccaatggcatttcttactggacaacaacagctagcaacaactagtaatcatgagattaatgaagatagtaataataatgaaggaggaagaagtgacggtggtggtgatcatcataatacacagagacatcatcatcatcaacaacaacatcatcataatattctctccggcttgaaccagtacggacggcaagtttccggcgactctcaagctagtggatcacttggaggtggtgatgaggaggatcagcaagattagacacacacaaaaacattttaatggtgggattttctgccgacggcggtagcggtgacggcgttcggcggctgtgtaaaacttttgttttcaccgttaattttttttattttctgtagtaattttttttgctaagtaaaaaaaaaaaaaaaaaaa

SEQ ID NO: 796 - protein, 489 aa, Arabidopsis thaliana
  G1064,PCF domain coordinates 116-179
MQKPTSSILNVIMDGGDSVGGGGGDDHHRHLHHHHRPTFPFQLLGKHDPDDNHQQQPSPSSSSSLFSLHQHQQLSQSQPQSQSQKSQPQTTQKELLQTQEESAVVAAKKPPLKRASTKDRHTKVDGRGRRIRMPALCAARVFQLTRELGHKSDGETIEWLLQQAEPSVIAATGTGTIPANFTSLNISLRSSGSSMSLPSHFRSAASTFSPNNIFSPAMLQQQQQQQRGGGVGFHHPHLQGRAPTSSLFPGIDNFTPTTSFLNFHNPTKQEGDQDSEELNSEKKRRIQTTSDLHQQQQQHQHDQIGGYTLQSSNSGSTATAAAAQQIPGNFWMVAAAAAAGGGGGNNNQTGGLMTASIGTGGGGGEPVWTFPSINTAAAALYRSGVSGVPSGAVSSGLHFMNFAAPMAFLTGQQQLATTSNHEINEDSNNNEGGRSDGGGDHHNTQRHHHHQQQHHHNILSGLNQYGRQVSGDSQASGSLGGGDEEDQQD

SEQ ID NO: 797 - DNA, 1473 bp, Arabidopsis thaliana
  G1067,family:AT-hook
tctcaagcttctctctcctttttttcccatagcacatcagaatcgctaaatacgactcctatgcaaagaagaagctacttctttctcttgccctaattaatctacctaactagggtttcctcttacctttcatgagagagatcatttaacataagtcaccttttttatatcttttgcttcgtctttaatttagttctgttcttggtctgtttctatattttgtcggcttgcgtaaccgatcacaccttaatgctttagctattgtttcctcaaaatcatgagttttgacttctcgatctgagttttctttttctctctttacgctcttcttcacctagctaccaatatatgaacgagcaggatcaagaatcgagaaattgatttgagctggcgaataagcagtggtgggatagggaattagtagatgcggcggcgatggaaggcggttacgagcaaggcggtggagcttctagatacttccataacctctttagaccggagattcaccaccaacagcttcaaccgcagggcgggatcaatcttatcgaccagcatcatcatcagcaccagcaacatcaacaacaacaacaaccgtcggatgattcaagagaatctgaccattcaaacaaagatcatcatcaacagggtcgacccgattcagacccgaatacatcaagctcagcaccgggaaaacgtccacgtggacgtccaccaggatctaagaacaaagccaagccaccgatcatagtaactcgtgatagccccaacgcgcttagatctcacgttcttgaagtatctcctggagctgacatagttgagagtgtttccacgtacgctaggaggagagggagaggcgtctccgttttaggaggaaacggcaccgtatctaacgtcactctccgtcagccagtcactcctggaaatggcggtggtgtgtccggaggaggaggagttgtgactttacatggaaggtttgagattctttcgctaacggggactgttttgccacctcctgcaccgcctggtgccggtggtttgtctatatttttagccggagggcaaggtcaggtggtcggaggaagcgttgtggctccccttattgcatcagctccggttatactaatggcggcttcgttctcaaatgcggttttcgagagactaccgattgaggaggaggaagaagaaggtggtggtggcggaggaggaggaggaggagggccaccgcagatgcaacaagctccatcagcatctccgccgtctggagtgaccggtcagggacagttaggaggtaatgtgggtggttatgggttttctggtgatcctcatttgcttggatggggagctggaacaccttcaagaccacctttttaattgaattttaatgtccggaaatttatgtgtttttatcatcttgaggagtcgtctttcctttgggatatttggtgtttaatgtttagttgatatgcatatttt

SEQ ID NO: 798 - protein, 311 aa, Arabidopsis thaliana
  G1067,At-hook amino acids 86-94,2nd cons. domain 94-247,DUF296 113-239
MEGGYEQGGGASRYFHNLFRPEIHHQQLQPQGGINLIDQHHHQHQQHQQQQQPSDDSRESDHSNKDHHQQGRPDSDPNTSSSAPGKRPRGRPPGSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEEEEEGGGGGGGGGGGPPQMQQAPSASPPSGVTGQGQLGGNVGGYGFSGDPHLLGWGAGTPSRPPF

SEQ ID NO: 799 - DNA, 1606 bp, Arabidopsis thaliana
  G1068,family:AT-hook
gagagttgttagctagctcacacgctttcgcttaaaactcaaaaacctgcactttctcgtctattttctcggcattcgtaaaacagaaaagtgggtctccaagaaaattaccctaaattcacaaagattcatacttttctccacctccaatggattccagagagatccaccaccaacaacagcaacaacaacaacaacaacagcagcagcagcaacaacagcaacatctacaacaacagcaacaaccaccgccagggatgttaatgagtcaccacaattcctacaatcgaaaccctaacgccgccgccgctgttttaatgggtcacaacacctccacatctcaagctatgcatcaaagattaccttttggtggttctatgtcaccgcatcagcctcaacaacatcagtatcatcatcctcagcctcagcaacagatagatcagaagactcttgaatctcttggatttcctacttcgcctcttccttctgcttctaattcttacggtggtggaaatgaaggaggtggtggtggtgatagcgccggagctaatgctaactcttccgatccacctgctaaacggaacagaggacgtcctcctggctccggtaagaagcagctcgatgctttaggaggaacaggaggagttgggttcacgcctcatgtcattgaggttaaaacaggagaggacatagctacgaagatattggcgtttacgaaccaagggccacgcgcaatctgtattctctcagctacaggagctgtaactaatgtgatgcttcgtcaagctaacaatagcaatcctactggaactgttaagtatgagggccgatttgaaatcatttctctgtcaggttctttcttgaattctgagagtaatggtactgtgaccaaaactggtaacttgagtgtgtcgctggctggacacgaaggccggattgtgggtggatgtgttgatggaatgctagtagctggatcacaagtccaggtcattgtgggaagctttgtaccagatggaaggaagcagaaacaaagtgcggggcgtgctcagaatactccggagccagcttcagcaccagccaatatgttgagctttggtggtgttggtggaccgggaagccctcgatctcaaggacaacaacactcgagcgagtcatcagaggaaaacgaaagtaattctccgttgcaccgtagaagcaacaacaacaacagcaacaatcatgggatatttggaaactctacacctcaaccgcttcaccaaattcctatgcagatgtaccagaatctctggcctggcaacagtcctcaataaacagatggttcatgggtcaagatttgaccgggtttgcttctctgttccttttgacacatctctccatcagatttatctctataaagtagattgagctctcttactctctcatcttcttctcctttactatttctcttaaatttagctttggttttagataaatagagagagagagacatgttaagtaggtttcaaattcaatcttgtttagtttgtttcttagtagtttcttttgattgtgatgatcataaagacttgttctttttctcctatattcaacgaattatccactttaa

SEQ ID NO: 800 - protein, 386 aa, Arabidopsis thaliana
  G1068,AT-hook amino acids 143-150,DUF296 168-285
MDSREIHHQQQQQQQQQQQQQQQQQHLQQQQQPPPGMLMSHHNSYNRNPNAAAAVLMGHNTSTSQAMHQRLPFGGSMSPHQPQQHQYHHPQPQQQIDQKTLESLGFPTSPLPSASNSYGGGNEGGGGGDSAGANANSSDPPAKRNRGRPPGSGKKQLDALGGTGGVGFTPHVIEVKTGEDIATKILAFTNQGPRAICILSATGAVTNVMLRQANNSNPTGTVKYEGRFEIISLSGSFLNSESNGTVTKTGNLSVSLAGHEGRIVGGCVDGMLVAGSQVQVIVGSFVPDGRKQKQSAGRAQNTPEPASAPANMLSFGGVGGPGSPRSQGQQHSSESSEENESNSPLHRRSNNNNSNNHGIFGNSTPQPLHQIPMQMYQNLWPGNSPQ

SEQ ID NO: 801 - DNA, 1116 bp, Arabidopsis thaliana
  G1069,family:AT-hook
ttggaaccctagaggcctttcaagcaaatcatcagggtaacaatttcttgatctttctttttagcgaatttccagtttttggtcaatcatggcaaacccttggtggacgaaccagagtggtttagcgggcatggtggaccattcggtctcctcaggccatcaccaaaaccatcaccaccaaagtcttcttaccaaaggagatcttggaatagccatgaatcagagccaagacaacgaccaagacgaagaagatgatcctagagaaggagccgttgaggtggtcaaccgtagaccaagaggtagaccaccaggatccaaaaacaaacccaaagctccaatctttgtgacaagagacagccccaacgcactccgtagccatgtcttggagatctccgacggcagtgacgtcgccgacacaatcgctcacttctcaagacgcaggcaacgcggcgtttgcgttctcagcgggacaggctcagtcgctaacgtcaccctccgccaagccgccgcaccaggaggtgtggtctctctccaaggcaggtttgaaatcttatctttaaccggtgctttcctccctggaccttccccacccgggtcaaccggtttaacggtttacttagccggggtccagggtcaggtcgttggaggtagcgttgtaggcccactcttagccatagggtcggtcatggtgattgctgctactttctctaacgctacttatgagagattgcccatggaagaagaggaagacggtggcggctcaagacagattcacggaggcggtgactcaccgcccagaatcggtagtaacctgcctgatctatcagggatggccgggccaggctacaatatgccgccgcatctgattccaaatggggctggtcagctagggcacgaaccatatacatgggtccacgcaagaccaccttactgactcagtgagccatttctatatataatggtctatataaataaatatatagatgaatataagcaagcaatttgaggtagtctattacaaagcttttgctctggttggaaaaataaataagtatcaaagctttgtttgttcttaatggaaatatagagcttgggaaggtagaaagagacgacatt

SEQ ID NO: 802 - protein, 281 aa, Arabidopsis thaliana
  G1069,At-hook amino acids 67-75,2nd cons. domain 75-218,DUF296 94-211
MANPWWTNQSGLAGMVDHSVSSGHHQNHHHQSLLTKGDLGIAMNQSQDNDQDEEDDPREGAVEVVNRRPRGRPPGSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEEEEDGGGSRQIHGGGDSPPRIGSNLPDLSGMAGPGYNMPPHLIPNGAGQLGHEPYTWVHARPPY

SEQ ID NO: 803 - DNA, 1084 bp, Arabidopsis thaliana
  G1075,family:AT-hook
tttgtgtttggtgctggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattggctagctcataagaattgtttaatttggttattgtcatcaaatttgcccacatataaagcttctagcaaat

SEQ ID NO: 804 - protein, 285 aa, Arabidopsis thaliana
  G1075,At-hook amino acids 78-86,2nd cons. domain 86-229,DUF296 105-222
MAGLDLGTTSRYVHNVDGGGGGQFTTDNHHEDDGGAGGNHHHHHHNHNHHQGLDLIASNDNSGLGGGGGGGSGDLVMRRPRGRPAGSKNKPKPPVIVTRESANTLRAHILEVGSGCDVFECISTYARRRQRGICVLSGTGTVTNVSIRQPTAAGAVVTLRGTFEILSLSGSFLPPPAPPGATSLTIFLAGAQGQVVGGNVVGELMAAGPVMVMAASFTNVAYERLPLDEHEEHLQSGGGGGGGNMYSEATGGGGGLPFFNLPMSMPQIGVESWQGNHAGAGRAPF

SEQ ID NO: 805 - DNA, 1342 bp, Arabidopsis thaliana
  G1076,family:AT-hook
attttagtcttcctataacttcttctcaatcctctctcatatcttttttcttagtttaaatttcaataaaatagaaaaaaacatatacaaatctacagagaagagaagctttattttaatcttgtgtgtgtgtgtgtgttttatataatttttattttttttcaaattaaaatctcttctttgcttttgatgtgggcatggctggtcttgatctaggcacagcttttcgttacgttaatcaccagctccatcgtcccgatctccaccttcaccacaattcctcctccgatgacgtcactcccggagccgggatgggtcatttcaccgtcgacgacgaagacaacaacaacaaccatcaaggtcttgacttagcctctggtggaggatcaggaagctctggaggaggaggaggtcacggcgggggaggagacgtcgttggtcgtcgtccacgtggcagaccaccgggatccaagaacaaaccgaaacctccggtaattatcacgcgcgagagcgcaaacactctaagagctcacattcttgaagtaacaaacggctgcgatgttttcgactgcgttgcgacttatgctcgtcggagacagcgagggatctgcgttctgagcggtagcggaacggtcacgaacgtcagcatacgtcagccatctgcggctggagcggttgtgacgctacaaggaacgttcgagattctttctctctccggatcgtttcttcctcctccggcacctcccggagcaacgagtttgacaattttcttagccggaggacaaggtcaggtggttggaggaagcgttgtgggtgagcttacggcggctggaccggtgattgtgattgcagcttcgtttactaatgttgcttatgagagacttcctttagaagaagatgagcagcagcaacagcttggaggaggatctaacggcggaggtaatttgtttccggaggtggcagctggaggaggaggaggacttccgttctttaatttaccgatgaatatgcaaccaaatgtgcaacttccggtggaaggttggccggggaattccggtggaagaggtcctttctgatgtgtatatattgataatcattatatatataccggcggagaagcttttccggcgaagaatttgcgagagtgaagaaaggttagaaaagcttttaatggactaatgaatttcaaattatcatcgtgatttcggacattgtcttgttcatcatgttaagcttaggtttattttttgtcgtttgtagaattttatgtttgaatccttttttttttctgtgaaactctattgtgttcgtctgcgaaggaaaaaaaaattctcaaaaaaaa

SEQ ID NO: 806 - protein, 292 aa, Arabidopsis thaliana
  G1076,At-hook amino acids 82-90,2nd cons. domain 90-233,DUF296 109-226
MAGLDLGTAFRYVNHQLHRPDLHLHHNSSSDDVTPGAGMGHFTVDDEDNNNNHQGLDLASGGGSGSSGGGGGHGGGGDVVGRRPRGRPPGSKNKPKPPVIITRESANTLRAHILEVTNGCDVFDCVATYARRRQRGICVLSGSGTVTNVSIRQPSAAGAVVTLQGTFEILSLSGSFLPPPAPPGATSLTIFLAGGQGQVVGGSVVGELTAAGPVIVIAASFTNVAYERLPLEEDEQQQQLGGGSNGGGNLFPEVAAGGGGGLPFFNLPMNMQPNVQLPVEGWPGNSGGRGPF

SEQ ID NO: 807 - DNA, 2597 bp, Arabidopsis thaliana
  G1078,family:BZIPT2
agtatagtgtagtgggaaagtctggaaacagctgtatctaactttttcccttttctctatgattctgttgtgaataatgcagagccgccgtgagctcaggcgccaccgtaacgaagaacaaacctgaaggagaaaaataagccatgggatgtgcggcgtccaagctcgataacgaagatgctgtacggcgttgtaaggatcgccgccgtctgatgaaagaagctgtctacgctcgtcatcatctcgccgccgctcacgccgattactgccgatcgcttcgtatcactggatctgctctttcctcattcgcctccggtgagcctctctctgtatctgatcaaactccggctgttttcctccatactccccctcctccgctttctgaacaatctccggctaaatttgtccctccacgtttttcgccgtcgcctgctccttcttctgtttatcctccttcgacgtctccttccgtcgccagttctaagcagccttcagtcatgtccacctcttccaatcgacgccggaaacagcaaccaaaacctagactgcctcatattctctcggagtcaagtcattcttcttctccgagaagtgagagatccaatttcatgcccaatttgtatcccagtgcttatcagaactctacttactccgctactccttctcatgcctcctccgtctggaactgggagaatttctaccctccttctcctcccgattccgaattcttcaacaggaaggctcaagagaagaaacataactccgataatcgattcaacgacgaggatacggaaacagtgaggtcagagtatgatttcttcgacacgaggaagcaaaagcagaagcagttcgaatcaatgagaaatcaggtggaggaagagacggagacggagagagaggaagtacagtgtagtgaatgggaggatcacgatcattacagcaccacgagctcctcggacgcagcggaggaagaggaagaagatgatgatagagaatcaatttccgaggtcgggacacgctccgagtttggatctacggtgagaagtaattcgatgagacggcatcatcaacaaccttcaccaatgccgcaagtatacggcggcgctgaacaaagtaaatatgataaagcagatgatgctacgatatcttctggtagctatagaggcggaggagatatcgctgacatgaagatggtagttaggcatagggatttgaaagaaatcatcgatgccattaaggaaaatttcgataaggctgctgcctcaggggagcaagtctctcagatgctcgagcttggcagagctgagctcgatcgtagtttcagccaattgaagaaaacggtgattcattcgagtagtttattaagcaacttgagctcgacatggacctcgaagccgccattggcagtcaagtataggatagacacgactgcgctggatcaaccgaacagttcgaagagcctttgttccactcttgaccgtctcttggcatgggagaagaagctttatgaagaaattaaggctagagaaggtttcaagattgagcatgagaagaagttatcacagcttcaaagccaagaatataaaggggaggatgaagctaagttagacaagacaaaggcctctataacgaggttacagtcactgatcattgttacttctcaagctgttactaccacatctactgccatcatccgtcttcgtgatactgaccttgttccacaactcgttgagctctgtcatggctttatgtacatgtggaaatctatgcatcaataccatgagactcagaacagcatcgtggagcaagtccgggggctcattaacagatcgggcaaaggcgaatcaacatctgagctacaccgacaagctacacgtgacttggaatcagctgtctcttcttggcactccagtttcagtagtttgattaaattccaacgtgacttcatacactcagttcacgcctggttcaagctgacccttcttccggtttgccaagaagacgccgccaatcatcacaaagagccgctcgatgcttacgccttctgcgatgagtggaaactcgctctagatcgtattcccgatacagttgcatctgaggcaatcaagagcttcatcaacgttgtacacgtgatatccgcaaaacaagccgatgaacacaagataaagaaaagaacagaatcagcatcaaaagagcttgagaagaaggcttcgtcggttagaaacctagagagaaaatactaccagtcatactcaatggttggtgtcggtttaccagagtcaggacccgataaccgacacatgttagacgctcgagacccgttaagcgataaaaagtcagagcttgcggtttgccaaaggagagttgaggaagagatggtgaaatactcaaaggcaatagaagtgacaagagccatgactttgaataatctgcagacagggttgcctggtgtgttccaatctttaacaagtttctctgctttgttcatggagtctcttcaaacggtatgcactcgctcatactctatcaaataggacattatatattatatatatatatatattgatatgcttacagagtttacagtaacaattgtg

SEQ ID NO: 808 - protein, 796 aa, Arabidopsis thaliana
  G1078,BZIPT2 domain coordinates 1-53,440-550
MGCAASKLDNEDAVRRCKDRRRLMKEAVYARHHLAAAHADYCRSLRITGSALSSFASGEPLSVSDQTPAVFLHTPPPPLSEQSPAKFVPPRFSPSPAPSSVYPPSTSPSVASSKQPSVMSTSSNRRRKQQPKPRLPHILSESSHSSSPRSERSNFMPNLYPSAYQNSTYSATPSHASSVWNWENFYPPSPPDSEFFNRKAQEKKHNSDNRFNDEDTETVRSEYDFFDTRKQKQKQFESMRNQVEEETETEREEVQCSEWEDHDHYSTTSSSDAAEEEEEDDDRESISEVGTRSEFGSTVRSNSMRRHHQQPSPMPQVYGGAEQSKYDKADDATISSGSYRGGGDIADMKMVVRHRDLKEIIDAIKENFDKAAASGEQVSQMLELGRAELDRSFSQLKKTVIHSSSLLSNLSSTWTSKPPLAVKYRIDTTALDQPNSSKSLCSTLDRLLAWEKKLYEEIKAREGFKIEHEKKLSQLQSQEYKGEDEAKLDKTKASITRLQSLIIVTSQAVTTTSTAIIRLRDTDLVPQLVELCHGFMYMWKSMHQYHETQNSIVEQVRGLINRSGKGESTSELHRQATRDLESAVSSWHSSFSSLIKFQRDFIHSVHAWFKLTLLPVCQEDAANHHKEPLDAYAFCDEWKLALDRIPDTVASEAIKSFINVVHVISAKQADEHKIKKRTESASKELEKKASSVRNLERKYYQSYSMVGVGLPESGPDNRHMLDARDPLSDKKSELAVCQRRVEEEMVKYSKAIEVTRAMTLNNLQTGLPGVFQSLTSFSALFMESLQTVCTRSYSIK

SEQ ID NO: 809 - DNA, 1995 bp, Arabidopsis thaliana
  G1079,family:BZIPT2
atgggttgtgctgcttcaagaattgataatgaagaaaaggttttagtgtgtaggcagagaaagaggctaatgaaaaagttattagggttcaggggagaatttgcagatgcacagttggcttatcttagagctttgaggaacactggtgttactcttaggcaattcactgagtctgagaccttggagcttgaaaacactagttatggtttaagtttgcctttgcctccttcgcctcctcctacattgcctccttcacctccaccacctcctccatttagcccggatttgagaaatcctgagactagtcatgacttggctgatgaggaggaagagggtgaaaatgatggtggtaatgatggaagtggtgcagctcctccgcctccattgccgaattcttggaacatttggaacccttttgagtcacttgagctgcatagtcatccaaatggtgacaatgtagttacacaagttgaactgaagaagaaacaacaaattcagcaagctgaagaggaagattgggcggagacgaagtctcaatttgaggaagaagatgagcaacaagaagcaggaggtacttgccttgatttgagtgttcatcaaatagaggctgttagtggctgtaacatgaagaagccacgtcgtctgaagtttaagctgggagaagttatggacggtaactcatctatgacaagctgctccggtaaagatcttgagaaaactcatgtgactgattgtagaatcaggaggaccttagaaggaatcatcagagagttggatgattattttcttaaagcatcgggttgcgagaaggagatagctgtgatagtagacatcaacagtagggatactgttgatcctttcaggtaccaggaaacaagaaggaagagaagcagctcggcaaaggtattcagtgcattgtcatggagttggtcttcaaagtctcttcagttgggcaaagatgctacaacaagcgggactgttgaaccctgtaggcctggagctcactgcagcacacttgagaagctatacacagctgagaagaaactttaccagctagtcagaaacaaagagattgccaaagtggagcatgagaggaagtctgcattactgcaaaagcaagatggggaaacctatgatttgagcaaaatggagaaagcacgcttgtctttggagagtttggaaaccgagatacagcgtctagaagattccataactacaacacgctcatgtttgcttaacttgatcaatgatgagctgtatccgcagctagttgctttaacttcagggctagcacagatgtggaaaacaatgctcaagtgtcatcaagttcaaattcatatatcccagcaactgaaccatcttccggattacccgagtatagatctcagttcggaatacaaacgccaggcggttaatgaactagagaccgaggttacttgctggtacaatagcttttgcaagttagtaaattcccagcgagaatacgtgaaaacactctgtacgtggatccaacttactgatcgcctctctaacgaagacaaccaaagaagtagcttgcctgttgctgctcgtaagctctgcaaagagtggcagcttgaatacaacctgcgtaggaaatgcaataaacttgagaggaggcttgagaaagagctaatttcactggctgagattgaaagaaggctcgaggggattttagcaatggaagaggaggaagtaagctcaacgagtttgggctctaagcatccgttgtcaatcaaacaagccaagatcgaagccttgagaaaacgagtggatattgagaaaactaagtacttaaactcggtcgaggttagtaagagaatgacactagacaacctcaaatcaagccttcccaatgtctttcagatgttgactgctctagctaatgtctttgccaatgggtttgaatccgttaatggccaaaccggtacagatgtttccgacacatcccaacattccgatgaatctcaaccctaa

SEQ ID NO: 810 - protein, 664 aa, Arabidopsis thaliana
  G1079,BZIPT2 domain coordinates 1-50
MGCAASRIDNEEKVLVCRQRKRLMKKLLGFRGEFADAQLAYLRALRNTGVTLRQFTESETLELENTSYGLSLPLPPSPPPTLPPSPPPPPPFSPDLRNPETSHDLADEEEEGENDGGNDGSGAAPPPPLPNSWNIWNPFESLELHSHPNGDNVVTQVELKKKQQIQQAEEEDWAETKSQFEEEDEQQEAGGTCLDLSVHQIEAVSGCNMKKPRRLKFKLGEVMDGNSSMTSCSGKDLEKTHVTDCRIRRTLEGIIRELDDYFLKASGCEKEIAVIVDINSRDTVDPFRYQETRRKRSSSAKVFSALSWSWSSKSLQLGKDATTSGTVEPCRPGAHCSTLEKLYTAEKKLYQLVRNKEIAKVEHERKSALLQKQDGETYDLSKMEKARLSLESLETEIQRLEDSITTTRSCLLNLINDELYPQLVALTSGLAQMWKTMLKCHQVQIHISQQLNHLPDYPSIDLSSEYKRQAVNELETEVTCWYNSFCKLVNSQREYVKTLCTWIQLTDRLSNEDNQRSSLPVAARKLCKEWQLEYNLRRKCNKLERRLEKELISLAEIERRLEGILAMEEEEVSSTSLGSKHPLSIKQAKIEALRKRVDIEKTKYLNSVEVSKRMTLDNLKSSLPNVFQMLTALANVFANGFESVNGQTGTDVSDTSQHSDESQP

SEQ ID NO: 811 - DNA, 2684 bp, Arabidopsis thaliana
  G1082,family:BZIPT2
gggtttggaatcatattattgagtgttatgggttgtacaagttctaagcttgacgatcttccggcggttgctctttgccgtgaacgctgtgctttcttagaagctgctattcatcaacgttacgctttagctgaatcacacgtggcttacactcattcgcttcgagaaatcggtcactctctccatcttttcatcaatcaccaccaccgtttcgtcgcttccggcggcgctaacgtcggtgattctcctcgacttaatcttcctcctcagagaaaaggtgaccttgacgacgaagcaacaaattccccaaaaaaacaaaagcttgcttcttctcaccacaaccacaaccacgctcactcgggttccggttctgattcgggtcatctcgaattcgattcagattccgacgaagatgaagaagacgacgacgacttggatttggattcgttgcatcaccactctcctccccaccaccatctcggcaatttccctattcccgaatcagcaccaatgggcggatacatggaacaacaaccgggttatataaacccgtacccgaatccagatatgatggggcatccttactctggaggaggaagttatatgcacatgaattacatgaagaacaaatccatgcctccttcagttgtctatgagcaaagaccaactagtcctcaacgagtctacataggcgaatcatcatcttcatatccatatcctcctcaaaattcatattttggatactcaaatccagtacccggacccggaccaggatactacggttcttcttctgcttctacaactgctgcagcaacaaaaccgccaccacctccaccgtcgccgcctaggtctaacggttgggattttttgaatccctttgatacttattatcctccgtatactccgagtcgagattcgagagagttaagagaagaagaaggtataccggatttagaagacgatgattcacattacgaagttgttaaagaagtttacggcaaaccaaaattcgccgccggtggtggtcaccaaccaaatcccgccgccgtacacatgatgagggaagagtccccgtctccgccgcttgataaatccggtgctagtactagcggtggaggtgatgtcggagatgcatctgcgtatcagtctagaccaagtgtgtcggtggagaaagaagggatggagtatgaagttcacgttgttgagaagaaggttgttgaagatgaggaacggcggagtaatgccacggcgacacgtggtggtggtggaggaggagggccacgtgcggtgcctgaagttgcgaaagagattgagaatcaattcgtgaaagctgcagagtcaggaagtgagattgctaagttacttgaagttgggaagcatccttatggtcgtaaacatgctgcttcgaagatgttgcacggtgttactccttcgttaccttctacctctggaggaacttcttcgtctgctgctgctgctgttgtgccacctacttatgcagatattgaagaagagcttgcttcgaggtcgaggaatctttcttcgacgttgcacaagctccatctttgggagaagaagctttatcatgaagtcaaggccgaggagaaactgcgtctagctcacgagaaaaagcttaggaagctaaagcgtttggatcaaagaggtgccgaggctatcaaagtagataaaacgcggaaattagtgagagatatgtccacaaaaatacggattgcgattcaggttgtcgacaaaatatccgtgacgattaataagataagagacgaagacctgtggccgcaactgaatgcattgattcaagggcttacaagaatgtggaaaacaatgcttgaatgtcatcaaagtcaatgtcaagctattagggaagcacaaggtttaggcccgataagagcaagcaagaaactaggcgatgaacatctagaagcgacgagtttgcttggacatgaacttattaattggatattgggattctctagctgggttagtgcgcagaagggttatgtaaaagagttgaataaatggctcatgaaatgtcttctgtatgaacctgaggaaacacctgatgggatagttcccttttcacctggtaggattggggctccacctatctttgtcatctgtaaccaatggtctcaagctctggataggatatctgagaaggaagttattgaggcaatgcgtagtttcactacaagtgtgcttcagctttgggaacaagatcggttagatacgatgatgacggggcatggtgattcagagaagaaagtcaggaacatggacagagaagaacagaggatacagagagagattcaagcattggaaaagaaaatgattcttgtggcaccgggtgatggtaacagtctttcgatatccggcaacgttgtttaccaaagcgatactagcagcgatagtttacaaggtagtttgcaacggatttttgaagctatggagagattcactgctgaatcgatgagagcttatgaggatctcttagagcgcaccaatgaagaaactgcaccacgggaacttgaggaagaagaggaggagtaaaaaagcaaaacaggaagaagaggtttgcttgtcaattcaatttgaatcccatgatcgagctgtttgctgatcttgcaatgccagaatactcggttttgcgcgtctgagactcgggc

SEQ ID NO: 812 - protein, 846 aa, Arabidopsis thaliana
  G1082,BZIPT2 domain coordinates 1-53,503-613
MGCTSSKLDDLPAVALCRERCAFLEAAIHQRYALAESHVAYTHSLREIGHSLHLFINHHHRFVASGGANVGDSPRLNLPPQRKGDLDDEATNSPKKQKLASSHHNHNHAHSGSGSDSGHLEFDSDSDEDEEDDDDLDLDSLHHHSPPHHHLGNFPIPESAPMGGYMEQQPGYINPYPNPDMMGHPYSGGGSYMHMNYMKNKSMPPSVVYEQRPTSPQRVYIGESSSSYPYPPQNSYFGYSNPVPGPGPGYYGSSSASTTAAATKPPPPPPSPPRSNGWDFLNPFDTYYPPYTPSRDSRELREEEGIPDLEDDDSHYEVVKEVYGKPKFAAGGGHQPNPAAVHMMREESPSPPLDKSGASTSGGGDVGDASAYQSRPSVSVEKEGMEYEVHVVEKKVVEDEERRSNATATRGGGGGGGPRAVPEVAKEIENQFVKAAESGSEIAKLLEVGKHPYGRKHAASKMLHGVTPSLPSTSGGTSSSAAAAVVPPTYADIEEELASRSRNLSSTLHKLHLWEKKLYHEVKAEEKLRLAHEKKLRKLKRLDQRGAEAIKVDKTRKLVRDMSTKIRIAIQVVDKISVTINKIRDEDLWPQLNALIQGLTRMWKTMLECHQSQCQAIREAQGLGPIRASKKLGDEHLEATSLLGHELINWILGFSSWVSAQKGYVKELNKWLMKCLLYEPEETPDGIVPFSPGRIGAPPIFVICNQWSQALDRISEKEVIEAMRSFTTSVLQLWEQDRLDTMMTGHGDSEKKVRNMDREEQRIQREIQALEKKMILVAPGDGNSLSISGNVVYQSDTSSDSLQGSLQRIFEAMERFTAESMRAYEDLLERTNEETAPRELEEEEEE

SEQ ID NO: 813 - DNA, 2535 bp, Arabidopsis thaliana
  G1084,family:BZIPT2
atgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactatctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaaggactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctag

SEQ ID NO: 814 - protein, 844 aa, Arabidopsis thaliana
  G1084,BZIPT2 domain coordinates 1-53,490-619
MGCSHSKLDDEEAVQICKDRKRFIKQAIEHRTKFASGHIAYIHSLRKVSDALHDFILQGDNNNEFVPTLCQDSFVTPVKRMPQRRRRSSRSNSGEFISISPSSIPPKMIQGRPRSNVKANYLMANRSRPVRVEQRSPETFRVETFSPPSSSNQYGESDGFFGMNMNMNTSASTSSSFWNPLSSPEQRLSSHNIPPPSPQNSQWDFFWNPFSSLDYYGYNSYDRGSVDSRSGIDDEIRGLRRVREEEGIPDLEEDDEPHKPEPVVNVRFQNHNPNPKATEENRGKVDKSCCNEEVKVEDVDEDEDEDGDEDDDEFTDSGCETENEGDEKCVAPPTQEQRKAEVCRGGEATGNVVGVGKVQEMKNVVGVRDDAKTTGFTVYVNRRPTSMAEVIKDLEDQFTTICDAAKEVSGLLEAGRAQYTSSFNDHSGEFMNNVAIFLSRKMLNPVALFRSGSSRSSSSRFLITSSGGSRESGSESRSDVSDESCMISGSHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQKRTLDEAKLLLAGTPVSKRHKKRQPPIMPEAINSQRLAQSALNLEAQLRNWRTCFEFWITSQRSYMKALSGWLLRCFRCDPDPEKVRLSSCLHPIYRVCIQWSRLLNSLNEKPVLDKLEFFASGMGSIYARQVREDPNWSGSGSRRYSGSESMELVVADKGEEDVVMTAEKLAEVAVKVLCHGMSVAVSSLAEFSINSADEHSKLVSQPADDASEQQPPDVNFNS

SEQ ID NO: 815 - DNA, 2663 bp, Arabidopsis thaliana
  G1089,family:BZIPT2
aagtaagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcgcggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaatctttatcattgctttcttatattaaggttttggcttttgtaagaaggtttcttacatatgagattcatatagtgtttgattcttaaggaactgttctgttgagtaataagaaagttgtgtattgaaatagagttgcatttgttaattttg

SEQ ID NO: 816 - protein, 798 aa, Arabidopsis thaliana
  G1089,BZIPT2 domain coordinates 425-500
MGCAQSKIENEEAVTRCKERKQLMKDAVTARNAFAAAHSAYAMALKNTGAALSDYSHGEFLVSNHSSSSAAAAIASTSSLPTAISPPLPSSTAPVSNSTASSSSAAVPQPIPDTLPPPPPPPPLPLQRAATMPEMNGRSGGGHAGSGLNGIEEDGALDNDDDDDDDDDDSEMENRDRLIRKSRSRGGSTRGNRTTIEDHHLQEEKAPPPPPLANSRPIPPPRQHQHQHQQQQQQPFYDYFFPNVENMPGTTLEDTPPQPQPQPTRPVPPQPHSPVVTEDDEDEEEEEEEEEEEEETVIERKPLVEERPKRVEEVTIELEKVTNLRGMKKSKGIGIPGERRGMRMPVTATHLANVFIELDDNFLKASESAHDVSKMLEATRLHYHSNFADNRGHIDHSARVMRVITWNRSFRGIPNADDGKDDVDLEENETHATVLDKLLAWEKKLYDEVKAGELMKIEYQKKVAHLNRVKKRGGHSDSLERAKAAVSHLHTRYIVDMQSMDSTVSEINRLRDEQLYLKLVHLVEAMGKMWEMMQIHHQRQAEISKVLRSLDVSQAVKETNDHHHERTIQLLAVVQEWHTQFCRMIDHQKEYIKALGGWLKLNLIPIESTLKEKVSSPPRVPNPAIQKLLHAWYDRLDKIPDEMAKSAIINFAAVVSTIMQQQEDEISLRNKCEETRKELGRKIRQFEDWYHKYIQKRGPEGMNPDEADNDHNDEVAVRQFNVEQIKKRLEEEEEAYHRQSHQVREKSLASLRTRLPELFQAMSEVAYSCSDMYRAITYASKRQSQSERHQKPSQGQSS

SEQ ID NO: 817 - DNA, 838 bp, Arabidopsis thaliana
  G1090,family:AP2
aaactaattcgcacagttctatatacactcacaaacacacacacacacaatatagtgctactaaaataaccttgtattaattatggaaaacacttacgttggccaacgagattaccgcttcaacgttaaccagttgtcctacagaggcattcgtcggaggaaatggggcaaatgggtatcggagatccgagaacccggtaagaaaacaaggatttggcttggaagctacgagacggccgagatggctgcagcggcctacgatgctgcggctcttcacctccgaggacgtgggaccaatctcaactttccggaactcgtcgacagttttcctcggccggaaagctctagttcggagcacattcaagcggctgcacaagatgcagcacttatgtttaaaccaggtaggttgagtgaaccagctctcgagtctggtcaaggactttctcgagtaggattgtctccggatcagattcaagcgattaatgagtctccattagactcgccgaggatggggtggatgcaggatttggaagttgctgactacgaagaattatacggacaattttttggtcagcacgatagggatgagttttttgaaatgcagcaatttcagtccatatggaattctaataattgatatacgttcgcttaattgcttaaccatttgattttttttttaataatgtcatatcatcaaccaaggtttttcgattatattcagtaaagtataataaattttcgacccttactgtttttcttgggttcaatttgtaatctcttaacaatgatgatgtcataaataccaatatgattaattcaaattttcaaaaaaaaaaaa

SEQ ID NO: 818 - protein, 184 aa, Arabidopsis thaliana
  G1090,AP2 domain coordinates 17-84
MENTYVGQRDYRFNVNQLSYRGIRRRKWGKWVSEIREPGKKTRIWLGSYETAEMAAAAYDAAALHLRGRGTNLNFPELVDSFPRPESSSSEHIQAAAQDAALMFKPGRLSEPALESGQGLSRVGLSPDQIQAINESPLDSPRMGWMQDLEVADYEELYGQFFGQHDRDEFFEMQQFQSIWNSNN

SEQ ID NO: 819 - DNA, 1146 bp, Arabidopsis thaliana
  G1095,family:RING/C3H2C3
atggatctaacagaccgtcgtaacccttttaacaatcttgtttttccgccgccgcctccgccgccatccacgaccttcacaagccctatattcccacgaacaagctcttccggcaccaatttccccattctggccatcgcagtgattggaatcttagccactgcgttcttacttgtaagttactacatcttcgtgatcaaatgctgtcttaattggcaccaaatcgacatctttcgccgccgcagacgaagcagtgaccaaaaccctctaatgatttactctcctcatgaggtaaacagaggactagacgaatccgccattagagctatcccagtcttcaaattcaagaagagagacgttgttgcaggagaagaagatcagagtaagaactctcaagaatgctctgtttgtttaaacgagtttcaagaagacgagaagctaaggattattcctaactgctgccacgtgtttcacattgattgcattgatatctggcttcagggcaacgcaaattgtcccttgtgcagaaccagcgtttcttgcgaagcaagtttcactcttgacctaatctctgcaccgagctctcctcgggagaatagccctcattctcggaacaggaatctcgaacccggcctggttctaggaggcgatgatgacttcgtcgtcatagagcttggggccagtaatggtaacaacagagaaagcgtgagaaacatagacttccttacggagcaagaaagggttacctcgaatgaggtctcgaccggaaacagcccgaaatcggtgagtcctttgcctataaagtttggtaatcggggaatgtataagaaagaaaggaaatttcacaaagtgacgagtatgggagacgaatgtatcgatactagaggcaaagatggtcattttggtgaaattcagcccataagaagatcgatctcgatggattcatcagtggatcgtcagctgtacttggcggtccaagaggaaatcagccggagaaacaggcagattccggtagctggagacggtgaagatagtagcagtagtggtggtggtaatagcagagtcatgaagagatgtttcttctcttttggaagtagtagaacttcaaaaagttcttcaatattacctgtttatttggaaccctaa

SEQ ID NO: 820 - protein, 381 aa, Arabidopsis thaliana
  G1095,RING/C3H2C3 domain coordinates 134-159
MDLTDRRNPFNNLVFPPPPPPPSTTFTSPIFPRTSSSGTNFPILAIAVIGILATAFLLVSYYIFVIKCCLNWHQIDIFRRRRRSSDQNPLMIYSPHEVNRGLDESAIRAIPVFKFKKRDVVAGEEDQSKNSQECSVCLNEFQEDEKLRIIPNCCHVFHIDCIDIWLQGNANCPLCRTSVSCEASFTLDLISAPSSPRENSPHSRNRNLEPGLVLGGDDDFVVIELGASNGNNRESVRNIDFLTEQERVTSNEVSTGNSPKSVSPLPIKFGNRGMYKKERKFHKVTSMGDECIDTRGKDGHFGEIQPIRRSISMDSSVDRQLYLAVQEEISRRNRQIPVAGDGEDSSSSGGGNSRVMKRCFFSFGSSRTSKSSSILPVYLEP

SEQ ID NO: 821 - DNA, 909 bp, Arabidopsis thaliana
  G1100,family:RING/C3H2C3
atggtgcagcctggaaccgagataaaagcaagcgacctaaccctactagtaatcacgattatactcttcgcaatcttcatcgttggcttggcttcggtttgcttccgctggacctctcgccaattttactcacaagaatccatcaaccctttcactgactccgacgttgaatcccgtacgagtattacggcggtgcgtgggctcgacgaggctatcatcaactcatttccgacgtttctctactcggaggtgaaggagcggagaatcgggataggtggcgtcgagtgtgcagtgtgtatctgtgagttcgaagaccatgaaacgctccgtttgatgcctgaatgctgccacgtgtttcatgctgattgtgtaagtgtctggctctctgatcactccacgtgtccactctgtcgtgtggatctttgcttacaaccgggtgagagaagctacttgaatccggaaccggatcttgtagaatctacaaactcgcatttgtttgatggtgtgacgtggaccaataggaacagaccgtctcggtcatggtcaacgagattgtctcaatgtcgagtctcccagatattaatctcgagatcgcattcgaccggacattctgtggttcaaccgctagataatttagaccggtttacgcttcggttaccagaagaagtccggaggcaactgacgaaaaaaacggtggacaacgtggcattttctcaggctaggagctcacggcgtggttacagaagcagaagtgccggaagcgagaggagtgtcttctcgtaccaacggcggatgcattccttctctgattgtgcatggtccacctcctgtggcggagaagcggtggctccgtcaaaggattcccgccgaatatcagttgaacaatcccagctagatgatcgagtgtag

SEQ ID NO: 822 - protein, 302 aa, Arabidopsis thaliana
  G1100,RING/C3H2C3 domain coordinates 96-137
MVQPGTEIKASDLTLLVITIILFAIFIVGLASVCFRWTSRQFYSQESINPFTDSDVESRTSITAVRGLDEAIINSFPTFLYSEVKERRIGIGGVECAVCICEFEDHETLRLMPECCHVFHADCVSVWLSDHSTCPLCRVDLCLQPGERSYLNPEPDLVESTNSHLFDGVTWTNRNRPSRSWSTRLSQCRVSQILISRSHSTGHSVVQPLDNLDRFTLRLPEEVRRQLTKKTVDNVAFSQARSSRRGYRSRSAGSERSVFSYQRRMHSFSDCAWSTSCGGEAVAPSKDSRRISVEQSQLDDRV

SEQ ID NO: 823 - DNA, 1511 bp, Arabidopsis thaliana
  G1108,family:RING/C3H2C3
gtgtggtatgcgcaaagtggacaatacctagatgggtgtttctcttctgaaacaacaacatcgtattacaaatcaagctgatactttttctagattcatggaaagatcaccagagaataatctaagcagaaatgagcacatcatcattgacattccaagaaatgccgccattgcatcatcatcatcttctcatgatagaatctcaaatgttttggaacctttacaacatgaggaagagagaccttctactgtttctcccatggctgctcctcagccagctacagctacagcttcttcttcttcttctatgcgatcaaatcctagaagtgtccgtcgtagaagaagtcctttgaattctggcttatggatttctattgaactattcctcactgttggtcagatcattgcagctattgtcgttttgtctttgtcaaaacatgagcatcctcgtgctcctttgttcacttggattgttggttatgcgtgtggatgcgttgctacactcccgcttttgtactggagatattatcattcgaatcaggcttctgaacaggattctggtcagcaccgtcctaatcttaatgttgcagcaggaccattcgccttctcgatatccaggacatccgaagcagatggtcgacagaccaataccacctcttctcgtggtagtagatatcctgggtttataagtgctgccagacttaaagttatcgtggaatacttcaaaatggctctggattgcttctttgcggtgtggtttgtggtaggtaatgtatggatatttggagggcattcatctgctgccgaggctcctaacttgtacaggttatgtttagtgtttcttacctttagctgtattggctacgcgatgcccttcatcctctgtacaacaatatgttgctgcttgccttgcataatctcaattctcggatatagagaagatttaacgcaacctcgaggtgccacacctgagtcgattaatgcgttgccgactcataaatttaagttgaagaaaagcagaagtaatggcgatgacaatggttcaagtactagcgaaggtggagttgtggcggctggaacagataacgaacgagctatttcaggagaggacgcagtctgttgcatttgcttagcgaaatatgcgaataacgaggagttaagagagcttccatgctcacatttcttccacaaagagtgcgttgacaaatggctgaagatcaatgcctcttgccctctatgcaagagcgaagttggggagaagaactctgatttgactagccaagggatcttaacctcgctctcttctggggaaaacgataaccatcaacaacagcaacaacaacaacggagtgaacttagagttgagaatggtttggccaataatgttatctagatcttcgagatttgctctatgtccgagaaaacggcaaattagccgtttggcgatgttcctacacaaaatggggtttgcttctcattgctaagaaggtgaagaaagacacggcgaagat

SEQ ID NO: 824 - protein, 453 aa, Arabidopsis thaliana
  G1108,RING/C3H2C3 domain coordinates 363-403
MGVSLLKQQHRITNQADTFSRFMERSPENNLSRNEHIIIDIPRNAAIASSSSSHDRISNVLEPLQHEEERPSTVSPMAAPQPATATASSSSSMRSNPRSVRRRRSPLNSGLWISIELFLTVGQIIAAIVVLSLSKHEHPRAPLFTWIVGYACGCVATLPLLYWRYYHSNQASEQDSGQHRPNLNVAAGPFAFSISRTSEADGRQTNTTSSRGSRYPGFISAARLKVIVEYFKMALDCFFAVWFVVGNVWIFGGHSSAAEAPNLYRLCLVFLTFSCIGYAMPFILCTTICCCLPCIISILGYREDLTQPRGATPESINALPTHKFKLKKSRSNGDDNGSSTSEGGVVAAGTDNERAISGEDAVCCICLAKYANNEELRELPCSHFFHKECVDKWLKINASCPLCKSEVGEKNSDLTSQGILTSLSSGENDNHQQQQQQQRSELRVENGLANNVI

SEQ ID NO: 825 - DNA, 499 bp, Arabidopsis thaliana
  G1113,family:RING/C3H2C3
ctttctctcacactcatgggtcttccaacagatttcaaagagcttcagattccaggttacgtactaaaaacactttacgtcatcggtttctttagagacatggtcgatgctctttgtccttacatcggtctaccaagttttcttgaccacaacgagacctctcgatccgacccgacccgactcgctctctccacgtcagcaactcttgccaacgagttaatcccggtggttcgtttctccgatcttttaaccgatccggaagattgctgcacggtttgcttatccgattttgtatccgacgataagattagacagctgccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaataatgatggt

SEQ ID NO: 826 - protein, 157 aa, Arabidopsis thaliana
  G1113,RING/C3H2C3 domain coordinates 85-128
MGLPTDFKELQIPGYVLKTLYVIGFFRDMVDALCPYIGLPSFLDHNETSRSDPTRLALSTSATLANELIPVVRFSDLLTDPEDCCTVCLSDFVSDDKIRQLPKCGHVFHHRCLDRWIVDCNKITCPICRNRFLPEEKSTPFDWGTSDWFRDEVESTN

SEQ ID NO: 827 - DNA, 1556 bp, Arabidopsis thaliana
  G1128,family:AT-hook
atggaggagagagaaggaactaacatcaacaacatcccaaccagttttggtctgaaacaacatgaaactcctcttcctcctcctggttacccaccacggtctgaaaaccctaatctttttccggtgggtcaatccagcacttcctccgccgccgccgcggtgaaaccttctgagaatgttgctcctccttttagcttaacaatgccggtggagaattcttcttctgagttgaagaagaagagagggagaccaagaaagtataaccctgacggctcactcgctgtgactctctctcctatgcctatctcatcctccgttccgttgacgtcggagtttggttctcggaaacgaggaagaggtcgaggaagaggcagaggaagaggacgaggacgtggacaaggacaaggaagcagagagcccaataacaacaacaacgacaacaattggctcaagaatcctcagatgttcgaatttaacaacaacactcctacttctggtggaggaggacctgctgaaattgtcagtccaagttttacacctcatgtgctcacagtaaatgccggtgaggatgtgacaatgaagataatgacattctctcaacaaggctcgcgtgctatttgtattctttcagcgaacggtcccatatccaatgttacacttcgtcaatctatgacatctggtggtactctcacttatgagggtcattttgagattctttctttgacgggttcgtttataccaagcgagagtggaggaacccgaagcagagctggtgggatgagtgtctctcttgcaggacaagatggtcgtgtctttggtggtggacttgctggtctctttattgccgctggtcctgttcaggtaatggtagggagttttatagcgggtcaggaggaatcgcagcagcagcagcagcagataaagaagcaaagaagggaaagactcgggatcccgacaacaacacaagcttctaatatctcattcggtggctcagcggaagatcctaaggctagatacgggctcaacaagcctgttgttattcagccaccaccggtgtctgcaccacctgtgtccttttcgcatgaaccaagtactaacaccgtccatggttactatgcaaataacacagctaaccatatcaaggatctcttctcttccctccctggagaagatagggaagaagatgaggatgatttagaaggtgaagatgatgaagaattcggaggccatagcgaatctgacaccgaggttccaagctgatgatcgatggaaagaatccgacatatatgtgttatgaatcttgagttgttttatttcggtgtcttcagatttttttagagcgtaatggtattttttttctttcagattgttagttgttaaagtcttaaacagagatatttcactaaaagttagggtttactagaggatgtaatctttagggttctttgacttgtgtctttcttttaatcctcagatggttgttgtaggcttgtagccaatcttagtgtgtgttcaaactctctccttcaatcaaactccccaatgacttcattttg

SEQ ID NO: 828 - protein, 419 aa, Arabidopsis thaliana
  G1128,AT-hook domain coordinates 78-86,DUF296 178-293
MEEREGTNINNIPTSFGLKQHETPLPPPGYPPRSENPNLFPVGQSSTSSAAAAVKPSENVAPPFSLTMPVENSSSELKKKRGRPRKYNPDGSLAVTLSPMPISSSVPLTSEFGSRKRGRGRGRGRGRGRGRGQGQGSREPNNNNNDNNWLKNPQMFEFNNNTPTSGGGGPAEIVSPSFTPHVLTVNAGEDVTMKIMTFSQQGSRAICILSANGPISNVTLRQSMTSGGTLTYEGHFEILSLTGSFIPSESGGTRSRAGGMSVSLAGQDGRVFGGGLAGLFIAAGPVQVMVGSFIAGQEESQQQQQQIKKQRRERLGIPTTTQASNISFGGSAEDPKARYGLNKPVVIQPPPVSAPPVSFSHEPSTNTVHGYYANNTANHIKDLFSSLPGEDREEDEDDLEGEDDEEFGGHSESDTEVPS

SEQ ID NO: 829 - DNA, 1219 bp, Arabidopsis thaliana
  G1129,family:HLH/MYC
tcgactctttctccactctctctctctctcgttgcaagcaacttgttttctgaatccaaagaagacgataacgatgaatggagctataggaggtgaccttttgctcaattttcctgacatgtcggtcctagagcgccaaagggctcacctcaagtacctcaatcccacctttgattctcctctcgccggcttctttgccgattcttcaatgattaccggcggcgagatggacagctatctttcgactgccggtttgaatcttccgatgatgtacggtgagacgacggtggaaggtgattcaagactctcaatttcgccggaaacgacgcttgggactggaaatttcaagaaacggaagtttgatacagagactaaggattgtaatgagaagaagaagaagatgacgatgaacagagatgacctagtagaagaaggagaagaagagaagtcgaaaataacagagcaaaacaatgggagcacaaaaagcatcaagaagatgaaacacaaagccaagaaagaagagaacaatttctctaatgattcatctaaagtgacgaaggaattggagaaaacggattatattcatgttcgtgcacgacgaggccaagccactgatagtcacagcatagcagaacgagttagaagagaaaagatcagtgagagaatgaagtttctacaagatttggttcctggatgcgacaagatcacaggcaaagcagggatgcttgatgaaatcattaactatgttcagtctcttcagagacaaatcgagttcttatcgatgaaactagcaattgtgaatccaaggccggattttgatatggatgacatttttgccaaagaggttgcctcaactccaatgactgtggtgccatctcctgaaatggttctttccggttattctcatgagatggttcactctggttattctagtgagatggttaactccggttaccttcatgtcaatccaatgcagcaagtgaataccagttctgatccattgtcatgcttcaacaatggcgaagctccttcgatgtgggactctcatgtgcagaatctctatggcaatttaggagtttgattaagaaaccaatccacaacataacaatgttccctaattcaaattattcatcggaagagagagcaaaccagtagctgttatttactaattccactagattattgacttgagatcccccgcccattagttgatgtatca

SEQ ID NO: 830 - protein, 335 aa, Arabidopsis thaliana
  G1129,HLH/MYC domain coordinates 175-233
MNGAIGGDLLLNFPDMSVLERQRAHLKYLNPTFDSPLAGFFADSSMITGGEMDSYLSTAGLNLPMMYGETTVEGDSRLSISPETTLGTGNFKKRKFDTETKDCNEKKKKMTMNRDDLVEEGEEEKSKITEQNNGSTKSIKKMKHKAKKEENNFSNDSSKVTKELEKTDYIHVRARRGQATDSHSIAERVRREKISERMKFLQDLVPGCDKITGKAGMLDEIINYVQSLQRQIEFLSMKLAIVNPRPDFDMDDIFAKEVASTPMTVVPSPEMVLSGYSHEMVHSGYSSEMVNSGYLHVNPMQQVNTSSDPLSCFNNGEAPSMWDSHVQNLYGNLGV

SEQ ID NO: 831 - DNA, 1322 bp, Arabidopsis thaliana
  G1133,family:HLH/MYC
ttcaagaaagaatcaccaagtgttgcgttccacacatttgagcaacagcttccacaatcgtattgtattcctgtaaagttcccttggcttaaactgcaagagcatgcctcttgataccaaacagcagaaatggttgccattaggcttaaatcctcaagcttgtgtccaggacaaggcgactgagtatttccgtcctggaattccttttccggaactcggtaaagtttatgcagctgagcatcagtttcgctatttgcagccaccgttccaagccttattgtctagatatgatcagcagtcttgtggaaaacaagtttcatgtttgaatgggcgatctagcaacggtgctgctccagagggggcactcaagtcttctcggaaaagatttatagtattcgatcagtcgggagagcagactcgtttgttacaatgtggatttcctctgcggtttccttcttctatggatgcagagcgagggaacattctcggtgccctacacccagagaaagggtttagtaaagatcatgccattcaagaaaagatattgcaacatgaagatcatgaaaatggcgaagaagactcggaaatgcacgaagacactgaggaaatcaacgcgttactgtattctgatgatgacgataatgatgattgggaaagtgatgatgaagtaatgagcactggtcactctccattcacagttgaacaacaagcgtgcaacataacaacagaagagctggatgaaactgaaagcactgttgatggtccacttcttaaaagacagaaactactggaccattcgtacagagactcatcaccatcccttgtgggcaccactaaagtcaaaggcttatcagatgaaaaccttcctgaatcaaacatttcaagcaaacaagaaacgggttctggtttgagcgacgagcagtcaagaaaagacaagattcacaccgctctgagaatcctggagagtgtagttccaggggcaaagggaaaagaagctcttttactactagacgaagccattgattacctcaagttgctgaagcaaagcttaaactcatcaaagggtttgaataaccattggtgaaaaacctacaaccccttttgtcctattgataaggcatgtttggttggttaaagagaagacatgggacaaaagataatcaatgaggtaaaggactgatgaagaagattctctcaaattcattaacgtgggtttgaaacaattagaacacgcctggtgaccctagtgggaccgtatccactgttcatctagctggatcaatagtggtttacttttggatttggcatgctctctcaaaaaa

SEQ ID NO: 832 - protein, 326 aa, Arabidopsis thaliana
  G1133,HLH/MYC domain coordinates 260-317
MPLDTKQQKWLPLGLNPQACVQDKATEYFRPGIPFPELGKVYAAEHQFRYLQPPFQALLSRYDQQSCGKQVSCLNGRSSNGAAPEGALKSSRKRFIVFDQSGEQTRLLQCGFPLRFPSSMDAERGNILGALHPEKGFSKDHAIQEKILQHEDHENGEEDSEMHEDTEEINALLYSDDDDNDDWESDDEVMSTGHSPFTVEQQACNITTEELDETESTVDGPLLKRQKLLDHSYRDSSPSLVGTTKVKGLSDENLPESNISSKQETGSGLSDEQSRKDKIHTALRILESVVPGAKGKEALLLLDEAIDYLKLLKQSLNSSKGLNNHW

SEQ ID NO: 833 - DNA, 1064 bp, Arabidopsis thaliana
  G1134,family:HLH/MYC
taaagaaagagaaaaaaagctttcgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttgaaaagtatattatttgataaatggatgtaggtgtaatataaaatttttgtacaataatgaagaaagttaaaaagaattaatgaaaacatatattctttatgatataaaaaaaaaaa

SEQ ID NO: 834 - protein, 262 aa, Arabidopsis thaliana
  G1134,HLH/MYC domain coordinates 187-245
MQPTSVGSSGGGDDGGGRGGGGGLSRSGLSRIRSAPATWLEALLEEDEEESLKPNLGLTDLLTGNSNDLPTSRGSFEFPIPVEQGLYQQGGFHRQNSTPADFLSGSDGFIQSFGIQANYDYLSGNIDVSPGSKRSREMEALFSSPEFTSQMKGEQSSGQVPTGVSSMSDMNMENLMEDSVAFRVRAKRGCATHPRSIAERVRRTRISDRIRKLQELVPNMDKQTNTADMLEEAVEYVKVLQRQIQELTEEQKRCTCIPKEEQ

SEQ ID NO: 835 - DNA, 2215 bp, Arabidopsis thaliana
  G1136,family:HLH/MYC
caatcactaaacgccatttgcttagctttttccctcttttgatttttcctccctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattgaacaaagttggcatatcaaagaggggaaactagtgttttcatcgatgaaatgggatcgaatttagcgggtaatgtatggtcttttgtaaagtagtaagtactcattttgcatcactcgcttcatgttgttaaatgttgttgttcattaggagaacttgcttagttcttagcttagtgttatcataagccttaagtgagaaggaagttggagactagaagaccagagagagttagcgaaataataaaatctttggttgtacttgtatgtatatatatgtatggagtaagattaagtga

SEQ ID NO: 836 - protein, 592 aa, Arabidopsis thaliana
  G1136,HLH/MYC domain coordinates 408-465
MNGTTSSINFLTSDDDASAAAMEAFIGTNHHSSLFPPPPQQPPQPQFNEDTLQQRLQALIESAGENWTYAIFWQISHDFDSSTGDNTVILGWGDGYYKGEEDKEKKKNNTNTAEQEHRKRVIRELNSLISGGIGVSDESNDEEVTDTEWFFLVSMTQSFVNGVGLPGESFLNSRVIWLSGSGALTGSGCERAGQGQIYGLKTMVCIATQNGVVELGSSEVISQSSDLMHKVNNLFNFNNGGGNNGVEASSWGFNLNPDQGENDPALWISEPTNTGIESPARVNNGNNSNSNSKSDSHQISKLEKNDISSVENQNRQSSCLVEKDLTFQGGLLKSNETLSFCGNESSKKRTSVSKGSNNDEGMLSFSTVVRSAANDSDHSDLEASVVKEAIVVEPPEKKPRKRGRKPANGREEPLNHVEAERQRREKLNQRFYSLRAVVPNVSKMDKASLLGDAISYINELKSKLQQAESDKEEIQKKLDGMSKEGNNGKGCGSRAKERKSSNQDSTASSIEMEIDVKIIGWDVMIRVQCGKKDHPGARFMEALKELDLEVNHASLSVVNDLMIQQATVKMGSQFFNHDQLKVALMTKVGENY

SEQ ID NO: 837 - DNA, 1311 bp, Arabidopsis thaliana
  G1137,family:HLH/MYC
tacttcagacttctactcaaaccagtcacgtagttggttggtgacatttcgctgcatttttcaatctgtgattgtttttcgttcgtctttcttttactattttctcgaaaaggacacaagaagtattgcattcactcagttgagcaacttaacaatcgtgttgtactttttgaagttcccttgagctaaactgctaagagcatgcctctggataagaggcaacgggatttgcctctgggcttaagtcctcaagcttgcttcaaggatatagtaggtcggtctgtccttcctagaattcctctccctgagcttgggaaactatatgcagctaagcttcaggctcgctgtttgcagccaccaccattccagtctttgctgtgcagtcatgataaggagtcttatggaaaaagattctcacggtctgacatgcggtcttggtgcgctgctgctactactactactactccacttggagcattagagtcttctcagaaaagacttttgatattcgatcagtcaggagaccagactcgtctattacaatgtccatttcctctacggtttccatctcatgcggctgcagaaccagtgaaactctctgagttacaaggtatagagaaagctttcaaagaagatggtgaagagtttcacaagagtgatggaacagagtcagaaatgcatgaagacactgaggagatcaatgcattgctatattcagatgatgattatgatgatgattgcgagagtgatgatgaagtaatgagcactggtcactctccttatccaaatgaaggagtttgcaacaaaagggaattagaagaaatcgatggtccttgtaaaaggcagaaactactggataaggtcaacaacatcagcgacttatcatcacttgtgggcactgagagctccacacaactcaatggatcttcctttcttaaggacaaaaagctccctgaatcaaaaaccatatcgaccaaagaggacactggttctggtctgagcaacgagcagtcgaagaaagacaagatccgcacagctctgaaaatactcgagagcgtagtccctggtgcaaaaggaaacgaagcgctcttacttctggacgaagcaattgattacctaaagttgctgaaacgagacttaatctccacagaggttaagaaccaaagctccaccactcacaagtcaccaatcttgttgcttaaagagacaacatggggaacaagaaatctgcagacagataaggcgtgaaagattctgacgagttaaaacgtgtgaagtgggtttttgggtacgtatccttgcaccagcttt

SEQ ID NO: 838 - protein, 348 aa, Arabidopsis thaliana
  G1137,HLH/MYC domain coordinates 257-314
MPLDKRQRDLPLGLSPQACFKDIVGRSVLPRIPLPELGKLYAAKLQARCLQPPPFQSLLCSHDKESYGKRFSRSDMRSWCAAATTTTTPLGALESSQKRLLIFDQSGDQTRLLQCPFPLRFPSHAAAEPVKLSELQGIEKAFKEDGEEFHKSDGTESEMHEDTEEINALLYSDDDYDDDCESDDEVMSTGHSPYPNEGVCNKRELEEIDGPCKRQKLLDKVNNISDLSSLVGTESSTQLNGSSFLKDKKLPESKTISTKEDTGSGLSNEQSKKDKIRTALKILESVVPGAKGNEALLLLDEAIDYLKLLKRDLISTEVKNQSSTTHKSPILLLKETTWGTRNLQTDKA

SEQ ID NO: 839 - DNA, 956 bp, Arabidopsis thaliana
  G1140,family:MADS
atccaagatcctccaactcacagaaaggcagattcaagaacagtagtgaaggagagatctggtaaaatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatgaatctgagagagagaaagatccagcagagttgacttcgatggaagcccacaaatattaagtctaccttttccctttcttttctttgaataagtgttgaaaaagaattgagatgggaaggatgaattctcattgcattgcagagaagcaagtttcagatattgtacgtgttattgggtctttataactatttttctccccaaaaaaaaaaaaaaaaaaaaaaaaaaaaa

SEQ ID NO: 840 - protein, 220 aa, Arabidopsis thaliana
  G1140,MADS domain coordinates 2-57
MAREKIRIKKIDNITARQVTFSKRRRGIFKKADELSVLCDADVALIIFSATGKLFEFSSSRMRDILGRYSLHASNINKLMDPPSTHLRLENCNLSRLSKEVEDKTKQLRKLRGEDLDGLNLEELQRLEKLLESGLSRVSEKKGECVMSQIFSLEKRGSELVDENKRLRDKLETLERAKLTTLKEALETESVTTNVSSYDSGTPLEDDSDTSLKLGLPSWE

SEQ ID NO: 841 - DNA, 1037 bp, Arabidopsis thaliana
  G1142,family:HLH/MYC
attaattaacaaaaaaccaaaagaaggcggcgcaaacaaaagataatgcaaccagagacctcagatcagatgttgtactcgtttcttgccggaaacgaagtcggcggtggagggtactgcgtctccggcgactacatgacgactatgcagagcttatgtgggtcttcgtcgtcgacgtcatcgtattacccactggcgatctccggcatcggagaaacgatggctcaagacagagctttagctgctttgaggaaccacaaagaagctgagagaagaaggagagagaggatcaattctcatctcaacaagcttcgtaacgtactctcttgtaattctaagaccgataaagccacactgctcgccaaagtagttcaacgagtcagagaacttaaacagcaaaccctagagacctccgactccgaccaaacattattaccatcagagaccgacgaaattagtgttctacactttggagactattcaaacgacggtcatataatcttcaaagcctctctatgttgtgaagatagatcagatctcttgccggaccttatggagattctcaagtctcttaacatgaagactctccgagctgagatggtaaccattggtggtcggacaagaagtgttcttgtcgtagctgctgacaaagagatgcacggcgtcgagtctgtgcattttttgcaaaatgctctcaagtcgctgcttgagcggtcaagcaagtcgttgatggaacgtagttctggtggtggaggaggagaacggtcaaagcggcgtcgtgcgctggatcacatcataatggtgtgaaatgatgagaattgagcacactaaaaagtctataattgattaatatatatagggtatgatcataattaacttggttataattaccaaaaccttttttattcctctttaataatatatatgttatatggttttagttactaagtcttgggagtgtaagcaaatgttgtaagtaggtttggtgtgttctttttcttttcttttttttttctttttcaaaaaaaaaaaaaaaa

SEQ ID NO: 842 - protein, 253 aa, Arabidopsis thaliana
  G1142,HLH/MYC domain coordinates 63-120
MQPETSDQMLYSFLAGNEVGGGGYCVSGDYMTTMQSLCGSSSSTSSYYPLAISGIGETMAQDRALAALRNHKEAERRRRERINSHLNKLRNVLSCNSKTDKATLLAKVVQRVRELKQQTLETSDSDQTLLPSETDEISVLHFGDYSNDGHIIFKASLCCEDRSDLLPDLMEILKSLNMKTLRAEMVTIGGRTRSVLVVAADKEMHGVESVHFLQNALKSLLERSSKSLMERSSGGGGGERSKRRRALDHIIMV

SEQ ID NO: 843 - DNA, 805 bp, Arabidopsis thaliana
  G1143,family:HLH/MYC
aaataagaatataaacacttttgtctgaaaaattatcaaagaagaagaaataaatgggtggaggaagcagatttcaagaaccagtgaggatgagccgtaggaaacaagtaacaaaagagaaggaagaagatgaaaacttcaaatctccaaatcttgaagcagagagacgtagaagagagaagcttcattgtcggcttatggctctgcgatctcatgtccccattgtcaccaacatgactaaagcaagtattgttgaagatgcgattacttacataggagagcttcaaaacaatgttaagaatctcttagagacatttcatgaaatggaagaagctcctcctgagattgatgaagaacaaacggatccaatgataaaacctgaagttgaaactagtgatcttaacgaagagatgaagaaactcggaatcgaggagaatgtgcaattgtgtaagattggggagaggaagttttggttaaagatcataacagagaagagagatgggatctttactaaattcatggaggttatgagatttctcggattcgagattatcgatattagtctaacaacttcaaatggagcaattcttattagtgcctctgttcagacacaggaactctgtgatgttgaacagacaaaagattttcttttggaagttatgagaagcaatccataagtattaattatatacatcttggaaatttcttgatctaataacatttccattggtttttattacattgttgttccattttaaatatgatatgattcagatgaaaaagagtttgtgttacaagccaatga

SEQ ID NO: 844 - protein, 207 aa, Arabidopsis thaliana
  G1143,HLH/MYC domain coordinates 25-82
MGGGSRFQEPVRMSRRKQVTKEKEEDENFKSPNLEAERRRREKLHCRLMALRSHVPIVTNMTKASIVEDAITYIGELQNNVKNLLETFHEMEEAPPEIDEEQTDPMIKPEVETSDLNEEMKKLGIEENVQLCKIGERKFWLKIITEKRDGIFTKFMEVMRFLGFEIIDISLTTSNGAILISASVQTQELCDVEQTKDFLLEVMRSNP

SEQ ID NO: 845 - DNA, 1357 bp, Arabidopsis thaliana
  G1145,family:bZIP
gtgatttctctctgccatttccttcgatttgatttctgggttctcttcttctcgtctctcttctgcatgtttcgccactctaccttagaaaaaaggttactttcgcctccgatttaggctcgatttgatgaattcgtcgtcgtgtggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggcttacactcatgagctagagatcaaagtttcacggttagaagaagaaaacgaaagactcaggaagcaaaaggaggtggaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaattctgttaactttaaaatattctcgagttattgtagtagcagactagcagcagtaatggttttcatgagtccgattgaaattcagagattgaacaggaaaaaa

SEQ ID NO: 846 - protein, 299 aa, Arabidopsis thaliana
  G1145,bZIP domain coordinates 227-270
MDSQRGIVEQAKSQSLNRQSSLYSLTLDEVQNHLGSSGKALGSMNLDELLKSVCSVEANQPSSMAVNGGAAAQEGLSRQGSLTLPRDLSKKTVDEVWKDIQQNKNGGSAHERRDKQPTLGEMTLEDLLLKAGVVTETIPGSNHDGPVGGGSAGSGAGLGQNITQVGPWIQYHQLPSMPQPQAFMPYPVSDMQAMVSQSSLMGGLSDTQTPGRKRVASGEVVEKTVERRQKRMIKNRESAARSRARKQAYTHELEIKVSRLEEENERLRKQKEVEKSSQVYHRLIPSGSSDGQARLLSDL

SEQ ID NO: 847 - DNA, 3323 bp, Arabidopsis thaliana
  G1146,family:PAZ
cttctctagcgtcactcttcttcttcattggtcggtagaataaggccaaggaagggatcagttttaagttttgtttcattctttttgtagtggagaaaaagagtttttgaaaatcaaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaaaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcgatatggcttcagctgcattcatcgagcctcttccagtgatagagtttgtagcacagcttcttggaaaggatgtcttgtcgaagccattgtcggattctgatcgcgtcaagattaagaagggtcttagaggagtgaaagtagaggttactcacagagcgaatgtaagaaggaaataccgtgttgcgggtttaacaactcaaccaacaagagagctaatgtttccagtagatgagaactgtactatgaagtcagttattgagtatttccaagagatgtatggattcacgatccagcacacgcatttgccatgtctccaagttggaaaccaaaagaaggcaagctatttgccgatggaggcatgcaaaattgtcgagggacaacggtacacgaaaaggttgaatgagaagcagattactgctctcttgaaagttacatgccaaagggccgagggacagagaaacgatattttgcggactgtccaacacaacgcatatgatcaagatccatatgcaaaggagtttggcatgaacataagcgaaaagttagcttctgttgaagctcgtattcttccagctccatggcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtgatcttaagagaatctgtgaaaccgagcttggtttgatatctcaatgttgtctcacaaaacatgtgttcaagattagcaaacagtatctggcagatgtatcccttaaaatcaacgtaaagatgggaggaaggaacacagttctagtagacgccataagctgtagaattccactggttagcgatataccgacaatcatttttggcgcagacgtgactcacccagagaacggggaagagtcaagcccttcaatcgctgctgttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcagggaccttcttatctcatttagaaaagcaacagggcaaaaaccgcttcgaattatcttttatcgtgatggagtaagcgaagggcaattctatcaagttttactctatgagttggatgcaattcgaaaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggtactgtagttgacactaaaatatgtcatccaactgaattcgacttctacctttgtagccatgcgggtattcagggaacaagcaggcctgcacattaccatgttctttgggacgagaacaatttcacagcagatggtattcaatctctgactaacaatctctgttatacctatgcgcggtgcactcggtcggtctctatagttcctccagcgtattatgctcatcttgcagcatttcgagcacgtttctacctggaacctgagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgtagttcggctttagatttaccaatgtttttcttatgtaaattttgtcggtttggtttaagcctttaggaattagtgtattagggtttttctaaagttgtactttagctgatgataacgttgatgcagtgactttgttaaaacctcctcttctacagtagtgtttacgtcgttcctc

SEQ ID NO: 848 - protein, 988 aa, Arabidopsis thaliana
  G1146,PAZ domain coordinates 886-896
MPIRQMKDSSETHLVIKTQPLKHHNPKTVQNGKIPPPSPSPVTVTTPATVTQSQASSPSPPSKNRSRRRNRGGRKSDQGDVCMRPSSRPRKPPPPSQTTSSAVSVATAGEIVAVNHQMQMGVRKNSNFAPRPGFGTLGTKCIVKANHFLADLPTKDLNQYDVTITPEVSSKSVNRAIIAELVRLYKESDLGRRLPAYDGRKSLYTAGELPFTWKEFSVKIVDEDDGIINGPKRERSYKVAIKFVARANMHHLGEFLAGKRADCPQEAVQILDIVLRELSVKRFCPVGRSFFSPDIKTPQRLGEGLESWCGFYQSIRPTQMGLSLNIDMASAAFIEPLPVIEFVAQLLGKDVLSKPLSDSDRVKIKKGLRGVKVEVTHRANVRRKYRVAGLTTQPTRELMFPVDENCTMKSVIEYFQEMYGFTIQHTHLPCLQVGNQKKASYLPMEACKIVEGQRYTKRLNEKQITALLKVTCQRAEGQRNDILRTVQHNAYDQDPYAKEFGMNISEKLASVEARILPAPWLKYHENGKEKDCLPQVGQWNMMNKKMINGMTVSRWACVNFSRSVQENVARGFCNELGQMCEVSGMEFNPEPVIPIYSARPDQVEKALKHVYHTSMNKTKGKELELLLAILPDNNGSLYGDLKRICETELGLISQCCLTKHVFKISKQYLADVSLKINVKMGGRNTVLVDAISCRIPLVSDIPTIIFGADVTHPENGEESSPSIAAVVASQDWPEVTKYAGLVCAQAHRQELIQDLYKTWQDPVRGTVSGGMIRDLLISFRKATGQKPLRIIFYRDGVSEGQFYQVLLYELDAIRKACASLEPNYQPPVTFIVVQKRHHTRLFANNHRDKNSTDRSGNILPGTVVDTKICHPTEFDFYLCSHAGIQGTSRPAHYHVLWDENNFTADGIQSLTNNLCYTYARCTRSVSIVPPAYYAHLAAFRARFYLEPEIMQDNGSPGKKNTKTTTVGDVGVKPLPALKENVKRVMFYC

SEQ ID NO: 849 - DNA, 2973 bp, Arabidopsis thaliana
  G1150,family:PAZ
atggaagaaaaaactcatcatcatcatcacagtaccaacaaacacatccctagttccaaatcaagaacacctcttctccacaagccttatcatcaccatgttcaaaccaatcctcctccttttcttttgcacccttcttctcaccaaaacctcaatcttgttgcctcaaatcttccttctagctactactactattactactgctacttctactctcaatttcacaactctcttcctcctcctcctcctcctcatcttcttcctctttctcctcctcttcctcctttacttcctcttcctcctcctcactcaatgacccgtttccacaaatctctccctgtttctcaagttgtggagagaaagcagcaacaccaacagaagaagaagatacaagtttctaacaacaaagtgagtggatccatagcaatagaagaagcagcattagtggttgctaaaagaccggactttggtggtcaagatggttctgtcatttatctcctcgccaaccattttcttgtcaagtttgattcgtcacagaggatttaccattacaatgttgagatatctccacagccttcaaaggaaattgctagaatgatcaaacagaagcttgttgagacagatcgtaatagcttctctggtgttgttccggcttttgacggcaggcaaaacatttacagccctgtggagtttcagggagataggcttgagttctttgttaatctccctatcccatcttgcaaggctgtgatgaattacggtgacttgcgtgagaagcaacctcagaagaagattgagaaactgtttagggttaatatgaagcttgtgtccaagtttgatggtaaagaacagagaaaggaaggagaggattgggctcctctgcctccagaatacattcatgctcttgatgttatcttgagagagaatccaatggagaagtgtacatcgatcggaagatcgttttactcgagttctatgggtggatctaaggagattggaggaggagctgttggactcagagggtttttccagagtcttagacatactcagcaaggtttagcacttaacatggatctctcaatcacagctttccatgaaagtattggagtaatagcttacttgcagaagcggctcgagtttcttacggaccttcctaggaacaaaggtagagaattgagtttagaggaaaagagagaagtggagaaagcacttaagaacataagagtctttgtttgccatagagaaacagttcaaaggtatcgagtttatgggttaacagaggaaattacggagaatatatggtttcctgatagagaagggaaatatctaaggcttatgagttacttcaaagatcattatggttatgagattcagttcaagaacttgccgtgtctgcaaatcagtagggcaagaccttgttaccttcctatggagctatgcatgatttgtgaaggtcaaaagtttcttggaaagctatcagatgatcaagctgcaaagatcatgaaaatgggctgccaaaaacctaatgaaaggaaagctattattgataaggttatgacaggatcggtcggtccatcgagcggaaaccaaacaagagaattcaaccttgaggtttcaagagaaatgacattgctgaaaggaagaatacttcagccaccaaagcttaaacttgaccggccaaggaaccttaaagaaagtaaagtttttaaaggaactagaattgagagatgggctttgatgagtattggaggcagctctgatcagaaatctaccattcccaagttcataaacgagcttactcaaaagtgtgagcatttgggagtcttcttaagcaagaacacattaagcagtaccttctttgaaccatcacacatactcaacaacatttcgcttctcgaatcaaaactgaaggagattcaaagagcggcatcgaacaatctccagctgattatttgtgtaatggagaaaaaacataaagggtacggagatctaaagaggatatcagagacaagaattggtgttgtgacacaatgctgcttataccctaacatcactaagctcagttctcagttcgtttcgaacttagctctcaagataaacgccaagatcggtggatccatgaccgagctctacaactcgataccttctcacatccctagactgcttagacccgatgagccggttatcttcatgggagctgatgtaacgcatcctcatccattcgatgattgtagcccttcagtagcggctgtggtagggagcataaactggccagaagctaaccgatacgtctcaagaatgaggtctcagactcataggcaagagatcatacaagatcttgacttgatggtcaaggaacttcttgatgatttttacaaagcggtaaaaaagcttccgaatcgaatcatattcttcagggacggtgttagcgagacacagttcaagaaagttctccaagaagagcttcaatcgataaaaactgcttgttcgaagttccaagattacaatccaagcatcacattcgccgtggttcagaaaagacaccacacaaggctgttccggtgcgatccagaccatgagaacatacctcctggtacagtggttgatacagtgataactcatccgaaagagtttgatttttatctctgtagccatttaggagtgaagggcacgagcaggccaacgcattaccatattctatgggacgagaacgagttcacttcagacgaattgcagagacttgtgtataatttgtgttacactttcgtgaggtgcacgaaacctatatcgattgtgccaccggcttattatgctcaccttgctgcgtacagaggaaggctatacatcgagagatcatctgaatctaatggaggatccatgaatccttcttctgtgtctcgtgttggtcctccaaagacgattcctcttcctaaattaagtgataatgtcaagaatctcatgttttactgctga

SEQ ID NO: 850 - protein, 990 aa, Arabidopsis thaliana
  G1150,PAZ domain coordinates 887-907
MEEKTHHHHHSTNKHIPSSKSRTPLLHKPYHHHVQTNPPPFLLHPSSHQNLNLVASNLPSSYYYYYYCYFYSQFHNSLPPPPPPHLLPLSPPLPPLLPLPPPHSMTRFHKSLPVSQVVERKQQHQQKKKIQVSNNKVSGSIAIEEAALVVAKRPDFGGQDGSVIYLLANHFLVKFDSSQRIYHYNVEISPQPSKEIARMIKQKLVETDRNSFSGVVPAFDGRQNIYSPVEFQGDRLEFFVNLPIPSCKAVMNYGDLREKQPQKKIEKLFRVNMKLVSKFDGKEQRKEGEDWAPLPPEYIHALDVILRENPMEKCTSIGRSFYSSSMGGSKEIGGGAVGLRGFFQSLRHTQQGLALNMDLSITAFHESIGVIAYLQKRLEFLTDLPRNKGRELSLEEKREVEKALKNIRVFVCHRETVQRYRVYGLTEEITENIWFPDREGKYLRLMSYFKDHYGYEIQFKNLPCLQISRARPCYLPMELCMICEGQKFLGKLSDDQAAKIMKMGCQKPNERKAIIDKVMTGSVGPSSGNQTREFNLEVSREMTLLKGRILQPPKLKLDRPRNLKESKVFKGTRIERWALMSIGGSSDQKSTIPKFINELTQKCEHLGVFLSKNTLSSTFFEPSHILNNISLLESKLKEIQRAASNNLQLIICVMEKKHKGYGDLKRISETRIGVVTQCCLYPNITKLSSQFVSNLALKINAKIGGSMTELYNSIPSHIPRLLRPDEPVIFMGADVTHPHPFDDCSPSVAAVVGSINWPEANRYVSRMRSQTHRQEIIQDLDLMVKELLDDFYKAVKKLPNRIIFFRDGVSETQFKKVLQEELQSIKTACSKFQDYNPSITFAVVQKRHHTRLFRCDPDHENIPPGTVVDTVITHPKEFDFYLCSHLGVKGTSRPTHYHILWDENEFTSDELQRLVYNLCYTFVRCTKPISIVPPAYYAHLAAYRGRLYIERSSESNGGSMNPSSVSRVGPPKTIPLPKLSDNVKNLMFYC

SEQ ID NO: 851 - DNA, 1239 bp, Arabidopsis thaliana
  G1181,family:HS
ctcgatcttttaacccccattattacatattactccttcctacattattcttcttctgctttcgtgactttcaggggacacttttgtttttataacttacgcttaaaatcctatgaattcgccgccggttgacgcaatgattaccggagaatcatcgtcacaaagatctatcccaacgccgtttctcacaaaaacgtttaacctcgttgaagatagttccatcgacgatgttatctcatggaacgaagatggttcctctttcatcgtatggaatccgacagatttcgctaaagatttgcttcctaaacacttcaaacacaacaatttctctagtttcgttcgtcagctcaacacttacggattcaaaaaagttgtaccggatcgatgggagttttcaaacgatttctttaagagaggagaaaaacgtcttctccgtgagatccaacgtcggaaaataacaacgacgcatcaaacagttgttgctccttcgtcggaacaacgaaaccagacgatggttgtatcaccgtcaaattccggggaagataataataataatcaggtgatgtcttcgtctccgtcgtcgtggtattgtcatcaaacgaagacgactgggaatggtggtttatcagtggagttattggaagagaacgagaagcttcggagtcaaaacattcagctaaaccgtgagcttactcagatgaaatctatctgcgataatatctatagtctcatgtcgaattacgtcggatctcagcccactgatcggagttattctcccggaggtagtagtagtcaaccgatggagtttttaccggcgaagcggttttcggagatggagattgaagaagaagaagaagcgagtccgaggttgtttggtgttccgattgggttaaaacggacgagaagtgaaggtgttcaggtgaagacgacggcggtggttggggaaaattccgatgaggagacgccgtggttgagacattataatcgaaccaatcagagagtttgtaattaaaaacgaacggtttagatttgtggtgtagatatgtgcgcgaagtagacgattacagctttttaagacaagcagagcacgtgtcccatctgtttcaagaagtttctgcaatcttgacttcttcttttaacactttgtgttttttattatttaattaataacaataaatgttctttttcagttttgttttcttcaaaaatagttcggctgtttctagactttcctttttt

SEQ ID NO: 852 - protein, 299 aa, Arabidopsis thaliana
  G1181,HS domain coordinates 23-114
MNSPPVDAMITGESSSQRSIPTPFLTKTFNLVEDSSIDDVISWNEDGSSFIVWNPTDFAKDLLPKHFKHNNFSSFVRQLNTYGFKKVVPDRWEFSNDFFKRGEKRLLREIQRRKITTTHQTVVAPSSEQRNQTMVVSPSNSGEDNNNNQVMSSSPSSWYCHQTKTTGNGGLSVELLEENEKLRSQNIQLNRELTQMKSICDNIYSLMSNYVGSQPTDRSYSPGGSSSQPMEFLPAKRFSEMEIEEEEEASPRLFGVPIGLKRTRSEGVQVKTTAVVGENSDEETPWLRHYNRTNQRVCN

SEQ ID NO: 853 - DNA, 2324 bp, Arabidopsis thaliana
  G1190,family:AKR
tcctgtcccaaaaccaaaagacttgagagtgtgtctttagagagagatcttctctcttttatcttacgactctcacttcttatctcaaatctacttcaactctatttccagtctccacattttcccacaaatttcaactcttgttctcttcctccaaagtaaaaaacaaatcgttgcaagtgaggtttggttttggtgttatagaattatgaagagcgggaagcaatcttcgcaacctgaaaagggtacttccaggatcttgtcactgactgtcctgtttatcgcattttgcggtttctccttctacctcggtggtatattttgctctgagagagacaagattgtagccaaggatgtcacaaggacgactacaaaggctgtagcttcccctaaagaacctacagctactcctattcaaatcaaatccgtttctttcccggagtgcgggtcagagttccaagattacaccccgtgcaccgatccaaagaggtggaagaagtatggtgtccatcgcttaagtttcttggagcgtcattgtcctccggtatatgaaaagaatgagtgtttgattccaccaccagacgggtataaaccgcctataagatggcccaagagccgagaacagtgttggtacaggaacgtgccttatgattggatcaataagcaaaagtctaaccagcattggcttaagaaagaaggagataagttccatttccctggtggtggtaccatgttccctcgtggagttagtcactatgttgatttgatgcaagatctgattcctgaaatgaaagacggaacagtcaggaccgccattgatactggctgtggggttgcgagctggggaggcgatcttttggaccgtgggatactatcactctctcttgctccaagagataaccatgaagctcaggttcaatttgctcttgaacgtggaattcctgcgattctcgggatcatctctacgcaacgtctcccttttccttcaaatgcatttgatatggctcattgttcaagatgtcttattccctggacagaatttggtggaatctatttacttgagattcaccgtatagttcgacctggaggtttttgggttctttctggtccacctgtgaactataatagacgatggcgtggatggaacacaaccatggaagatcagaaatctgactacaacaagcttcagtcacttctaacctccatgtgtttcaaaaagtacgctcaaaaagatgacatagccgtgtggcagaaactctcagacaaatcttgctatgacaaaatcgctaagaacatggaagcttaccctcccaaatgtgacgacagtatagaacctgattctgcttggtacactccactccgtccttgcgtggttgccccgacacctaaagtcaagaagtctggtctcggatcaatcccaaaatggcccgagaggttacatgtcgcgcccgagagaatcggtgatgttcacggagggagtgcgaacagtttgaaacacgatgatggtaaatggaagaacagagttaagcattacaagaaagttttaccagctcttgggacagacaagataagaaatgttatggatatgaacactgtttatggaggtttctctgcggccctcattgaggatcccatttgggtcatgaacgttgtatcatcgtacagcgcaaattcgcttcctgttgtctttgatcgcggtctcatcgggacttaccacgactggtgcgaagctttctcaacgtatccaagaacatatgatcttcttcacctcgacagtctttttaccttggagagtcacaggtgtgagatgaagtacattttgctagagatggacaggatcttgcggccgagtggatatgttataatccgagaatcgagttatttcatggacgcaatcacaacgttagcgaaagggataaggtggagttgccggagagaggagactgagtatgcagtcaaaagtgagaagattctggtttgccagaaaaagctatggttttcgtcaaaccaaacctcttgatgagaccacctgtatcatagtgtttatcatctcctgtgatgcacactacagagagaaggatctagtcctttgagtccaagatatagctctataaacaatctcctttttttgttctctttaatttcttgggtatttcacggtatagattgatattatatattttttaattatatttttaatatatagatatattagtatgtggtttaaacactattattatcaaggtcttaaagatttgctttgcaagagttaaaaaatgttggagtaaggacctcttgattaataaattgactgacgcagcaaa

SEQ ID NO: 854 - protein, 603 aa, Arabidopsis thaliana
  G1190,AKR domain coordinates 85-593
MKSGKQSSQPEKGTSRILSLTVLFIAFCGFSFYLGGIFCSERDKIVAKDVTRTTTKAVASPKEPTATPIQIKSVSFPECGSEFQDYTPCTDPKRWKKYGVHRLSFLERHCPPVYEKNECLIPPPDGYKPPIRWPKSREQCWYRNVPYDWINKQKSNQHWLKKEGDKFHFPGGGTMFPRGVSHYVDLMQDLIPEMKDGTVRTAIDTGCGVASWGGDLLDRGILSLSLAPRDNHEAQVQFALERGIPAILGIISTQRLPFPSNAFDMAHCSRCLIPWTEFGGIYLLEIHRIVRPGGFWVLSGPPVNYNRRWRGWNTTMEDQKSDYNKLQSLLTSMCFKKYAQKDDIAVWQKLSDKSCYDKIAKNMEAYPPKCDDSIEPDSAWYTPLRPCVVAPTPKVKKSGLGSIPKWPERLHVAPERIGDVHGGSANSLKHDDGKWKNRVKHYKKVLPALGTDKIRNVMDMNTVYGGFSAALIEDPIWVMNVVSSYSANSLPVVFDRGLIGTYHDWCEAFSTYPRTYDLLHLDSLFTLESHRCEMKYILLEMDRILRPSGYVIIRESSYFMDAITTLAKGIRWSCRREETEYAVKSEKILVCQKKLWFSSNQTS

SEQ ID NO: 855 - DNA, 2054 bp, Arabidopsis thaliana
  G1196,family:AKR
catctgttctgagattgtcttcttcttcttgaaatctttttcatttgtgcaatgattttgaagactacccatctattcagttctttctcttatgatttaagtttcatttagtttttttttctcatccgccattttcgttgactttttgaagcatttctcgaattgactttgttcttcacattgattcattagaatgttctttcataaagtttggatcttttcttcagggcttgattaatttcatatctatgatcttctctgtattgtttttgatccaatcacttctcaaaatttgatccttgtcattggatttagatttagggtttttgtatccttggggatttgaagatcaaaaacagagtctttgagtgatacttctggggaacaaaatggctgcaactgcaatagagccatcttcatctataagtttcacatcttctcacttatcaaacccttctcctgttgttactacttatcactcagctgctaatcttgaagagctcagctctaacttggagcagcttctcactaatccagattgcgattacactgacgcagagatcatcattgaagaagaagctaaccctcggaagcttcgtaactatgttgagaagtcactagtagagaatgttcttcctatcctcttagttgcgtttcattgtgatttgacacagcttcttgatcaatgcattgagagagtggcgagatcagacttagacagattctgtatcgaaaaggagcttcctttagaagtattggaaaaaatcaaacagcttcgagttaagtcggtgaacatacccgaggtggaggataaatcgatagagagaacagggaaagtactcaaggcattggattcagatgatgtagaactcgtgaagcttcttttgactgagtcagatataactctagaccaagccaatggtctacattatgcagtggcatacagtgatccgaaagttgtgacacaggttcttgatctagatatggctgatgttaatttcagaaattccagggggtatacggttcttcatattgctgctatgcgtagagagccaacaattatcataccacttattcaaaaaggagctaatgcttcagatttcacgtttgatggacgcagtgcggtaaatatatgtaggagactcactaggccgaaagattatcataccaaaacctcaaggaaagaacctagtaaataccgcttatgcatcgatatcttggaaagggaaattagaaggaatccattggttagtggggatacacccacttgttcccattcgatgcccgaggatctccaaatgaggttgttatacttagaaaagcgagtgggacttgctcagttgttcttcccagcagaagccaatgtggctatggacgttgctaatgttgaagggacaagcgagtgcacaggtcttctaactccacctccatcaaatgatacaactgaaaacttgggtaaagtcgatttaaatgaaacgccttatgtgcaaacgaaaagaatgcttacacgtatgaaagccctcatgaaaacagttgagacaggtcggagatacttcccatcttgttatgaggttctggataagtacatggatcagtatatggacgaagaaatccctgatatgtcgtatcccgagaaaggcactgtgaaagagagaagacagaagaggatgagatataacgagctgaagaacgacgttaaaaaagcatatagcaaagacaaagtcgcgcggtcttgtctttcttcttcatcaccagcttcttctcttagagaagccttagagaatccaacatgatcttgtcccagataagtaatgctactagagatagttccttggaagaaattagctattttataggttttggtttagaaaacagtggagatcccattttggtattcaggtttattacatggtttaggtttgattttgtattaaaggagatggatttttgaaatgtataaagcaaaacctttcctttttgctttgcttctttctttaaaaaaaaaattgtaatatatggaagtgaaatcgaagcaacgattgagcaaaaaaaaa

SEQ ID NO: 856 - protein, 467 aa, Arabidopsis thaliana
  G1196,AKR domain coordinates 179-254
MAATAIEPSSSISFTSSHLSNPSPVVTTYHSAANLEELSSNLEQLLTNPDCDYTDAEIIIEEEANPRKLRNYVEKSLVENVLPILLVAFHCDLTQLLDQCIERVARSDLDRFCIEKELPLEVLEKIKQLRVKSVNIPEVEDKSIERTGKVLKALDSDDVELVKLLLTESDITLDQANGLHYAVAYSDPKVVTQVLDLDMADVNFRNSRGYTVLHIAAMRREPTIIIPLIQKGANASDFTFDGRSAVNICRRLTRPKDYHTKTSRKEPSKYRLCIDILEREIRRNPLVSGDTPTCSHSMPEDLQMRLLYLEKRVGLAQLFFPAEANVAMDVANVEGTSECTGLLTPPPSNDTTENLGKVDLNETPYVQTKRMLTRMKALMKTVETGRRYFPSCYEVLDKYMDQYMDEEIPDMSYPEKGTVKERRQKRMRYNELKNDVKKAYSKDKVARSCLSSSSPASSLREALENPT

SEQ ID NO: 857 - DNA, 1780 bp, Arabidopsis thaliana
  G1198,family:bZIP
tcttttcaaattccaatcatttgatcaactaatcaagaattaattataagactttgcaatctctctccctctccctctccctagctagttctctcttgtgtttcttaactcgagcttctctcaatagtgattatcatctttttcatcatttcaagatttaatgtgttttgcagaaaagagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttcctttaaagttgtactagagaaaagataggatcttccttcg

SEQ ID NO: 858 - protein, 481 aa, Arabidopsis thaliana
  G1198,bZIP domain coordinates 173-223
MANHRMSEATNHNHNHHLPYSLIHGLNNNHPSSGFINQDGSSSFDFGELEEAIVLQGVKYRNEEAKPPLLGGGGGATTLEMFPSWPIRTHQTLPTESSKSGGESSDSGSANFSGKAESQQPESPMSSKHHLMLQPHHNNMANSSSTSGLPSTSRTLAPPKPSEDKRKATTSGKQLDAKTLRRLAQNREAARKSRLRKKAYVQQLESSRIKLSQLEQELQRARSQGLFMGGCGPPGPNITSGAAIFDMEYGRWLEDDNRHMSEIRTGLQAHLSDNDLRLIVDGYIAHFDEIFRLKAVAAKADVFHLIIGTWMSPAERCFIWMAGFRPSDLIKILVSQMDLLTEQQLMGIYSLQHSSQQAEEALSQGLEQLQQSLIDTLAASPVIDGMQQMAVALGKISNLEGFIRQADNLRQQTVHQLRRILTVRQAARCFLVIGEYYGRLRALSSLWLSRPRETLMSDETSCQTTTDLQIVQSSRNHFSNF

SEQ ID NO: 859 - DNA, 2127 bp, Arabidopsis thaliana
  G1202,family:AKR
caaatcacatattttgtgaaatcccaaagaaagtttttgctttcaccggccagtcatgggaaactatcggtggccgtcaaagctatcaaagttatcactcagagcaaaacaaacgaatctgtaccgcgtcattctaatcgcgatcctctgcgtcaccttttacttcgtcggagtatggcaacactccggcagaggaatctcacgctcttccatttctaaccacgagctcacgtccgtgccctgcacgtttcctcaccaaaccacaccgattctcaacttcgcctcccgtcacacagcccctgaccttcctccgacgataacggacgcgcgtgttgttcaaatcccgtcgtgcggcgttgaattctcggagtacacgccctgcgagttcgtgaatcggtctttgaatttcccaagagagaggcttatatacagagagagacactgtccggaaaaacacgagatagtcaggtgtcggattccagcgccgtacggttacagtttaccttttcggtggccggagagccgtgacgtggcgtggtttgctaacgtgccgcatacggaactaacggtggagaagaagaatcagaactgggtaaggtatgagaaggataggtttttatttcctggtggtggtacgatgtttccacgtggagctgatgcttacatcgacgagatcggacggttgataaatctcaaagatggatcaattcggacagccattgatactggatgtggggtagcgagctttggggcgtatctaatgtcgaggaacatagtaacgatgtcgtttgcaccaagagacacacacgaagctcaggttcagttcgcacttgagagaggagtccctgccatcataggagtgttagcctctattaggctcccatttccggccagagccttcgacattgctcattgctctcgatgtctcattccttggggccaatacaacgggacgtatctcatagaagtggatagggtactgagaccgggggggtattggattttgtcgggaccgccgattaactggcagagacactggaagggttgggaaagaactagagacgatctcaactcggagcagtctcagatcgagagggtggctaggagcttgtgttggaggaaattggtgcagagagaggatcttgcggtttggcagaaacctaccaaccatgttcactgtaagcgcaatcggatagctttaggacgccctccgttctgccaccggacactacccaaccagggctggtacactaagcttgaaacctgtttgacgccgttgccggaagtaacaggatctgagatcaaagaagtagcgggtggacagttggcgagatggcctgagagattgaatgctcttcctccgaggatcaaaagtggaagcttggaagggatcactgaggatgaatttgtcagcaacacagagaaatggcagagaagagtgtcttactacaagaaatatgaccaacagctagcggagacgggaagatacagaaactttctcgacatgaacgctcatcttggaggtttcgcctcagccttagtcgatgatcctgtatgggtcatgaatgttgtccccgtggaggccagtgttaacacccttggagttatctatgagcgaggattgattggaacgtatcaaaactggtgtgaagcaatgtcaacttacccaaggacatacgatttcatccatgccgattcggtgttcagtctgtacaaagacagatgtgacatggaagatatcttgctagaaatggacaggattctaagaccaaagggaagcgtgatcatcagagacgacattgatgtgctaaccaaagtgaagaagattacagatgcgatgcaatgggaagggaggataggagatcatgaaaacggacctcttgaaagagagaagattttgtttcttgtgaaggagtactggaccgcacctgcgcctgatcagtcatcagatccttgatcaagcttggaataattcataaaatttgtagctccattcttttttcttcaaatgttttgtacacactaatcgactttgggggaaagaagaaacaaacacccgctaaattgtttcaaaccggagattcattgcgactttgtgagaaaatgaactagagagtttactacaaa

SEQ ID NO: 860 - protein, 633 aa, Arabidopsis thaliana
  G1202,AKR domain coordinates 105-619
MGNYRWPSKLSKLSLRAKQTNLYRVILIAILCVTFYFVGVWQHSGRGISRSSISNHELTSVPCTFPHQTTPILNFASRHTAPDLPPTITDARVVQIPSCGVEFSEYTPCEFVNRSLNFPRERLIYRERHCPEKHEIVRCRIPAPYGYSLPFRWPESRDVAWFANVPHTELTVEKKNQNWVRYEKDRFLFPGGGTMFPRGADAYIDEIGRLINLKDGSIRTAIDTGCGVASFGAYLMSRNIVTMSFAPRDTHEAQVQFALERGVPAIIGVLASIRLPFPARAFDIAHCSRCLIPWGQYNGTYLIEVDRVLRPGGYWILSGPPINWQRHWKGWERTRDDLNSEQSQIERVARSLCWRKLVQREDLAVWQKPTNHVHCKRNRIALGRPPFCHRTLPNQGWYTKLETCLTPLPEVTGSEIKEVAGGQLARWPERLNALPPRIKSGSLEGITEDEFVSNTEKWQRRVSYYKKYDQQLAETGRYRNFLDMNAHLGGFASALVDDPVWVMNVVPVEASVNTLGVIYERGLIGTYQNWCEAMSTYPRTYDFIHADSVFSLYKDRCDMEDILLEMDRILRPKGSVIIRDDIDVLTKVKKITDAMQWEGRIGDHENGPLEREKILFLVKEYWTAPAPDQSSDP

SEQ ID NO: 861 - DNA, 2721 bp, Arabidopsis thaliana
  G1206,family:ENBP
atggattctggagttaaattggagcatatgaattgtttccaattatcttatcaatattcgtggacgactaggaagaagagaactctgaaaccattcatgtcaaaaggttctagccctagtagtagtagtgatagtaggaaacggaagctttcgagagctgaagatagcgatgattcagcggttaaacggaatgcgaaacgaaggagaaagatatgcaaagtagaagaatattatgaagatgatgattgcatattaagtgattgggttcagaggaatactgcgaaaaggattgataagcgcaacgaagaagttgaagttatggttaagatagagtcaggtgatgattgcacaataggtaagtggttttctgatgttagtagtaaaaggaaagataaacgacaagtagaagttgatgaagatgaggaatgggaagaagaagttacactgtgttctaagatcaaggcaacgtcgtcgcgaagcagaacccatagtttaagtgctaacagtccagaaaatgttacagatgttattagtccttgtcgttcacggtctccagcttctaatgtatcagattccattcagaaaaatgactgcaccagtagtagaaaacagagtggcccaatttgtcatcagtgcttgaaaggggaaaggataacacttctcatttgtagtgaatgtgagaagacaatgttttgtcttcaatgtataaggaaatggtatccaaatctatctgaggatgatgttgttgagaaatgtcctttatgccgtcaaaattgtaattgtagcaaatgcttgcatttgaatggtttaattgagacatcgaagagggaactcgcgaaatctgaaagacgtcatcatctccagtatttgattacgttgatgcttccttttctgaataagttatccatattccagaagctagagattgaatttgaggcaactgttcaaggaaaactgccttctgaagttgaaataactgcggctataagctacactgatgaacgtgtatactgtgatcattgtgcaacttcaattgttgacttgcatcgaagctgtccaaagtgctcttatgaactttgtttgaagtgctgtcaagagattcgtgaaggatcgctttctgaacgccctgaaatgaagttccattatgttgatagaggacatcgatatatgcatggtttagatgctgcggaaccgagcttgtcttccacttttgaagacgaagaagctaacccatctgacgctaagtggagccttggtgaaaatggaagcatcacttgtgcaccagaaaagctaggtggttgtggtgaacggatgctagagcttaggcggatcctaccactcacgtggatgtcagatttagagcacaaagcagagactttcttatcatcatacaatataagccctagaatgttgaactgtaggtgttcttctttggagacagagctgacaaggaaatcagcttcgaggacaacatcaagtgacaactaccttttctgtcctgaatctctcggtgtcttgaaggaagaagagcttcttcattttcaagagcattgggcaaaaggcgaaccagtaatcgttaggaacgctcttgacaacacacctggtttaagctgggagccgatggttatgtggcgggctttatgcgaaaatgtgaattcaacatcaagctctgagatgtcccaagtcaaagcaattgattgcttagctaattgtgaggtggagatcaatactcgtcagttctttgaaggttatagcaaaggaagaacatatgaaaatttctggcctgagatgttgaagcttaaggactggcctccttctgataagtttgaagatcttctacctcgtcactgtgatgagttcatatccgcgttacctttccaggaatatagtgatcctagaactggaattcttaacattgcaacaaagcttcctgaaggatttatcaaaccagatttaggtccaaaaacttacatcgcctatgggattccagatgagcttggtagaggcgattccgtgactaagcttcactgcgatatgtcagacgcggtgaatattctaacgcatacggccgaagtgaccctaagtcaagaacaaatatcctcagtcaaagcactgaaacagaaacacaagttacagaataaggtcgataaacagagtactgaagactgtaacgaaaaggaagaagaagaagaagaagaattgaacatgccagagatttcgagcaatgaaaatgaagaaacgggcagtgctctttgggacatatttaggagagaagacgttcccaagttagaagagtatctaagaaagcattgcaaagaatttagacacacttattgtagtccagttacaaaggtaacaacacccacctgcatcaattttatgacgaatttatttccggtactgacggtttcttcttttcaggtttatcatccgatacatgaccaatcatgctatttaaccttagagcacaaaagaaaactcaaggcggaatatgggatcgagccatggacatttgtgcaaaagctaggtgaagcggtgtttattcccgcgggttgtcctcatcaagttcggaatctaaagtcgtgcacaaaagtcgcagttgactttgtgtcaccagagaacatccatgagtgtctgcgtttgaccgaagagtttcgccaacttcccaaaaaccacaaggccagagaggacaaactcgaggcaagtcttttatctctttga

SEQ ID NO: 862 - protein, 906 aa, Arabidopsis thaliana
  G1206,ENBP domain coordinates 209-255,613-886
MDSGVKLEHMNCFQLSYQYSWTTRKKRTLKPFMSKGSSPSSSSDSRKRKLSRAEDSDDSAVKRNAKRRRKICKVEEYYEDDDCILSDWVQRNTAKRIDKRNEEVEVMVKIESGDDCTIGKWFSDVSSKRKDKRQVEVDEDEEWEEEVTLCSKIKATSSRSRTHSLSANSPENVTDVISPCRSRSPASNVSDSIQKNDCTSSRKQSGPICHQCLKGERITLLICSECEKTMFCLQCIRKWYPNLSEDDVVEKCPLCRQNCNCSKCLHLNGLIETSKRELAKSERRHHLQYLITLMLPFLNKLSIFQKLEIEFEATVQGKLPSEVEITAAISYTDERVYCDHCATSIVDLHRSCPKCSYELCLKCCQEIREGSLSERPEMKFHYVDRGHRYMHGLDAAEPSLSSTFEDEEANPSDAKWSLGENGSITCAPEKLGGCGERMLELRRILPLTWMSDLEHKAETFLSSYNISPRMLNCRCSSLETELTRKSASRTTSSDNYLFCPESLGVLKEEELLHFQEHWAKGEPVIVRNALDNTPGLSWEPMVMWRALCENVNSTSSSEMSQVKAIDCLANCEVEINTRQFFEGYSKGRTYENFWPEMLKLKDWPPSDKFEDLLPRHCDEFISALPFQEYSDPRTGILNIATKLPEGFIKPDLGPKTYIAYGIPDELGRGDSVTKLHCDMSDAVNILTHTAEVTLSQEQISSVKALKQKHKLQNKVDKQSTEDCNEKEEEEEEELNMPEISSNENEETGSALWDIFRREDVPKLEEYLRKHCKEFRHTYCSPVTKVTTPTCINFMTNLFPVLTVSSFQVYHPIHDQSCYLTLEHKRKLKAEYGIEPWTFVQKLGEAVFIPAGCPHQVRNLKSCTKVAVDFVSPENIHECLRLTEEFRQLPKNHKAREDKLEASLLSL

SEQ ID NO: 863 - DNA, 1056 bp, Arabidopsis thaliana
  G1225,family:HLH/MYC
atgactctagaagctttatcatcaaacggtcttttaaactttttgctctctgaaactctttcaccaactccattcaagtctctcgtcgatctcgagccattgccggaaaatgatgtcatcatatcgaagaacacaatttcggagatatctaatcaagaaccgccaccacagcgacaaccaccagctacgaatcgagggaagaagcggcggaggaggaagcctagggtttgcaaaaacgaggaagaagctgagaatcaacgaatgactcacattgccgtcgaaagaaatcgaagaagacaaatgaatcaacatctctctgtcttgcgatctctcatgcctcaaccttttgctcacaagggtgatcaagcttcaatagttggtggagccatagatttcatcaaagaacttgaacacaaattactatctcttgaagctcaaaaacatcataatgctaaattaaaccagtcggttacttcttcaacaagtcaagactcaaatggtgaacaagagaatcctcatcaaccatcttcactatctctatcgcagttctttcttcattcatacgatccgagccaagagaataggaacggctcaacaagctcggtgaaaacccctatggaagatcttgaggtgactctaatcgaaactcatgctaacatcagaatcttgtcgagaagaagaggtttccggtggagcacgttggccaccaccaaaccgccgcagctttcgaagctggtggcttctctacaatcgctgtccctctccattcttcaccttagtgtcacaacattggacaattatgctatttactccatcagcgctaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttgttgttattccttcttttaattttatcacatagcacatctttagttttttttttt

SEQ ID NO: 864 - protein, 327 aa, Arabidopsis thaliana
  G1225,HLH/MYC domain coordinates 82-141
MTLEALSSNGLLNFLLSETLSPTPFKSLVDLEPLPENDVIISKNTISEISNQEPPPQRQPPATNRGKKRRRRKPRVCKNEEEAENQRMTHIAVERNRRRQMNQHLSVLRSLMPQPFAHKGDQASIVGGAIDFIKELEHKLLSLEAQKHHNAKLNQSVTSSTSQDSNGEQENPHQPSSLSLSQFFLHSYDPSQENRNGSTSSVKTPMEDLEVTLIETHANIRILSRRRGFRWSTLATTKPPQLSKLVASLQSLSLSILHLSVTTLDNYAIYSISAKVEESCQLSSVDDIAGAVHHMLSIIEEEPFCCSSMSELPFDFSLNHSNVTHSL

SEQ ID NO: 865 - DNA, 1362 bp, Arabidopsis thaliana
  G1226,family:HLH/MYC
ctgcatttattaagaacagtttagaaagtgtcaacccctaaaggaatgtttttagtttagaggaaagagagagaagaagaagcagcagcagaagttgttaatttgaagactatttgaggaaagacacctatatctaaatactcaaagttacaaaaatattacttcagaaaacagttccattagagagactcataaagcttctcatctaattatgagtggattgatgagttttggtgaattagaagaccaatttggtcagatttcagacactactatggaagagaagataccatttctgcaaatgcttcaatgcatagaacacccttttacaacaacagaaccaaatcagtttctccaatcacttctccagatccaaaccctagaatcaaagagctgtctcacccttgaaacaaacatcaaaagagatccgggtcaaacagatgacccggaaaaggatccaagaacagaaaacggagcagtaacggtcaaagaaaaaagaaaacggaaacgtacaagagctccaaagaacaaagacgaagttgaaaaccaaaggatgactcacattgccgtcgaacgtaatcgaagacgacaaatgaacgaacacttaaactctctccgatctctcatgcctccttcgtttcttcaacggggtgaccaagcttcgattgtaggaggggcaatagatttcatcaaggaactagagcaactcttgcaatctctagaagctgagaaacgaaaggatggaactgatgaaactcctaaaacggcgtcgtgttcttcatcttcgtctcttgcatgcactaactcttctatttctagcgtgtctacgacgtcggaaaatggatttacggcgagattcggcggtggagatacgacagaagtggaggctacggtgatacagaaccatgtgagcttaaaagttcggtgtaagagaggaaaacgacagatcttaaaagctattgtctcgattgaagaactaaagcttgcgattctacatctcactatctcttcttcctttgactttgtcatctactctttcaatctcaagatggaagatggttgtaaattaggatcagcagatgagatagcgacagccgttcatcagatcttcgagcaaatcaacggtgaagtcatgtggtcaaatcttagtcgaacttagttgacttttgactcctagtaacgtgtgtaaactttaggttacaaagaaaagggacgtgatataaataagaaaaaccaaagaggtgaaattttgggagttttaattattatcttatactttttggattttagattagtagcaaactcgcagtgttctacgatgacattattattggtcacatgaaggtttaggttaaaaaaaaa

SEQ ID NO: 866 - protein, 315 aa, Arabidopsis thaliana
  G1226,HLH/MYC domain coordinates 109-168
MSGLMSFGELEDQFGQISDTTMEEKIPFLQMLQCIEHPFTTTEPNQFLQSLLQIQTLESKSCLTLETNIKRDPGQTDDPEKDPRTENGAVTVKEKRKRKRTRAPKNKDEVENQRMTHIAVERNRRRQMNEHLNSLRSLMPPSFLQRGDQASIVGGAIDFIKELEQLLQSLEAEKRKDGTDETPKTASCSSSSSLACTNSSISSVSTTSENGFTARFGGGDTTEVEATVIQNHVSLKVRCKRGKRQILKAIVSIEELKLAILHLTISSSFDFVIYSFNLKMEDGCKLGSADEIATAVHQIFEQINGEVMWSNLSRT

SEQ ID NO: 867 - DNA, 1196 bp, Arabidopsis thaliana
  G1228,family:HLH/MYC
gcatttataattactcactcatcttcttttcattacattacataccaaacaagagctctcaaatggaaaggtttcaaggacacatcaacccctgtttcttcgatcgaaaaccggatgtgagaagcctcgaggttcaaggatttgcagaggctcaaagctttgctttcaaagaaaaagaggaagaaagcttacaagatacagttccatttctacagatgctgcaaagtgaagacccctcatcgtttttttcaatcaaagagccaaactttctgacgctactgtctcttcaaaccctcaaggagccttgggaactcgaaagatatctttcacttgaggattcacaatttcattcaccggtccaatctgagaccaaccgcttcatggaaggagccaatcaagctgtgtcaagccaagaaattccctttagccaagcaaacatgacactcccttcttctacctcatcaccactcagtgcacattcaagacgaaagcgcaaaatcaaccacttgctgcctcaagaaatgactagagaaaagagaaagaggaggaaaacaaaaccaagtaaaaacaatgaagagattgagaatcaaagaataaaccacattgctgttgaacgaaacagaagacgtcaaatgaacgaacatatcaactctctccgggcccttctcccaccttcctacatccaacgaggagaccaagcttccatagtaggaggagcaataaactacgtgaaggtcctcgagcaaatcatacaatctctcgaatcgcaaaagagaacgcaacaacaaagtaacagtgaggtagtagaaaacgcacttaatcatctctcaggcatttcgtcgaacgacctgtggacaactcttgaagatcaaacttgtatccccaaaatcgaagctacagtgatacaaaaccatgtcagccttaaagttcaatgtgagaagaaacaaggacaacttctcaaaggaatcatatcacttgaaaagcttaaactcactgttcttcatctcaatatcactacttcgtctcattcctctgtttcttattccttcaacctcaagatggaagatgagtgcgacttagagtcagccgacgagattacggcggctgttcatcggattttcgatattccgacaatttgattaaacacatataattccaaaaatattaacagctgacaaaatggtatctttgcggcc

SEQ ID NO: 868 - protein, 358 aa, Arabidopsis thaliana
  G1228,HLH/MYC domain coordinates 172-231
MERFQGHINPCFFDRKPDVRSLEVQGFAEAQSFAFKEKEEESLQDTVPFLQMLQSEDPSSFFSIKEPNFLTLLSLQTLKEPWELERYLSLEDSQFHSPVQSETNRFMEGANQAVSSQEIPFSQANMTLPSSTSSPLSAHSRRKRKINHLLPQEMTREKRKRRKTKPSKNNEEIENQRINHIAVERNRRRQMNEHINSLRALLPPSYIQRGDQASIVGGAINYVKVLEQIIQSLESQKRTQQQSNSEVVENALNHLSGISSNDLWTTLEDQTCIPKIEATVIQNHVSLKVQCEKKQGQLLKGIISLEKLKLTVLHLNITTSSHSSVSYSFNLKMEDECDLESADEITAAVHRIFDIPTI

SEQ ID NO: 869 - DNA, 1604 bp, Arabidopsis thaliana
  G1229,family:HLH/MYC
tttgggcgggtctttctttccctaaatctttcttttattttgctgtttaaaaaaaaaatccaaccataagacaaaacaacgaacgaggaagagagagagagaaggatatatctctaatcacgatgcaggagataataccggattttcttgaagagtgtgaatttgtcgacacttcactagccggagatgatctatttgccatcttagagagtcttgaaggtgccggagagatatctccgacagctgcatctacacctaaagatggaaccacaagttccaaggagttagttaaggatcaagattatgaaaactcatctcctaagaggaaaaagcaaagactagaaaccaggaaagaagaggacgaagaagaagaagacggagacggagaagcagaagaagataataagcaagatgggcaacaaaagatgtctcatgtaaccgtggaacgtaaccggagaaagcaaatgaacgagcacttaaccgttttgcgttctcttatgccttgtttctacgtcaaacggggggaccaagcatcgatcataggaggagttgtggagtacataagcgagttacaacaagttctccaatctttggaagccaagaaacaacgtaaaacctacgccgaagtcctaagcccgagagttgtcccgagccctcgtccttcaccgcctgttctaagcccaagaaaaccgcctcttagcccgcgcatcaaccaccaccagattcaccaccacctacttctccctcccataagtcctcgaacacctcagccaacaagcccataccgggccattccaccgcaactaccactcatcccacagcctccgcttcgctcttacagctcattggccagttgcagcagcttaggagatccacctccatactctcctgcttcatcttcttcatctccttcagttagtagtaaccatgagagtagtgtgatcaatgagcttgttgctaactcaaaatcggctttggctgatgtggaagtgaagttttcaggagctaacgtgctgctcaaaacggtgtcgcataagatcccgggacaagttatgaagataattgctgctcttgaagatttggctcttgagattcttcaggttaatattaacaccgtcgacgaaaccatgcttaattctttcaccatcaagattggaattgagtgccaactaagtgcagaagaactggctcaacaaattcagcaaacattctgctagtaaagaaggatttaatatagcttcgtataaaccttaacgagagagcagtacgtactcactttctctccttagtatccctttaattatcttttcagttttctgcaaagatatggagtttaaaaaaataaaattgttatctaaagttttaatcaaatattgattaattataactaatataggtataagtgagttttaaagattatcagcttcataacagccatcgtcatgtttactttcttttaaattttagaatttagacgtactcctaccatgtaattttatttctgtcattacatcaagcattgtagctgtaattgcatatgaatgaacaatagtgtatgagtgatctcatgaataatattcttcttgcaacacaaaaaaaaaaaa

SEQ ID NO: 870 - protein, 364 aa, Arabidopsis thaliana
  G1229,HLH/MYC domain coordinates 96-155
MQEIIPDFLEECEFVDTSLAGDDLFAILESLEGAGEISPTAASTPKDGTTSSKELVKDQDYENSSPKRKKQRLETRKEEDEEEEDGDGEAEEDNKQDGQQKMSHVTVERNRRKQMNEHLTVLRSLMPCFYVKRGDQASIIGGVVEYISELQQVLQSLEAKKQRKTYAEVLSPRVVPSPRPSPPVLSPRKPPLSPRINHHQIHHHLLLPPISPRTPQPTSPYRAIPPQLPLIPQPPLRSYSSLASCSSLGDPPPYSPASSSSSPSVSSNHESSVINELVANSKSALADVEVKFSGANVLLKTVSHKIPGQVMKIIAALEDLALEILQVNINTVDETMLNSFTIKIGIECQLSAEELAQQIQQTFC

SEQ ID NO: 871 - DNA, 2481 bp, Arabidopsis thaliana
  G1242,family:SWI/SNF
gcgccgagacttttcagcaccaactatcggcttcttatcacgggaaccccccttcagaataatctccatgaattgtgggcccttctcaattttcttctccctgaggtttttagttcagcagaaacttttgacgagtggtttcaaatttctggtgaaaacgaccagcaagaagttgttcaacaacttcacaaggttctgcgaccatttcttcttcggaggttaaaatcagatgtagagaaaggcttacctccaaaaaaggagacaatactcaaagttggcatgtctcaaatgcaaaaacagtactacaaggctttactgcagaaggatcttgaagtggttaatggtggtggagaacgcaaacgtctgttgaacatagcaatgcaattgcggaaatgctgcaatcacccttatctcttccagggtgcggagcctggtcccccatatactacaggagatcaccttgtaacaaacgcaggtaagatggttctcttagataaattgctacctaagttgaaggatcgagattcaagggttctgatattttctcagatgacaaggcttttggatattctcgaggattacctaatgtatcgtggttaccagtactgccgtattgatggaaatactggtggtgacgaacgagatgcttccatagaagcctataacaagccaggaagtgagaaattcgttttcttgttatccactagagctggaggacttggtatcaatcttgctactgcagatgttgtgatcctctatgatagtgactggaaccctcaagttgacttgcaagctcaggatcgtgcacataggattggtcaaaaaaaagaagttcaagtgttccggttctgcaccgagaatgctattgaggctaaagtcattgagagagcttacaagaagttggcacttgatgctctggttattcagcaagggagattggcagaacagaaaactgttaataaggatgagttgcttcaaatggtgagatatggtgctgaaatggtgtttagttctaaagatagcacaattacggatgaggatattgacagaatcattgccaaaggagaagaggcaacggctgaacttgatgccaagatgaagaaatttactgaagatgcaatacagtttaaaatggatgacagtgctgacttttatgattttgacgatgacaacaaggatgagagcaaggtggattttaaaaagattgtgagtgaaaattggaatgatccaccaaaaagagagagaaagcgcaactactctgaagttgaatacttcaagcaaacgttgcgacaaggtgctccagctaaacctaaagagcctagaattccacgcatgccccaattgcatgattttcagttctttaacattcagaggctgactgagctgtatgaaaaagaagtgcgataccttatgcaagcacatcagaaaactcaaatgaaagacacaattgaggttgatgaacctgaagaagttggagatcccttaactgctgaagaagtggaagaaaaggagctattgctggaagagggtttctcaacatggagcagaagagacttcaatgccttcattagggcttgtgagaagtatggccggaacgacataaagagtattgcctctgagatggaagggaaaactgaggaagaggttgaacgatatgctcaagttttccaagtgcgatataaagagctgaatgattacgacagaatcatcaagaatattgagagaggggaagcaagaatctctaggaaagatgaaatcatgaaagctattgggaagaaactggatcgctacagaaacccgtggctggaactgaagattcaatatggtcagaacaaagggaagctgtacaatgaagagtgcgaccgtttcatgatatgcatggtccataaacttgggtatggaaactgggatgagctaaaggcagcgtttcggacatcccccttgtttaggtttgactggtttgtaaaatcccgcacaactcaggaacttgcaaggagatgtgacacactaatcaggttgattgagaaagagaatcaagaatttgatgagagagagaggcaagcccgaaaagagaagaagctttcaaagagtgcaacgccatcaaaacgaccttcgggtaggcaagcaaatgagagcccttcatctcttctgaagaaacgaaagcagctgtcaatggatgattatggaaagcgtaggaaataagaaggcttgtgttgaatccatcactaagtaatcagaaagatttatgatcacttctaggtttgattccgaatcggagaattagttagaagaagctccttagagacaaggatctaatattttgtacccgcaagcatcactgcattgtctccgacttctcttatttcttcaacgtgtattttactctattttgtttgtagaaatattcaccacattcctagtagtgcgtttttagtaaatctcaaatgaacttttgtggtcggatttgaacaaaaaaaaaaa

SEQ ID NO: 872 - protein, 640 aa, Arabidopsis thaliana
  G1242,SWI/SNF domain coordinates 96-180,417-466,519-580
MSQMQKQYYKALLQKDLEVVNGGGERKRLLNIAMQLRKCCNHPYLFQGAEPGPPYTTGDHLVTNAGKMVLLDKLLPKLKDRDSRVLIFSQMTRLLDILEDYLMYRGYQYCRIDGNTGGDERDASIEAYNKPGSEKFVFLLSTRAGGLGINLATADVVILYDSDWNPQVDLQAQDRAHRIGQKKEVQVFRFCTENAIEAKVIERAYKKLALDALVIQQGRLAEQKTVNKDELLQMVRYGAEMVFSSKDSTITDEDIDRIIAKGEEATAELDAKMKKFTEDAIQFKMDDSADFYDFDDDNKDESKVDFKKIVSENWNDPPKRERKRNYSEVEYFKQTLRQGAPAKPKEPRIPRMPQLHDFQFFNIQRLTELYEKEVRYLMQAHQKTQMKDTIEVDEPEEVGDPLTAEEVEEKELLLEEGFSTWSRRDFNAFIRACEKYGRNDIKSIASEMEGKTEEEVERYAQVFQVRYKELNDYDRIIKNIERGEARISRKDEIMKAIGKKLDRYRNPWLELKIQYGQNKGKLYNEECDRFMICMVHKLGYGNWDELKAAFRTSPLFRFDWFVKSRTTQELARRCDTLIRLIEKENQEFDERERQARKEKKLSKSATPSKRPSGRQANESPSSLLKKRKQLSMDDYGKRRK

SEQ ID NO: 873 - DNA, 1746 bp, Arabidopsis thaliana
  G1246,family:MYB-(R1)R2R3
atgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtag

SEQ ID NO: 874 - protein, 581 aa, Arabidopsis thaliana
  G1246,MYB-(R1)R2R3 domain coordinates 27-139
MIMYGGGGAGKDGGSTNHLSDGGVILKKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPPDIIPNHQLHPHPHHQQQQQHNHHHHHHQQQQQHQQMYFQPQSSQRNTPSSSPLPSPTPANAKSSSSFTFHTTTANLLHPLSPHTPNTPSQLSSTPPPPPLSSPLCSPRNNQYPTLPLFALPRSQINNNNNGNFTFPRPPPLLQPPSSLFAKRYNNANTPLNCINRVSTAPFSPVSRDSYTSFLTLPYPSPTAQTATYHNTNNPYSSSPSFSLNPSSSSYPTSTSSPSFLHSHYTPSSTSFHTNPVYSMKQEQLPSNQIPQIDGFNNVNNFTDNERQNHNLNSSGAHRRSSSCSLLEDVFEEAEALASGGRGRPPKRRQLTASLPNHNNNTNNNDNFFSVSFGHYDSSDNLCSLQDLKSKEEESLQMNTMQEDIAKLLDWGSDSGEISNGQSSVVTDDNLVLDVHQLASLFPADSTAVVAATNDQHNKNNNNNCSWDDMQGIR

SEQ ID NO: 875 - DNA, 1245 bp, Arabidopsis thaliana
  G1247,family:MYB-(R1)R2R3
atgattcaggatcaagcgaatgatttattagcaatgaagaaaacttttactaagtctaaatggaaaccagaggaagatagaattttgaaagattatgttattcaatatggtgatagaacttggactcatgttccaaaacgcacgggccttcctcataatcctgcaagttgtcgttttcgttggatgaatcatcttaagccaagcttgaaaaaagggccctttaccgatgaggaagagaagcgtgttctccaacttcatgctgttttggggaacaaatggtcacaaatggctagagaagtatgtaactctctttcctttttttttcactctctacattttcatcttcttttactgtttgatttaaacttttgtttctttaagttccctggtcgaacagataacgagataaagaatttttggaacgcaagacgtatgcgattgaaaggaaagggtttaccagtttaccctgatgaagttcgagagcaggcgatacgtacagcagcacaatatggtgtaaaagttgaattattgaatgctcattatagtcaagactcattgatggcaggcaatgtcgagaaacctcaagaactcaataacttggcactcaatcaatgttctccgtattaccagtcaacgcttgccaatgttcagcctagccgcaatcgcgttatggaaccagaaacaacatttcctttcacgggtggatctgccatgaacgagcaaaaccctactctcttgtgtaatccttacgtggagagcactcaagaacagttacctgacagccatttgtttggaaatgttacatattcttctcctcctatgcctctcattcacgaggttgagaacttggagctcccttcattccaaggctttgattttcatgaagagcctagcagttttggagcagaacaatataacccaatgctgaatcttgagccacacaacactttggtccagtctcctctgataggccagacaccaacagatttcccatcatcattctatgatgaattgttggatgaattgttggaatcagttgttaacggttcattaggagaaataccgaaaaccgataccagttcggagtcccaactgtttcagtcctctctacgtagccataccgatgctacaccagacattgcaaacacaactggtaaaccttttttagtctctacgcattacattacaatcacttcattttttgtgtgttcaattcaagaggtttccactaatctttatgcatga

SEQ ID NO: 876 - protein, 414 aa, Arabidopsis thaliana
  G1247,MYB-(R1)R2R3 domain coordinates 18-141
MIQDQANDLLAMKKTFTKSKWKPEEDRILKDYVIQYGDRTWTHVPKRTGLPHNPASCRFRWMNHLKPSLKKGPFTDEEEKRVLQLHAVLGNKWSQMAREVCNSLSFFFHSLHFHLLLLFDLNFCFFKFPGRTDNEIKNFWNARRMRLKGKGLPVYPDEVREQAIRTAAQYGVKVELLNAHYSQDSLMAGNVEKPQELNNLALNQCSPYYQSTLANVQPSRNRVMEPETTFPFTGGSAMNEQNPTLLCNPYVESTQEQLPDSHLFGNVTYSSPPMPLIHEVENLELPSFQGFDFHEEPSSFGAEQYNPMLNLEPHNTLVQSPLIGQTPTDFPSSFYDELLDELLESVVNGSLGEIPKTDTSSESQLFQSSLRSHTDATPDIANTTGKPFLVSTHYITITSFFVCSIQEVSTNLYA

SEQ ID NO: 877 - DNA, 483 bp, Arabidopsis thaliana
  G1248,family:CAAT
atggcggggaattatcattcgttccaaaatccaatccctcgataccagaattacaacttcgggagcagctcatctaatcatcaacatgaacatgatgggttagtggtggtggtggaggatcaacagcaagaagaaagcatgatggtaaaagaacaagacaggctacttccgatagcaaacgtaggaaggatcatgaagaacatcctcccagcaaacgcaaaggtctctaaagaagccaaagagactatgcaagaatgtgtgtccgagttcattagcttcgtcacgggagaagcatccgataaatgccacaaggagaagcgaaagaccgttaatggagacgatatctgttgggctatggctaatctagggtttgatgattacgccgcccagctcaagaagtacttacatcgttaccgagttctcgaaggtgagaaacctaatcatcacggcaaaggaggacctaaatcctcgccagataattaa

SEQ ID NO: 878 - protein, 160 aa, Arabidopsis thaliana
  G1248,CAAT domain coordinates 43-126
MAGNYHSFQNPIPRYQNYNFGSSSSNHQHEHDGLVVVVEDQQQEESMMVKEQDRLLPIANVGRIMKNILPANAKVSKEAKETMQECVSEFISFVTGEASDKCHKEKRKTVNGDDICWAMANLGFDDYAAQLKKYLHRYRVLEGEKPNHHGKGGPKSSPDN

SEQ ID NO: 879 - DNA, 738 bp, Arabidopsis thaliana
  G1249,family:CAAT
tcgaccgttcttctcaatctcaccaatcggtttaagctgaaaacccgaattagcaaaatcttcgttcgggctgttttggttaatccggtttacatgttttctcattgctcattttcattttcccgccgtgacagagcgcgtaaatctcaaaaccctaaaaatgtcgaacatatacaattcattaccttaatcagattttctcaacagaatcaaaatcaaaatccatggaggaagaagaaggatcaatccgaccagagtttccaatcggaagagtaaagaagataatgaaactggacaaagacatcaacaaaatcaactcagaagctcttcacgtcatcacttactccaccgaactcttcctccacttcctcgccgagaaatctgctgttgttacggcggagaagaagcgtaagactgttaatctcgatcatttaagaatcgccgtgaaaagacaccaacctactagtgatttcctcttagactcgcttccgttgccggctcagcctgtcaaacataccaaatcggtttccgacaagaagattccggcgccgccaattgggactcgtcgtatcgatgatttcttcagtaaagggaaagcaaagactgattcagcctaaagtaaaatttctcattttgttcacaattgcaaattttactctgttctcaaatcaaaatcttgttttgctaaaagtgtagtgagaatgtatggatcatgaggaacttttataggaagcggcc

SEQ ID NO: 880 - protein, 130 aa, Arabidopsis thaliana
  G1249,CAAT domain coordinates 13-89
MEEEEGSIRPEFPIGRVKKIMKLDKDINKINSEALHVITYSTELFLHFLAEKSAVVTAEKKRKTVNLDHLRIAVKRHQPTSDFLLDSLPLPAQPVKHTKSVSDKKIPAPPIGTRRIDDFFSKGKAKTDSA

SEQ ID NO: 881 - DNA, 1538 bp, Arabidopsis thaliana
  G1255,family:Z-CO-like
cagctcaaactctctaggactacactaaatctaactttttgcagagagcaaaagattcaataattgagattgatctcaaaaccaaagctctcgtgctcttgtcgttgatgttggttgtgtagactttgtatacaatgatgaaaagtttggcgaatgctgttggagcgaagacggcgagggcttgcgacagctgcgtgaagagacgtgcacggtggtactgcgcggccgacgatgcttttctttgccagtcttgcgacagtttggtccattcagcaaaccctcttgctcgccgccacgagagagtccgtttgaagacggctagcccggcggtcgtaaagcatagcaaccactcatcagcttctcctccacatgaggtcgccacgtggcatcacgggtttactcgtaaagctcgaacgccacgtggctctggtaagaaaaacaattcgtcgatatttcatgacttggttcctgatattagtattgaggatcagacagacaactatgagcttgaagagcagctgatctgtcaagtgccggttctagatccgttggtgtctgagcagttcttgaacgatgtcgttgagcccaagatcgagtttcctatgatcagaagtggtttgatgatcgaggaggaggaagacaacgctgaaagttgtcttaatggatttttcccgaccgacatggagcttgaggagtttgctgctgacgtggagactctgctcggtcgcgggttagacacggagtcgtatgccatggaggagctagggttatctaattcagagatgttcaaaatcgaaaaagatgagattgaagaagaagtagaagagataaaagccatgagcatggatatatttgatgatgatcgaaaagacgtggatggaacagtaccgtttgagctaagctttgattacgagtcgtcacacaagacgtccgaagaagaggtaatgaagaacgttgaaagtagtggtgaatgtgttgttaaggtgaaagaggaagaacataagaatgttctgatgctaagattaaactatgactcggtgatatccacttggggaggtcaaggtccaccgtggagttcaggagagccaccggaacgagacatggacatcagcggttggccagccttttccatggtggagaatggaggagaaagtactcatcagaagcaatacgttggtggatgtttaccatcaagtgggtttggagatggaggtagagaagctagagtttcgagatacagagagaagaggaggacaaggttgttttctaagaagatacggtacgaggtacgtaaattgaatgcagagaaaagaccacgaatgaaaggaagattcgtgaagagagcctcgctcgctgctgctgcttcaccattaggtgttaattactgaatagttaatatctattcatgttatatctcactttacaaatttcggtgaatcttttttcttctgaaacaacagaagttattttggcacttaattgtgctttgaggacttgtatgtacatagaagtaaccaataataatgtgacttttacta

SEQ ID NO: 882 - protein, 417 aa, Arabidopsis thaliana
  G1255,Z-CO-like domain coordinates 19-57
MMKSLANAVGAKTARACDSCVKRRARWYCAADDAFLCQSCDSLVHSANPLARRHERVRLKTASPAVVKHSNHSSASPPHEVATWHHGFTRKARTPRGSGKKNNSSIFHDLVPDISIEDQTDNYELEEQLICQVPVLDPLVSEQFLNDVVEPKIEFPMIRSGLMIEEEEDNAESCLNGFFPTDMELEEFAADVETLLGRGLDTESYAMEELGLSNSEMFKIEKDEIEEEVEEIKAMSMDIFDDDRKDVDGTVPFELSFDYESSHKTSEEEVMKNVESSGECVVKVKEEEHKNVLMLRLNYDSVISTWGGQGPPWSSGEPPERDMDISGWPAFSMVENGGESTHQKQYVGGCLPSSGFGDGGREARVSRYREKRRTRLFSKKIRYEVRKLNAEKRPRMKGRFVKRASLAAAASPLGVNY

SEQ ID NO: 883 - DNA, 859 bp, Arabidopsis thaliana
  G1266,family:AP2
caatccactaacgatccctaaccgaaaacagagtagtcaagaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagtaccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtacttttgtgatacttggcg

SEQ ID NO: 884 - protein, 218 aa, Arabidopsis thaliana
  G1266,AP2 domain coordinates 79-147
MDPFLIQSPFSGFSPEYSIGSSPDSFSSSSSNNYSLPFNENDSEEMFLYGLIEQSTQQTYIDSDSQDLPIKSVSSRKSEKSYRGVRRRPWGKFAAEIRDSTRNGIRVWLGTFESAEEAALAYDQAAFSMRGSSAILNFSAERVQESLSEIKYTYEDGCSPVVALKRKHSMRRRMTNKKTKDSDFDHRSVKLDNVVVFEDLGEQYLEELLGSSENSGTW

SEQ ID NO: 885 - DNA, 1072 bp, Arabidopsis thaliana
  misc_feature (46)..(46): n is a, c, g, or t
  misc_feature (61)..(61): n is a, c, g, or t
  misc_feature (63)..(63): n is a, c, g, or t
  G1267,family:WRKY
aagtagagaataataatcacatcaagattgtttataaccctccccntaatcaccttcttantnaccaccctctccggctctcaacagaacaacaacaaaaaaacagcttccgttgtcctgttccggcgaaatcggacggtcgagatcaatcatgcatcgtagagcagcaattcaagaatcggatgacgaagaagatgagacttacaacgacgtcgttcctgaatctccttcttcttgtgaagactcaaagatctcaaaaccaactccaaagaaaaggaggaacgtagagaagagagttgtctcagttccgatagctgacgtggaaggatctaagagcagaggcgaagtatatccaccgtccgattcatgggcctggagaaagtacggacaaaaaccgatcaaaggctcgccttatcccaggggatattacagatgtagtagctcaaaaggatgtccggcgaggaagcaggtggagagaagccgtgtggacccttctaagcttatgattacttacgcctgcgaccacaatcaccctttcccttcctcctccgctaacaccaaatcccaccaccgctcctccgtcgtcctcaaaaccgcaaagaaagaggaagaatacgaagaggaggaagaagaactaaccgtcaccgccgcagaggaaccaccggcgggacttgatctaagccacgtagactcaccgttgctattaggcggctgctacagcgaaatcggagagttcgggtggttctacgacgcgtcgatctcatcatcatctggttcttcgaatttcctcgacgtaactctagagagaggtttttcagtaggccaagaggaagatgagtctttgttcggtgatctcggtgatttacctgattgcgcctccgtgttccgccgtgggactgttgcgacggaggagcaacatcgaagatgtgattttggcgccattcctttctgtgatagttctagatgagtttgtgtgtgtagccaaaaccaaaagaaaaaaacacaatttttttattttccactgtaaaggtgtatcaatggtggattcatttttttaaaaaaaaaaaaaaaa

SEQ ID NO: 886 - protein, 271 aa, Arabidopsis thaliana
  G1267,WRKY domain coordinates 70-127
MHRRAAIQESDDEEDETYNDVVPESPSSCEDSKISKPTPKKRRNVEKRVVSVPIADVEGSKSRGEVYPPSDSWAWRKYGQKPIKGSPYPRGYYRCSSSKGCPARKQVERSRVDPSKLMITYACDHNHPFPSSSANTKSHHRSSVVLKTAKKEEEYEEEEEELTVTAAEEPPAGLDLSHVDSPLLLGGCYSEIGEFGWFYDASISSSSGSSNFLDVTLERGFSVGQEEDESLFGDLGDLPDCASVFRRGTVATEEQHRRCDFGAIPFCDSSR

SEQ ID NO: 887 - DNA, 1166 bp, Arabidopsis thaliana
  G1269,family:MYB-related
aacaattctctctctctttattcttcttcttcagcttcagatttcagatcttaaatcttcaagtcttcttcttcttcttctgcaaccatggctatgcaggaacgttgtgagagtttatgttctgatgaacttatatcttcctcagatgccttttacctcaagacaagaaagccttataccatcactaaacaaagagagaaatggacagaagcagagcatgagaagtttgtagaagcattgaaactctatggcagagcttggagacgaatcgaagaacatgttggaacaaaaactgcagttcagattcgaagccatgcgcagaagttctttactaaggttgctcgcgattttggtgttagctctgagtccattgagatcccgcctccaaggccaaagagaaagccgatgcatccttaccctagaaagcttgtgattcctgatgcaaaagagatggtatacgctgaactaaccggatccaagctgattcaggatgaagataaccgatctccaacatcggttttatcagctcatggctcagatggattaggttccattggttcaaattcacctaactcttcttcagctgagttatcatctcacacagaggaatcattgtctctagaagcagagaccaaacagagccttaagctctttggaaaaacttttgtagttggtgattacaactcttcaatgagttgtgatgattctgaagatggcaagaagaagctatactcagaaacacagtctcttcaatgttcttcttctacttcagaaaacgctgaaacagaagtggtagtgtcggagttcaaaagaagtgagagatcagctttctctcagttaaaatcgtcggtgactgagatgaacaacatgagagggttcatgccttacaaaaagagagtaaaggtggaagaaaacattgacaatgtaaaattatcatatcctttgtggtgaagtgttcgtttgtgtcaagtcagttgtgtaaactcttttgatctcaacatcagattatgtgtataatgtcagagtattagggaaagtttttttggattagattcgtaagatcactccaaagtttcgtgtctttccatataaccagttagaaattgagatccttgtacttaaacatttttatttgatcaatcaaatcttcttgatgaaaaaaaaaa

SEQ ID NO: 888 - protein, 287 aa, Arabidopsis thaliana
  G1269,MYB-related domain coordinates 37-83
MAMQERCESLCSDELISSSDAFYLKTRKPYTITKQREKWTEAEHEKFVEALKLYGRAWRRIEEHVGTKTAVQIRSHAQKFFTKVARDFGVSSESIEIPPPRPKRKPMHPYPRKLVIPDAKEMVYAELTGSKLIQDEDNRSPTSVLSAHGSDGLGSIGSNSPNSSSAELSSHTEESLSLEAETKQSLKLFGKTFVVGDYNSSMSCDDSEDGKKKLYSETQSLQCSSSTSENAETEVVVSEFKRSERSAFSQLKSSVTEMNNMRGFMPYKKRVKVEENIDNVKLSYPLW

SEQ ID NO: 889 - DNA, 2793 bp, Arabidopsis thaliana
  G1272,family:PAZ
atggattcaacaaatggtaacggagctgatcttgaatcagcaaatggggcaaacgggagtggggttactgaggcattaccacctcctccaccagttatacctccaaatgtggaaccagttcgtgttaaaactgaacttgctgagaagaaggggccagttcgagttcctatggctcgaaaaggatttggaacaaggggccaaaagatccccttgttaacaaatcatttcaaagtcgatgtggctaatcttcagggtcatttcttccactacagtgtggctctattctatgatgatggtcgtcctgttgaacaaaagggtgttggaagaaaaatccttgacaaggtgcatcagacttaccattctgatctggatggtaaagagtttgcttatgacggtgagaagacgttgtttacatatggagctttgcctagtaacaagatggatttttctgtggtgcttgaggaagtatctgctacaagtaaggattttgtgagcagggctaatggaaacggaagccccaatgggaatgaaagtccaagtgatggtgataggaaaagactgcgtaggcctaaccggtccaaaaactttagagtggagatcagctatgcggccaaaattcctcttcaagctcttgctaatgcaatgcggggacaagaatcagagaattcccaggaggcaatacgggttcttgatatcatattgaggcaacatgctgctagacaaggttgcttgcttgttcgacagtcttttttccacaatgatccaaccaactgtgaaccagttggtggtaacatcttaggatgtaggggatttcactccagtttcagaacaacgcagggtggcatgtcacttaatatggatgttacaaccaccatgatcatcaagcctggtccagtggttgatttcctaattgctaaccaaaatgctagggacccttattcgattgactggtctaaggctaaacgaacccttaagaacctaagggtaaaggtcagcccctcaggccaagaattcaagataaccggattgagtgacaagccttgcagggaacaaacgtttgaattgaagaaaaggaacccaaatgaaaatggagagttcgaaactactgaagttacagttgctgactacttccgcgatacaaggcatattgatttgcaatattctgcggatttgccttgcatcaatgttgggaagccaaagcgacccacttacattcctctcgagctctgcgcgttggttccacttcagaggtacacaaaagcacttaccacgttccaaagatctgcccttgttgagaaatccagacagaaaccccaagagaggatgactgttctgtccaaagctctgaaagttagcaactatgatgcggaaccactcctgcgatcctgtggcatttcgatcagctccaactttactcaggtggagggtcgtgttctaccagctcccaagctgaaaatgggatgtggatctgaaacctttcccagaaatggtcgctggaacttcaacaacaaggaatttgttgagcccaccaaaattcaacgatgggttgttgtcaatttctctgctcgctgtaatgtacgtcaagttgttgatgatctgataaaaattggaggatcaaaaggaattgaaattgcttctccctttcaagtgtttgaggagggtaatcaattccgccgtgctcctcctatgattcgtgttgagaacatgtttaaggacatccaatcgaaactccctggtgtcccacaattcatactatgtgtgctccctgacaaaaagaacagtgatctctatggtccatggaagaaaaaaaacttaactgaatttggcattgttactcaatgcatggctccaacgcggcaacctaatgatcagtatcttactaacttacttctgaagattaatgcaaagcttggaggcctgaactcaatgttaagtgtagagcgtacacctgcgttcactgtgatttctaaggttccaaccattatccttgggatggatgtttcacatggatctcctggacagtctgatgtcccgtccatcgctgctgtggtgagttctagggagtggccactgatatccaaatatagagcatctgttcggacacagccttctaaggctgagatgattgagtcccttgtcaagaaaaatggaactgaagacgatggcattatcaaggagttgctggtagatttctacaccagctcgaataagagaaaaccagagcatatcataattttcagggatggtgtgagtgaatctcaattcaatcaggttctgaatattgaacttgatcagatcatcgaggcttgcaagctcttagacgcaaattggaacccaaagttccttttgttggtggctcaaaagaatcatcataccaagttcttccagccaacgtctcctgaaaatgttcctccagggacaatcattgacaacaaaatatgtcacccaaagaacaatgatttctacctctgtgctcacgctggaatgattggaactacccgcccaactcactaccacgtcctgtatgatgagattggtttttcagctgacgaacttcaggaacttgtccactcgctctcctatgtgtaccaaagaagcaccagtgccatttctgttgttgcgccgatctgctatgctcacttggcagctgctcagcttgggacgttcatgaagtttgaagatcagtctgagacatcatcaagccatggtggtatcacagctccaggaccaatctctgttgcacagctcccaagactcaaagacaacgtcgccaactccatgttcttctgttaa

SEQ ID NO: 890 - protein, 930 aa, Arabidopsis thaliana
  G1272,PAZ domain coordinates 800-837
MDSTNGNGADLESANGANGSGVTEALPPPPPVIPPNVEPVRVKTELAEKKGPVRVPMARKGFGTRGQKIPLLTNHFKVDVANLQGHFFHYSVALFYDDGRPVEQKGVGRKILDKVHQTYHSDLDGKEFAYDGEKTLFTYGALPSNKMDFSVVLEEVSATSKDFVSRANGNGSPNGNESPSDGDRKRLRRPNRSKNFRVEISYAAKIPLQALANAMRGQESENSQEAIRVLDIILRQHAARQGCLLVRQSFFHNDPTNCEPVGGNILGCRGFHSSFRTTQGGMSLNMDVTTTMIIKPGPVVDFLIANQNARDPYSIDWSKAKRTLKNLRVKVSPSGQEFKITGLSDKPCREQTFELKKRNPNENGEFETTEVTVADYFRDTRHIDLQYSADLPCINVGKPKRPTYIPLELCALVPLQRYTKALTTFQRSALVEKSRQKPQERMTVLSKALKVSNYDAEPLLRSCGISISSNFTQVEGRVLPAPKLKMGCGSETFPRNGRWNFNNKEFVEPTKIQRWVVVNFSARCNVRQVVDDLIKIGGSKGIEIASPFQVFEEGNQFRRAPPMIRVENMFKDIQSKLPGVPQFILCVLPDKKNSDLYGPWKKKNLTEFGIVTQCMAPTRQPNDQYLTNLLLKINAKLGGLNSMLSVERTPAFTVISKVPTIILGMDVSHGSPGQSDVPSIAAVVSSREWPLISKYRASVRTQPSKAEMIESLVKKNGTEDDGIIKELLVDFYTSSNKRKPEHIIIFRDGVSESQFNQVLNIELDQIIEACKLLDANWNPKFLLLVAQKNHHTKFFQPTSPENVPPGTIIDNKICHPKNNDFYLCAHAGMIGTTRPTHYHVLYDEIGFSADELQELVHSLSYVYQRSTSAISVVAPICYAHLAAAQLGTFMKFEDQSETSSSHGGITAPGPISVAQLPRLKDNVANSMFFC

SEQ ID NO: 891 - DNA, 1548 bp, Arabidopsis thaliana
  G1273,family:WRKY
tcagattttcttcgttccctaactcctaaaaaggagagattcttcaaatccttatcacaacttcagtttttgcattcaccgtcgtgagtgttctacttttggtcaagtaatggaggtgaatgatggtgaaagagtggtaatagcaaaaccagttgcctcaagaccttcttcaagttctggcttcaggacattcactgagcttcttactgattcagttaccgtatctccgcaaacgacttgccacgagattgtagacgctgctataagaccaaagactttgagattcaatcagccagtagcagcttcggtctcatgtccacgggctgaagtaaaaggtattggaaatggaatgtcttgtgatgatgattcagatagcagaaactacgtcgtttataaaccgaaagcaaagcttgtctccaaagcaaccgtctctgcattggctaatatggggaatcgtcaacaaacttggagacaaagcgaagcagtatcctatgggaagagtgtgagccaaggtacacatcgagcaggtcctaatctagtccagaaagttccatcttttacggaatcagagacatctactggggatagatcttctgtggatggatacaactggaggaaatacggacagaagcaagttaaaggaagtgagtgtccaaggagttattacaaatgcacacacccgaaatgtccggtgaagaagaaagtagagagatcagtggaaggtcaagtttcagagattgtgtatcaaggtgaacataatcactcaaagccatcttgtcctcttccacggcgtgcttcatcatcaatctcttcagggtttcaaaaaccaccaaaatcgattgcttctgaaggatcaatgggacaagaccctaacaataatctctattctcctctatggaacaatcaaagcaatgactctactcaaaacagaacagagaagatgagtgaaggttgtgttattacaccatttgagtttgctgttccaagatcgacaaattcaaatcccggaacttcagattccggttgcaagagtagccaatgtgatgaaggagagcttgatgatccaagcagaagcaaaagaaggaagaacgagaagcaatctagtgaagcaggagtatcgcaaggctcagtggaatcagacagtcttgaagatggattcaggtggagaaagtatggacaaaaagtggtaggaggcaatgcgtatccaagaagttattacagatgcacaagtgctaattgcagagcaaggaaacatgttgaacgagcgagtgatgatccaagagctttcattacaacctacgagggtaaacataatcatcatttgctcttgagccctccatcttcctctactcttccctttaactccccacaactttctaagcaaacaatttgatttgatgatccattcatgctttttcttttttctttttctttttttgttaagaatgagaaaaaagaagaagcaaatggtaaatacaatcaccatttgctcttcactcacaacttcctaagcaaaagccatttgatcaattcatgcctgtttcttca

SEQ ID NO: 892 - protein, 427 aa, Arabidopsis thaliana
  G1273,WRKY domain coordinates 163-218,347-403
MEVNDGERVVIAKPVASRPSSSSGFRTFTELLTDSVTVSPQTTCHEIVDAAIRPKTLRFNQPVAASVSCPRAEVKGIGNGMSCDDDSDSRNYVVYKPKAKLVSKATVSALANMGNRQQTWRQSEAVSYGKSVSQGTHRAGPNLVQKVPSFTESETSTGDRSSVDGYNWRKYGQKQVKGSECPRSYYKCTHPKCPVKKKVERSVEGQVSEIVYQGEHNHSKPSCPLPRRASSSISSGFQKPPKSIASEGSMGQDPNNNLYSPLWNNQSNDSTQNRTEKMSEGCVITPFEFAVPRSTNSNPGTSDSGCKSSQCDEGELDDPSRSKRRKNEKQSSEAGVSQGSVESDSLEDGFRWRKYGQKVVGGNAYPRSYYRCTSANCRARKHVERASDDPRAFITTYEGKHNHHLLLSPPSSSTLPFNSPQLSKQTI

SEQ ID NO: 893 - DNA, 748 bp, Arabidopsis thaliana
  G1275,family:WRKY
ccaagaaaagggaagatcacgcattcttataggcgtaattcgtaaatagtggtgagtatgaatgatgcagacacaaacttggggagtagtttcagcgatgatactcactctgtgttcgagtttccggagctagacttgtcagatgaatggatggatgatgatcttgtgtctgcggtttccgggatgaatcagtcttatggttatcagactagtgatgttgctggtgctttattctcaggttcttctagctgtttcagtcatcctgaatctccaagtaccaaaacttatgttgctgctacagccactgcttctgccgacaaccaaaacaagaaagaaaagaaaaaaattaaagggagagttgcgttcaagacacggtccgaggtggaagtgcttgacgacgggttcaagtggagaaagtatgggaagaagatggtgaagaacagcccacatccaagaaactactacaaatgttcagttgatggctgtcccgtgaagaaaagggttgaacgagacagagatgatccgagctttgtgataacaacttacgagggttcccacaatcactcaagcatgaactaagactcgaactaaggctcaaggcgaccatgctatattcagcacatcttattttctatggttacgaacgatacttaaaactgcttctagttctttatatccattgtaaactggttgcaggttcacaaattttgagaggtttatgacattctaaatctgtagtacttatata

SEQ ID NO: 894 - protein, 173 aa, Arabidopsis thaliana
  G1275,WRKY domain coordinates 113-169
MNDADTNLGSSFSDDTHSVFEFPELDLSDEWMDDDLVSAVSGMNQSYGYQTSDVAGALFSGSSSCFSHPESPSTKTYVAATATASADNQNKKEKKKIKGRVAFKTRSEVEVLDDGFKWRKYGKKMVKNSPHPRNYYKCSVDGCPVKKRVERDRDDPSFVITTYEGSHNHSSMN

SEQ ID NO: 895 - DNA, 1540 bp, Arabidopsis thaliana
  G1276,family:AP2
ttttgttgttgttgtgaaagctcagagttttgtttgcttttttgttgacttttttgagattgatgctggatctcaatctcgacgtcgactcgaccgagtctactcagaacgaacgagattcgattactgttaaaggggtttctttgaatcagatggatgaatcggtgacgtcgaactcttctgttgttaatgctgaagcttctagctgtatagatggtgaagatgagttgtgctctacacgaacggtcaagtttcaatttgagatactgaaaggaggaggagaagaagaagaagaagatgatgatgaaagaagtgctgtgatgatgactaaggagttttttcctgttgctaaaggcatgaactttatggattcgagcgctcaaagttcaaggagcaccgttgatatttccttccagagggggaaacaaggtggagactttataggtagcgggagcggtggtggcgatgcttcacgggtgatgcagccaccatcacagccggtgaagaaaagcaggagaggtcctaggtctaagagttctcagtatagaggcgtcactttctatcggaggacaggcagatgggaatcgcatatctgggattgcggtaaacaagtttatttaggtggatttgatactgcccatgctgcagctagggcgtatgatcgagctgctgtcaaattccggggtctggaagctgacatcaatttcgttattggcgattatgaagaggatctcaagcagatggcgaatctttccaaagaggaagttgtgcaagtacttcggcgacagagctctggtttctcaaggaataattctagatatcaaggagttgctttgcaaaagattggcgggtggggagctcaaatggagcagcttcatggaaacatgggttgtgacaaggcagccgtacaatggaagggaagggaagctgcttccttaattgagcctcatgcatcccgaatgattcccgaggcagctaatgttaagctcgacctcaacttgggaatctctctttcactaggagatggtccgaagcaaaaagatagggccctccggcttcaccatgtccctaacaattccgtatgtggaaggaacaccatgatggagaaccacatggctgcagcggcatgtgatacgcctttcaatttcttgaagaggggttcagaccatcttaataaccggcatgcccttccttctgcgttcttttcacccatggaaagaacaccagagaaagggcttatgttacgttctcatcaaagcttcccagccaggacatggcaagggcatgatcagtccagtggtgggaccgccgtagcagctacagcaccgccactgttttcaaatgcagcatcatcaggattctcactctcagctacacgccctccttcatccacagctattcatcatccttctcagcccttcgtcaatctgaatcagcccggtctctatgttatccacccatctgattacatatctcagcaccaacacaatctcatgaaccgcccacaaccaccaccatagcttcctccttcctccgcata

SEQ ID NO: 896 - protein, 485 aa, Arabidopsis thaliana
  G1276,AP2 domain coordinates 158-224,250-305
MLDLNLDVDSTESTQNERDSITVKGVSLNQMDESVTSNSSVVNAEASSCIDGEDELCSTRTVKFQFEILKGGGEEEEEDDDERSAVMMTKEFFPVAKGMNFMDSSAQSSRSTVDISFQRGKQGGDFIGSGSGGGDASRVMQPPSQPVKKSRRGPRSKSSQYRGVTFYRRTGRWESHIWDCGKQVYLGGFDTAHAAARAYDRAAVKFRGLEADINFVIGDYEEDLKQMANLSKEEVVQVLRRQSSGFSRNNSRYQGVALQKIGGWGAQMEQLHGNMGCDKAAVQWKGREAASLIEPHASRMIPEAANVKLDLNLGISLSLGDGPKQKDRALRLHHVPNNSVCGRNTMMENHMAAAACDTPFNFLKRGSDHLNNRHALPSAFFSPMERTPEKGLMLRSHQSFPARTWQGHDQSSGGTAVAATAPPLFSNAASSGFSLSATRPPSSTAIHHPSQPFVNLNQPGLYVIHPSDYISQHQHNLMNRPQPPP

SEQ ID NO: 897 - DNA, 911 bp, Arabidopsis thaliana
  G1277,family:AP2
attctaaagtcctcctctcggaaagtaagagactcaacttccgagccgccatggacgccggagtagcagtaaaagctgacgtggcagtcaaaatgaagagagaaagaccattcaaagggatcagaatgagaaaatgggggaaatgggttgcggagattcgagaacccaacaagcgttcaagactttggctcggctcttactctactcccgaagcggcggcgcgtgcatacgacacggctgtcttttacctcagaggaccaactgctacgctcaacttcccggagcttctgccgtgtacctccgccgaggatatgtcagcggcaacgatcaggaaaaaggcgacggaggtgggagctcaagtagatgcgataggggcgacggtggtgcagaacaacaaacgccgccgcgtttttagtcaaaagcgtgactttggcggcgggttattagagcttgttgacttgaacaagttacctgacccggaaaatctcgatgatgatttggtgggaaaatagactgaaaaataataataaaatatcttacaatggtggctgtagctatcgtacgcggaatgcttgggcttgtgttatatgactacgtggttacggaaagattcctctgtttcgtcattgtattaaaatttaatcccacaagtcaaacatactgtacattattcttaatttagtattttcttattaatatctatcatttgtttggtgaacaccagaatattagactattaatgtaacgagtttttaatatttcgatcataataacaccaagctagttaaaggttaatatcttgttacgaagtcttgagtaagttcaattgtcatatatatgtaacggaagaggttcgttcgggtcccaagtgaagtggatcaaaggtgacttcacataaaaaataaaaaaaa

SEQ ID NO: 898 - protein, 153 aa, Arabidopsis thaliana
  G1277,AP2 domain coordinates 18-85
MDAGVAVKADVAVKMKRERPFKGIRMRKWGKWVAEIREPNKRSRLWLGSYSTPEAAARAYDTAVFYLRGPTATLNFPELLPCTSAEDMSAATIRKKATEVGAQVDAIGATVVQNNKRRRVFSQKRDFGGGLLELVDLNKLPDPENLDDDLVGK

SEQ ID NO: 899 - DNA, 1978 bp, Arabidopsis thaliana
  G1289,family:AKR
tggagctcagctcagctcacactttcctcttcctcttacctgaaacgcgtctcgtaacactgatctctaatgatcttcgtctccaatggcgatatcagtacaacacgtcgtcgttttactcctctccactctcctcatcgccatcaccttcttcctcttcacctccgataacgccagattccctttcccttctctctccaccaccgattactacacaccaatcccaaaatctccaattcctcaccgaatcgtcgacgtttcttcagatcaaactccacagaagatgaagctaaacacttccctcgaggtgggagagctgaaatgggatctatgtaaaggtgcagaatctgttgattacataccttgtcttgataattacgctgccatcaagcagctcaaatcaaggagacatatggagcatcgagaacgtcattgccctgaaccaagtcctaaatgtctccttcccttgcctgataattataagccgccggttccgtggcctaagagccgggatatgatttggtatgacaatgttcctcatcccaagcttgttgaatacaagaaggaacaaaattgggttaaaaaagagggtgaatttctagtttttcctggaggaggtactcaattcaaattcggggttactcattacgttgagttcatcgaaaaggcgttaccgagtatcaaatgggggaaaaacataagggttgtattagatgttggttgtggtgttgctagctttggcggatctttattagataaagatgtcattacaatgtcgtttgctcctaaagatgaacatgaagctcagattcaatttgcgttagaacgaggaatacctgcaacactttctgttattggaacacaacagctcacgtttccgagcaatgcatttgatcttatacattgtgcacggtgcagagtccattgggatgctgatggtgggaaaccgttgttggagctcaatagggtacttaggccaggaggtttcttcatatggtctgcaacaccagtctatcgagataatgacagagatagcagaatttggaatgaaatggtttctcttactaaatccatttgctggaaggtcgtgacaaagacggttgattcctctggaatcggacttgtgatctatcaaaagccaacatcagaatcctgttataataaacgcagcacacaagatccaccactttgtgataaaaaggaagcaaatggttcatggtatgttcctctcgctaaatgcctttccaagttacctagtggaaatgtccagagttggcctgaactatggcctaaacggcttgtgagtgttaaaccgcaaagcatttcagttaaagcggaaacattgaagaaagatacagagaaatggtcagcaagtgtttctgatgtttacctcaaacatctagctgtaaactggtcgactgtgcggaatgtgatggacatgaatgctggttttggcggttttgctgctgaacttataaatcaaccactctgggtgatgaatgatgtccctgtggataaacctgacactctctccgtcgtttatgatcgaggcttgatcggagtttaccatgattggtgtgagtccgtcaacacttaccctagaacatacgatctgttacattccagtttcctcctaggtgatctcacacaaaggtgtgagattgtacaagtggtagctgagatagatcggatagtgagaccaggtggatatcttgtggtacaagacaacatggaaacaataatgaagcttgaatccatacttggttcgcttcattggtcaaccaaaatatacgaggaccggtttttggttggtcggaagggattttggcgtcccgctaaaccggagctcagatagacagaacgagagacataaacatactagcaaagtaaatttgtacactactatcaatgacgcaaccagattatatcacagcgtactatataacccattaagggggttttgttttgaaaaaaaaaa

SEQ ID NO: 900 - protein, 589 aa, Arabidopsis thaliana
  G1289,AKR domain coordinates 90-578
MAISVQHVVVLLLSTLLIAITFFLFTSDNARFPFPSLSTTDYYTPIPKSPIPHRIVDVSSDQTPQKMKLNTSLEVGELKWDLCKGAESVDYIPCLDNYAAIKQLKSRRHMEHRERHCPEPSPKCLLPLPDNYKPPVPWPKSRDMIWYDNVPHPKLVEYKKEQNWVKKEGEFLVFPGGGTQFKFGVTHYVEFIEKALPSIKWGKNIRVVLDVGCGVASFGGSLLDKDVITMSFAPKDEHEAQIQFALERGIPATLSVIGTQQLTFPSNAFDLIHCARCRVHWDADGGKPLLELNRVLRPGGFFIWSATPVYRDNDRDSRIWNEMVSLTKSICWKVVTKTVDSSGIGLVIYQKPTSESCYNKRSTQDPPLCDKKEANGSWYVPLAKCLSKLPSGNVQSWPELWPKRLVSVKPQSISVKAETLKKDTEKWSASVSDVYLKHLAVNWSTVRNVMDMNAGFGGFAAELINQPLWVMNDVPVDKPDTLSVVYDRGLIGVYHDWCESVNTYPRTYDLLHSSFLLGDLTQRCEIVQVVAEIDRIVRPGGYLVVQDNMETIMKLESILGSLHWSTKIYEDRFLVGRKGFWRPAKPELR

SEQ ID NO: 901 - DNA, 2083 bp, Arabidopsis thaliana
  G1290,family:AKR
aattccactgttattagactcttgactctgttttgtttcccgccgatctcgtgatgatggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggattaaggaatgggaaatcatattccatttcactcccacaactaaaaatgatgtatgtcctatatcatgatgtttcgtgagtttcaaataaattgaaacgtacatatatcagtttttcatctacgtgactgcgttgtatagttttcgttcttcacttagcatcatgtgtattctagctccaagtgcgtttcaaacaaatatagttatttttagccaattatatatacggt

SEQ ID NO: 902 - protein, 601 aa, Arabidopsis thaliana
  G1290,AKR domain coordinates 270-366
MMATTTTTTTARFSDSYEFSNTSGNSFFAAESSLDYPTEFLTPPEVSALKLLSNCLESVFDSPETFYSDAKLVLAGGREVSFHRCILSARIPVFKSALATVKEQKSSTTVKLQLKEIARDYEVGFDSVVAVLAYVYSGRVRSPPKGASACVDDDCCHVACRSKVDFMVEVLYLSFVFQIQELVTLYERQFLEIVDKVVVEDILVIFKLDTLCGTTYKKLLDRCIEIIVKSDIELVSLEKSLPQHIFKQIIDIREALCLEPPKLERHVKNIYKALDSDDVELVKMLLLEGHTNLDEAYALHFAIAHCAVKTAYDLLELELADVNLRNPRGYTVLHVAAMRKEPKLIISLLMKGANILDTTLDGRTALVIVKRLTKADDYKTSTEDGTPSLKGGLCIEVLEHEQKLEYLSPIEASLSLPVTPEELRMRLLYYENRVALARLLFPVETETVQGIAKLEETCEFTASSLEPDHHIGEKRTSLDLNMAPFQIHEKHLSRLRALCKTVELGKRYFKRCSLDHFMDTEDLNHLASVEEDTPEKRLQKKQRYMELQETLMKTFSEDKEECGKSSTPKPTSAVRSNRKLSHRRLKVDKRDFLKRPYGNGD

SEQ ID NO: 903 - DNA, 978 bp, Arabidopsis thaliana
  G1304,family:MYB-(R1)R2R3
atggggcgatcaccatgttgcgatgagaatggtctaaagaaagggccatggacacaagaggaggatgataaactgatagatcacattcaaaaacatggccatggcagctggagagctcttccaaagcaagccggtttaaaccgatgcggaaagagttgtagattaagatggaccaactacttgagacctgacatcaagagaggaaatttcactgaagaggaagaacaaactattatcaacctccattcccttcttggaaacaagtggtcgtcgatagccggtaatcttcctggaagaacggacaatgaaataaaaaactattggaacacacatttgagaaagaaacttctccaaatggggattgatccggtgacccataggccaagaaccgaccatctaaacgttttagcagctctcccgcagcttatagccgccgcaaatttcaacagcctcttgaatctcaaccaaaatgtgcaactggatgcaacaactcttgctaaagctcaactgctacacactatgattcaagtccttagcaccaataacaacaccaccaatccttctttttcttcatcaactatgcaaaacagtaacaccaatctctttggccaagcttcttacttagagaaccaaaatctttttggtcagtctcaaaacttctctcacattcttgaggatgagaatttgatggtcaaaacccaaattattgataaccctttggactctttttcttcccccatacaacccggttttcaagatgatcataattcactccctctattggttccggcgtctcctgaagaatctaaagaaactcaaaggatgatcaagaacaaagacatcgtcgattaccatcatcatgatgcttcaaacccttcatcatcaaactcaacgtttacacaagatcatcatcacccatggtgtgacactattgatgatggagcaagtgattctttttggaaagagataatagagtaa

SEQ ID NO: 904 - protein, 325 aa, Arabidopsis thaliana
  G1304,MYB-(R1)R2R3 domain coordinates 13-118
MGRSPCCDENGLKKGPWTQEEDDKLIDHIQKHGHGSWRALPKQAGLNRCGKSCRLRWTNYLRPDIKRGNFTEEEEQTIINLHSLLGNKWSSIAGNLPGRTDNEIKNYWNTHLRKKLLQMGIDPVTHRPRTDHLNVLAALPQLIAAANFNSLLNLNQNVQLDATTLAKAQLLHTMIQVLSTNNNTTNPSFSSSTMQNSNTNLFGQASYLENQNLFGQSQNFSHILEDENLMVKTQIIDNPLDSFSSPIQPGFQDDHNSLPLLVPASPEESKETQRMIKNKDIVDYHHHDASNPSSSNSTFTQDHHHPWCDTIDDGASDSFWKEIIE

SEQ ID NO: 905 - DNA, 720 bp, Arabidopsis thaliana
  G1305,family:MYB-(R1)R2R3
atggggaatagaagagcaccatgctgtgacaaaagccaagtgaagagagggccatggagtgatgaagaaagtgaaagactcagatcttttatcctcaaaaatggtcatcaaaattggcgatctcttcccaaactcgctggattgatgagatgcggaaagagttgtcgtctaagatggataaactatctgagaccaggtctcaaacgaggcaacttcaccaaggaggaggaagataccattatccaccttcaccaagcttatggaaacaagtggtctaagatcgcatccaacttcccgggaaggacagacaacgagatcaagaatgtatggaacactcatctcaagaagcggttggtgaagaggagcatttcatcatcatcatccgatgttaccaatcattcagtgtcttctacctcttcttcctcttcctcaatctcgtcagtcttgcaggacgttattattaagagtgagaggcctaaccaggaagaggagtttggggaaatcttggtggagcaaatggcatgtggatttgaggtggatgcaccacaatcactagaatgtctctttgacgatagccaggttcctcctcctatatctaaaccagactcactacaaacccatgggaagtcatcagatcacgaattttggagccgactgattgaaccagggttcgatgattacaatgagtggctcattttcttggataaccaaacttgctag

SEQ ID NO: 906 - protein, 239 aa, Arabidopsis thaliana
  G1305,MYB-(R1)R2R3 domain coordinates 15-118
MGNRRAPCCDKSQVKRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHLKKRLVKRSISSSSSDVTNHSVSSTSSSSSSISSVLQDVIIKSERPNQEEEFGEILVEQMACGFEVDAPQSLECLFDDSQVPPPISKPDSLQTHGKSSDHEFWSRLIEPGFDDYNEWLIFLDNQTC

SEQ ID NO: 907 - DNA, 912 bp, Arabidopsis thaliana
  G1309,family:MYB-(R1)R2R3
cgtcgacctcttaattaagacgacttgagagagaaagaaagatacgtggaagatgaccaaatctggagagagaccaaaacagagacagaggaaagggttatggtcacctgaagaagaccagaagctcaagagtttcatcctctctcgtggccatgcttgctggaccactgttcccatcctagctggattgcaaaggaatgggaaaagctgcagattaaggtggattaattacctaagaccaggactaaagagggggtcgtttagtgaagaagaagaagagaccatcttgactttacattcttccttgggtaacaagtggtctcggattgcaaaatatttaccgggaagaacagacaacgagattaagaactattggcattcctatctgaagaagagatggctcaaatctcaaccacaactcaaaagccaaatatcagacctcacagaatctccttcttcactactttcttgcgggaaaagaaatctggaaaccgaaaccctagatcacgtgatctccttccagaaattttcagagaatccaacttcatcaccatccaaagaaagcaacaacaacatgatcatgaacaacagtaataacttgcctaaactgttcttctctgagtggatcagttcttcaaatccacacatcgattactcctctgcttttacagattccaagcacattaatgaaactcaagatcaaatcaatgaagaggaagtgatgatgatcaataacaacaactactcttcacttgaggatgtcatgctccgtacagattttttgcagcctgatcatgaatatgcaaattattattcttctggagatttcttcatcaacagtgaccaaaattatgtctaagaagagtgaatatgatcgtaagaggaacataagctagttacttgtgttacagc

SEQ ID NO: 908 - protein, 268 aa, Arabidopsis thaliana
  G1309,MYB-(R1)R2R3 domain coordinates 13-115
MTKSGERPKQRQRKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKRWLKSQPQLKSQISDLTESPSSLLSCGKRNLETETLDHVISFQKFSENPTSSPSKESNNNMIMNNSNNLPKLFFSEWISSSNPHIDYSSAFTDSKHINETQDQINEEEVMMINNNNYSSLEDVMLRTDFLQPDHEYANYYSSGDFFINSDQNYV

SEQ ID NO: 909 - DNA, 800 bp, Arabidopsis thaliana
  G1311,family:MYB-(R1)R2R3
aagtataataacacaaagaaacagagtaaaagaaagaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttggtttatttactttttaaaaaaaaaaaaaaaaa

SEQ ID NO: 910 - protein, 238 aa, Arabidopsis thaliana
  G1311,MYB-(R1)R2R3 domain coordinates 11-112
MDFKKEETLRRGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKKQEAQNYGKLFEWRGNTGEELLHKYKETEITRTKTTSQEHGFVEVVSMESGKEANGGVGGRESFGVMKSPYENRISDWISEISTDQSEANLSEDHSSNSCSENNINIGTWWFQETRDFEEFSCSLWS

SEQ ID NO: 911 - DNA, 1356 bp, Arabidopsis thaliana
  G1313,family:MYB-(R1)R2R3
atgagttacacgagcactgacagtgaccataatgagtcaccagctgctgatgataatggaagtgactgcagaagtagatgggatggtcatgctctcaagaaaggcccttggagttcagctgaagatgatattcttattgactatgtgaataagcatggtgagggtaactggaatgctgtgcagaaacacaccagcttgtttcgttgtggtaaaagctgtcgtctaagatgggctaatcatctgaggccaaatttgaagaaaggagcttttagtcaagaagaagaacagcttatcgttgaattgcatgccaagatgggtaatagatgggcacgtatggctgcacatttgcctggccgaacggataatgagataaagaattattggaacactcgtatcaagaggcgacaacgagctggtttgccactttatcctcctgagatgcatgttgaggcacttgagtggagtcaagagtatgccaagagtagagttatgggagaagatagaagacatcaagatttcttgcagctggggagttgtgaatctaatgtcttctttgatactcttaattttaccgacatggtacctggtacttttgatctagcagatatgactgcctacaaaaatatgggtaactgtgcaagttctcctcgatatgaaaacttcatgacaccaacaatcccctcctcgaagcgactttgggaatctgagttgttgtatcctgggtgtagcagtaccataaagcaagaattctcgtcgcctgaacaattccggaacacatctccacaaacgatttccaaaacttgcagcttctcagttccttgtgatgttgagcatcctctctatggaaaccgacattcacctgttatgattccagatagccatacccctacggatggcattgttccttattctaagcccttatatggggcagtgaagctggagctcccttcattccaatattcagaaacaacatttgaccagtggaagaaatcgtcatctcctccacactctgatctccttgatccctttgatacttacattcagtctccaccaccaccaacggggggagaagagtcagatttatattcaaattttgatactggtctgctcgatatgttgcttctggaagccaagatcagaaataatagtacaaagaacaatttgtacaggagctgcgcttcaactattccatcagctgatcttggccaggttactgtatcccaaactaaatccgaggagtttgacaattcccttaagagcttcttggttcattccgaaatgtccacacaaaatgcagatgaaactccaccaagtgagttactattcaccttaccatcacttgaaatagtttgttga

SEQ ID NO: 912 - protein, 451 aa, Arabidopsis thaliana
  G1313,MYB-(R1)R2R3 domain coordinates 32-135
MSYTSTDSDHNESPAADDNGSDCRSRWDGHALKKGPWSSAEDDILIDYVNKHGEGNWNAVQKHTSLFRCGKSCRLRWANHLRPNLKKGAFSQEEEQLIVELHAKMGNRWARMAAHLPGRTDNEIKNYWNTRIKRRQRAGLPLYPPEMHVEALEWSQEYAKSRVMGEDRRHQDFLQLGSCESNVFFDTLNFTDMVPGTFDLADMTAYKNMGNCASSPRYENFMTPTIPSSKRLWESELLYPGCSSTIKQEFSSPEQFRNTSPQTISKTCSFSVPCDVEHPLYGNRHSPVMIPDSHTPTDGIVPYSKPLYGAVKLELPSFQYSETTFDQWKKSSSPPHSDLLDPFDTYIQSPPPPTGGEESDLYSNFDTGLLDMLLLEAKIRNNSTKNNLYRSCASTIPSADLGQVTVSQTKSEEFDNSLKSFLVHSEMSTQNADETPPSELLFTLPSLEIVC

SEQ ID NO: 913 - DNA, 990 bp, Arabidopsis thaliana
  G1314,family:MYB-(R1)R2R3
atgggaagagctccgtgttgcgacaagacaaaagtgaagcgagggccttggtcgcctgaagaagactctaaacttagagattacattgaaaagtatggtaatggtggaaattggatctctttccccctcaaagccggtttgaggagatgtgggaagagttgtagactgaggtggctaaactatttgagaccaaacataaagcatggtgacttctctgaggaagaagacaggatcatttttagtctcttcgctgccataggaagcaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctag

SEQ ID NO: 914 - protein, 329 aa, Arabidopsis thaliana
  G1314,MYB-(R1)R2R3 domain coordinates 14-116
MGRAPCCDKTKVKRGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKKLLSSSSDSSSSAMASPYLNPISQDVKRPTSPTTIPSSSYNPYAENPNQYPTKSLISSINGFEAGDKQIISYINPNYPQDLYLSDSNNNTSNANGFLLNHNMCDQYKNHTSFSSDVNGIRSEIMMKQEEIMMMMMIDHHIDQRTKGYNGEFTQGYYNYYNGHGDLKQMISGTGTNSNINMGGSGSSSSSISNLAENKSSGSLLLEYKCLPYFYS

SEQ ID NO: 915 - DNA, 849 bp, Arabidopsis thaliana
  G1317,family:MYB-(R1)R2R3
atgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaa

SEQ ID NO: 916 - protein, 282 aa, Arabidopsis thaliana
  G1317,MYB-(R1)R2R3 domain coordinates 13-118
MGRSPCCDKNGVKKGPWTAEEDQKLIDYIRFHGPGNWRTLPKNAGLHRCGKSCRLRWTNYLRPDIKRGRFSFEEEETIIQLHSVMGNKWSAIAARLPGRTDNEIKNHWNTHIRKRLVRSGIDPVTHSPRLDLLDLSSLLSALFNQPNFSAVATHASSLLNPDVLRLASLLLPLQNPNPVYPSNLDQNLQTPNTSSESSQPQAETSTVPTNYETSSLEPMNARLDDVGLADVLPPLSESFDLDSLMSTPMSSPRQNSIEAETNSSTFFDFGIPEDFILDDFMF

SEQ ID NO: 917 - DNA, 1011 bp, Arabidopsis thaliana
  G1322,family:MYB-(R1)R2R3
aaagttattgatagtttctgttacttattaatttttaaggttatgtgtattattaccaattggaggactatatagtcgcaagtctcaaccctataaaagaaaacattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtctaaaacgtactggaaaaagttgtcggctccggtggctgaactatctccgaccagatgtgcggcgagggaacataaccgaagaagaacagcttttgatcattcagcttcatgctaagcttggaaacaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgagtaaaaaaaaaaaaaa

SEQ ID NO: 918 - protein, 206 aa, Arabidopsis thaliana
  G1322,MYB-(R1)R2R3 domain coordinates 26-130
METTMKKKGRVKATITSQKEEEGTVRKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMKVSSENMMNHQHHCSGNSQSSGMTTQGSSGKAIDTAESFSQAKTTTFNVVEQQSNENYWNVEDLWPVHLLNGDHHVI

SEQ ID NO: 919 - DNA, 1088 bp, Arabidopsis thaliana
  G1323,family:MYB-(R1)R2R3
aagagggaatctcaaaagtgtgtgtctgtgagagaggagagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtagtagcaacaacgaagaaacgtcgaattgtagacaaaatgtagatattacagagttgaaagattgtattttgcaaatgattgctttgtagtgaaatcaagttatcacaaaaaaaaaaaaaa

SEQ ID NO: 920 - protein, 273 aa, Arabidopsis thaliana
  G1323,MYB-(R1)R2R3 domain coordinates 15-116
MGKGRAPCCDKTKVKRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKKRLSSETNLNADEAGSKGSLNEEENSQESSPNASMSFAGSNISSKDDDAQISQMFEHILTYSEFTGMLQEVDKPELLEMPFDLDPDIWSFIDGSDSFQQPENRALQESEEDEVDKWFKHLESELGLEENDNQQQQQHKQGTEDEHSSSLLESYELLIH

SEQ ID NO: 921 - DNA, 1137 bp, Arabidopsis thaliana
  G1324,family:MYB-(R1)R2R3
cgaaaacaccacaaaccaaatatcattaagtaattaggaaacttaaactaagtatggaaaattcgatgaagaagaagaagagcttcaaagaaagtgaagatgaagaactaagaagagggccttggactttggaggaagacacacttctcacaaattacatcctccataacggtgagggtcgttggaatcacgtcgccaaatgtgctgggctaaagagaactgggaaaagttgtagattgagatggttgaattacttgaaacccgacataagacgagggaatcttactcctcaagaacagcttttgatccttgagcttcactctaaatggggtaataggtggtccaagattgcacagtacttgccaggaagaacggataacgagatcaagaactattggagaacaagagttcaaaaacaagctcgtcaactcaacatcgaatctaacagcgacaagttctttgacgctgttcgtagtttttgggtccctagattgatcgagaagatggaacaaaactcatccactactactacttattgttgtccccaaaacaacaacaacaactctcttcttcttccttctcaatctcacgactctttaagtatgcaaaaagatatagattactcgggtttcagcaacatagacggttcttcttcaacttctacttgcatgtctcatctaacaacagttccacactttatggatcaaagcaacaccaatatcatcgatggctcgatgtgtttccatgaaggcaatgttcaagaattcggaggatatgttcctggcatggaggattacatggtaaactcggacatctcaatggaatgtcacgtggcggatggttattcagcgtacgaggatgttacacaagatcccatgtggaatgtggatgacatttggcagtttagggagtaattaagtcgtcaagagatgagatggtagagcctaccactacggttctattatatggactaatatacttcttttgcttaactaagcaaaaagtttcgaaccttttacccatattatctcgggttggagactagaacatgttaaatttgtatcttctttgttgcgagtacttactaagtcattggataaatatttataatgatagtttcttgtacaaaaaaaaaaa

SEQ ID NO: 922 - protein, 286 aa, Arabidopsis thaliana
  G1324,MYB-(R1)R2R3 domain coordinates 20-118
MENSMKKKKSFKESEDEELRRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTRVQKQARQLNIESNSDKFFDAVRSFWVPRLIEKMEQNSSTTTTYCCPQNNNNNSLLLPSQSHDSLSMQKDIDYSGFSNIDGSSSTSTCMSHLTTVPHFMDQSNTNIIDGSMCFHEGNVQEFGGYVPGMEDYMVNSDISMECHVADGYSAYEDVTQDPMWNVDDIWQFRE

SEQ ID NO: 923 - DNA, 880 bp, Arabidopsis thaliana
  G1326,family:MYB-(R1)R2R3
cgacggtacggtggagatagagatagcatccatggagatgtctagaggaagcaacagttttgacaataagaagcctagttgccaaagaggtcactggagacctgttgaagatgacaatctccggcaactcgttgaacaatacggtcccaagaactggaattttattgctcaacatctctatggaagatcagggaaaagctgtagattaagatggtacaaccaacttgatccaaacatcaccaagaaacccttcaccgaggaggaagaagagagactgcttaaagctcatcggatccaagggaatcgttgggcctccatagcccgactgttccccgggaggaccgacaacgctgtcaaaaaccattttcatgtcatcatggctagacgcaaacgggaaaacttctcttccacagctacttctacgttcaaccaaacttggcatactgttttgagccctagttctagtcttacaaggctaaatagatcccatttcgggctatggaggtatcgaaaggataagagttgcggtctctggccttactcttttgtttcaccacctacgaatggtcaatttggatcttcatctgtctctaacgtacaccacgaaatttatcttgagaggagaaagtcgaaagagttggtggatcctcagaattacacatttcatgcagccacaccagatcataagatgacttcaaatgaagatggaccatccatgggagatgatggtgagaagaacgatgttactttcattgattttcttggtgttggattagcttcttaggttataacatcacaagtcaaagcttttaagggtttctatcattagggttaggcatcattttcagccttttgcttccttaaactctcatatggatct

SEQ ID NO: 924 - protein, 250 aa, Arabidopsis thaliana
  G1326,MYB-(R1)R2R3 domain coordinates 18-121
MEMSRGSNSFDNKKPSCQRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKRENFSSTATSTFNQTWHTVLSPSSSLTRLNRSHFGLWRYRKDKSCGLWPYSFVSPPTNGQFGSSSVSNVHHEIYLERRKSKELVDPQNYTFHAATPDHKMTSNEDGPSMGDDGEKNDVTFIDFLGVGLAS

SEQ ID NO: 925 - DNA, 891 bp, Arabidopsis thaliana
  G1327,family:MYB-(R1)R2R3
atggggaaaggaagagcaccatgctgcgacaagaacaaagtgaagagagggccatggagccctcaagaagatctcactctcatcacttttattcaaaaacatggccatcaaaactggagatctcttcccaagcttgctggattgttgagatgtgggaaaagttgccgactaagatggataaactatctgagaccggacgtgaagcgaggcaactttagcaaaaaggaggaagatgctatcattcactaccatcaaacccttggaaacaagtggtcaaagatcgcgtccttcttgccgggaagaactgacaacgagatcaaaaacgtgtggaacacgcatctcaagaaacgactcactccatcttcttcttcttcatccctctctagcactcatgaccaaagcacaaaagcagatcatgacaagaactgtgacggggctcaagaagaaatacattcagggttaaatgagagccaaaactcagctacttcgtcacatcaccaaggcgagtgtatgcacacaaaaccagagcttcatgaggttaatggactcaacgagatccagttcctgctcgaccatgatgactttgatgatataacctctgagtttcttcaggataacgatatcttatttccgctagactctcttcttcataaccaccaaactcacatttcaacccaagaaatgactcgagaggtaaccaaatcgcaatcatttgatcatcctcaaccggatatcccatgcggatttgaagacacaaacgaagaatccgacttgaggagacagctggttgaatcaaccacacctaacaatgagtacgacgagtggttcaacttcattgacaaccaaacttactttgatgattttaatttcgtcggagaagtatgtctatga

SEQ ID NO: 926 - protein, 296 aa, Arabidopsis thaliana
  G1327,MYB-(R1)R2R3 domain coordinates 14-116
MGKGRAPCCDKNKVKRGPWSPQEDLTLITFIQKHGHQNWRSLPKLAGLLRCGKSCRLRWINYLRPDVKRGNFSKKEEDAIIHYHQTLGNKWSKIASFLPGRTDNEIKNVWNTHLKKRLTPSSSSSSLSSTHDQSTKADHDKNCDGAQEEIHSGLNESQNSATSSHHQGECMHTKPELHEVNGLNEIQFLLDHDDFDDITSEFLQDNDILFPLDSLLHNHQTHISTQEMTREVTKSQSFDHPQPDIPCGFEDTNEESDLRRQLVESTTPNNEYDEWFNFIDNQTYFDDFNFVGEVCL

SEQ ID NO: 927 - DNA, 1161 bp, Arabidopsis thaliana
  G1328,family:MYB-(R1)R2R3
aattcaatcactatatttttttaaaaacatttgacttcatcgatcggttaacaattaatcaaaaagatgggacgatcaccatgttgtgagaagaagaatggtctcaagaaaggaccatggactcctgaggaggatcaaaagctcattgattatatcaatatacatggttatggaaattggagaactcttcccaagaatgctgggttacaaagatgtggtaagagttgtcgtctccggtggaccaactatctccgaccagatattaagcgtggaagattctcttttgaagaagaagaaaccattattcaacttcacagcatcatgggaaacaagtggtctgcgattgcggctcgtttgcctggaagaacagacaacgagatcaaaaactattggaacactcacatcagaaaaagacttctaaagatgggaatcgacccggttacacacactccacgtcttgatcttctcgatatctcctccattctcagctcatctatctacaactcttcgcatcatcatcatcatcatcatcaacaacatatgaacatgtcgaggctcatgatgagtgatggtaatcatcaaccattggttaaccccgagatactcaaactcgcaacctctctcttttcaaaccaaaaccaccccaacaacacacacgagaacaacacggttaaccaaaccgaagtaaaccaataccaaaccggttacaacatgcctggtaatgaagaattacaatcttggttccctatcatggatcaattcacgaatttccaagacctcatgccaatgaagacgacggtccaaaattcattgtcatacgatgatgattgttcgaagtccaattttgtattagaaccttattactccgactttgcttcagtcttgaccacaccttcttcaagcccgactccgttaaactcaagttcctcaacttacatcaatagtagcacttgcagcaccgaggatgaaaaagagagttattacagtgataatatcactaattattcgtttgatgttaatggttttctccaattccaataaacaaaacgccattggaatagagttatgtaaacatgcaatcattgtatttgttatatagattttgttacatatccaaaatccaaaatactatagttttaaaataaaaaaaaaaaaaaaaaa

SEQ ID NO: 928 - protein, 324 aa, Arabidopsis thaliana
  G1328,MYB-(R1)R2R3 domain coordinates 14-119
MGRSPCCEKKNGLKKGPWTPEEDQKLIDYINIHGYGNWRTLPKNAGLQRCGKSCRLRWTNYLRPDIKRGRFSFEEEETIIQLHSIMGNKWSAIAARLPGRTDNEIKNYWNTHIRKRLLKMGIDPVTHTPRLDLLDISSILSSSIYNSSHHHHHHHQQHMNMSRLMMSDGNHQPLVNPEILKLATSLFSNQNHPNNTHENNTVNQTEVNQYQTGYNMPGNEELQSWFPIMDQFTNFQDLMPMKTTVQNSLSYDDDCSKSNFVLEPYYSDFASVLTTPSSSPTPLNSSSSTYINSSTCSTEDEKESYYSDNITNYSFDVNGFLQFQ

SEQ ID NO: 929 - DNA, 981 bp, Arabidopsis thaliana
  G1330,family:MYB-(R1)R2R3
gtaccggcgacctctttgtgggtcactcttcatcaatgggtgacaaaggaaggagcttaaagatcaacaagaacatggaggaattcacgaaagtggaagaagaaatggacgtaaggagaggtccatggacagttgaggaagatttagagctcatcaattacattgctagtcatggtgaaggtcgatggaactctctcgctcgttgcgccgaactcaaaaggaccggaaaaagctgcagacttcggtggctgaactatctccgaccagatgtgcgccgtggaaacataaccctcgaagaacaactcttgattcttgaacttcacacacgttggggcaatagatggtctaagattgcacaatatttaccaggaagaacggataacgagatcaaaaactattggagaacacgtgttcaaaagcatgcaaaacagcttaaatgcgacgtgaacagtcaacaatttaaagacaccatgaagtatctttggatgcctcggctcgtagaaaggatccaagccgcgtccatcgggtctgtttccatgtcatcttgcgtcaccacctcctcagatcagttcgtgatcaacaacaacaacaccaacaacgtggataatttggctttaatgagtaaccctaatggttacatcacgccggataattccagcgtggcagtatctcctgtatcagatttgacggagtgtcaagtgagtagtgaagtgtggaagattggtcaggatgagaatttggtggatccaaaaatgacatcgccgaattatatggataatagcagtggactattaaacggagattttacgaagatgcaagatcaaagtgaccttaattggtttgaaaatattaatgggatggtaccaaattattcggacagtttttggaacattggaaatgatgaagacttctggctcttacaacaacatcaacaagtccacgacaatggaagcttctgaatagacaagaagctatgcggcc

SEQ ID NO: 930 - protein, 307 aa, Arabidopsis thaliana
  G1330,MYB-(R1)R2R3 domain coordinates 28-134
MGDKGRSLKINKNMEEFTKVEEEMDVRRGPWTVEEDLELINYIASHGEGRWNSLARCAELKRTGKSCRLRWLNYLRPDVRRGNITLEEQLLILELHTRWGNRWSKIAQYLPGRTDNEIKNYWRTRVQKHAKQLKCDVNSQQFKDTMKYLWMPRLVERIQAASIGSVSMSSCVTTSSDQFVINNNNTNNVDNLALMSNPNGYITPDNSSVAVSPVSDLTECQVSSEVWKIGQDENLVDPKMTSPNYMDNSSGLLNGDFTKMQDQSDLNWFENINGMVPNYSDSFWNIGNDEDFWLLQQHQQVHDNGSF

SEQ ID NO: 931 - DNA, 786 bp, Arabidopsis thaliana
  G1331,family:MYB-(R1)R2R3
atggtggaagaagtttggagaaagggtccatggaccgccgaagaagaccgtcttttgatcgaatacgtccgtgttcacggtgaaggtcgttggaactctgtctctaaactcgcaggattgaaaaggaatggcaaaagctgcagactaagatgggtgaattaccttagaccagacctcaagagaggacagatcactccacatgaagaaagtataatacttgagctacacgctaagtggggaaataggtggtcaacaattgcacgtagtttaccaggaagaacagacaatgagatcaagaactattggagaacccatttcaagaaaaaggcaaagcctacgactaacaatgcggagaagataaagagtcgtctcctaaaaaggcaacacttcaaggaacagagagaaatagagttgcaacaagaacagcagttgtttcagttcgaccaactcggtatgaaaaagatcatctctttactcgaagaaaacaatagcagtagcagtagcgatggcggtggtgatgtgttctattatcctgatcaaataacacattcatcaaaaccctttggctataactctaattcattagaggagcagttacaaggtagattttctcctgtaaacatacctgatgctaatactatgaacgaagacaatgccatatgggacgggttttggaacatggatgttgtaaatggacatggtgggaacttgggtgttgtggctgctactgctgcttgtggcccaaggaagccctatttccataacttggtgattccattttgttaa

SEQ ID NO: 932 - protein, 261 aa, Arabidopsis thaliana
  G1331,MYB-(R1)R2R3 domain coordinates 8-109
MVEEVWRKGPWTAEEDRLLIEYVRVHGEGRWNSVSKLAGLKRNGKSCRLRWVNYLRPDLKRGQITPHEESIILELHAKWGNRWSTIARSLPGRTDNEIKNYWRTHFKKKAKPTTNNAEKIKSRLLKRQHFKEQREIELQQEQQLFQFDQLGMKKIISLLEENNSSSSSDGGGDVFYYPDQITHSSKPFGYNSNSLEEQLQGRFSPVNIPDANTMNEDNAIWDGFWNMDVVNGHGGNLGVVAATAACGPRKPYFHNLVIPFC

SEQ ID NO: 933 - DNA, 606 bp, Arabidopsis thaliana
  G1332,family:MYB-(R1)R2R3
atggaatgcaaaagagaagaagggaagtcttacgtgaagagagggttgtggaaaccagaagaagatatgatattaaaaagctatgttgagactcatggtgaaggaaactgggcagacatttctcgtagatccgggttgaagagaggaggaaaaagctgtaggctgagatggaagaactatctaagaccaaatatcaaaagaggaagcatgtcaccacaagaacaagaccttatcatccgcatgcataagcttcttggaaacagatggtcgttgatcgctggtcgccttccaggtcgtactgacaatgaagtgaagaactactggaatactcatttgaacaagaaacctaattcccgaaaacagaatgcacctgaatcaatcgtcggcgccactcctttcacggataagccagttatgtctacagaactgagaagaagccatggagaaggaggagaagaggagagcaatacctggatggaggagaccaaccactttggctatgacgtccacgtaggatctcccttgccacttatttcccactacccagacaacactctcgtgtttgacccatgtttttcctttaccgatttctttcctctgctttag

SEQ ID NO: 934 - protein, 201 aa, Arabidopsis thaliana
  G1332,MYB-(R1)R2R3 domain coordinates 13-116
MECKREEGKSYVKRGLWKPEEDMILKSYVETHGEGNWADISRRSGLKRGGKSCRLRWKNYLRPNIKRGSMSPQEQDLIIRMHKLLGNRWSLIAGRLPGRTDNEVKNYWNTHLNKKPNSRKQNAPESIVGATPFTDKPVMSTELRRSHGEGGEEESNTWMEETNHFGYDVHVGSPLPLISHYPDNTLVFDPCFSFTDFFPLL

SEQ ID NO: 935 - DNA, 1274 bp, Arabidopsis thaliana
  G1334,family:CAAT
atagctcccaactaataggaatctcaagcttctcactctctcttgtttttccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtccttttgtcttgtcccttatctttcagccaaacggaaagagaacttgtgtcttggaaaaaagacattgagtttccttggtttataagattggtccttttaccatccgtttggctgtaaacaggcaaatcatctttggctcatgcttcatcaagttcttatcttcgtctgttttcttctacgcatcttcataagatctctgaactagtgaataacatttcctagcatcatgtttcaactagtgtgtgttgtaagaaactctgccttatttccagatgatgtattgtgtgtaacgtgtttatgaaacaaacgtaagactttcaagttaaaaaaaaaaaaaaaaaaaaaaaaaaa

SEQ ID NO: 936 - protein, 269 aa, Arabidopsis thaliana
  G1334,CAAT domain coordinates 133-190
MQTEELLSPPQTPWWNAFGSQPLTTESLSGEASDSFTGVKAVTTEAEQGVVDKQTSTTLFTFSPGGEKSSRDVPKPHVAFAMQSACFEFGFAQPMMYTKHPHVEQYYGVVSAYGSQRSSGRVMIPLKMETEEDGTIYVNSKQYHGIIRRRQSRAKAEKLSRCRKPYMHHSRHLHAMRRPRGSGGRFLNTKTADAAKQSKPSNSQSSEVFHPENETINSSREANESNLSDSAVTSMDYFLSSSAYSPGGMVMPIKWNAAAMDIGCCKLNI

SEQ ID NO: 937 - DNA, 965 bp, Arabidopsis thaliana
  G1335,family:Z-CLDSH
tttttttttaaaagatttagagagaaaagtgagttattaagagattccaatcaaaatgagcggagacaacggcggtggtgagaggcgcaaaggctccgtcaagtggtttgatacccagaagggtttcggcttcatcactcctgacgacggtggcgacgatctcttcgttcaccagtcctccatcagatctgagggtttccgtagcctcgctgccgaagaagccgtagagttcgaggttgagatcgacaacaacaaccgtcccaaggccatcgatgtttctggacccgacggcgctcccgtccaaggaaacagcggtggtggttcatctggcggacgcggcggtttcggtggaggaagaggaggtggacgcggatctggaggtggatacggcggtggcggtggtggatacggaggaagaggaggtggtggtcgaggaggcagcgactgctacaagtgtggtgagcccggtcacatggcgagagactgttctgaaggcggtggaggttacggaggaggcggcggtggctacggaggtggaggcggatacggcggaggaggtggtggttacggaggtggtggccgtggaggtggtggcggcgggggaagctgctacagctgtggcgagtcgggacatttcgccagggattgcaccagcggtggacgttaaaaccaacgccggttacgcggtggagaagagtgagttggttatctcacaagtgatcggttctttctcccgccgccttctatctctctattatccactttttgcttattatgatggatctctatctttgttagttggttttttcttgatggtttcggattaggactcttcttttggttttgctacttatggttggttttatttatggtacttgtgatatgggtgaaatgctctacttgttgctctgtttcaagtgttcataatatgcgaacaaatattctgggttttgtttcaaaaaaaa

SEQ ID NO: 938 - protein, 203 aa, Arabidopsis thaliana
  G1335,Z-CLDSH domain coordinates 24-43,131-144,185-203
MSGDNGGGERRKGSVKWFDTQKGFGFITPDDGGDDLFVHQSSIRSEGFRSLAAEEAVEFEVEIDNNNRPKAIDVSGPDGAPVQGNSGGGSSGGRGGFGGGRGGGRGSGGGYGGGGGGYGGRGGGGRGGSDCYKCGEPGHMARDCSEGGGGYGGGGGGYGGGGGYGGGGGGYGGGGRGGGGGGGSCYSCGESGHFARDCTSGGR

SEQ ID NO: 939 - DNA, 1630 bp, Arabidopsis thaliana
  G1337,family:Z-CO-like
aatggatttgtcatcattcttctcaccgtccttagtctctgaaaataaattctgattttgatttcgaattttagggattttgagagagagtcagttatgagtagttcggagagagtaccgtgcgatttctgcggcgagcgtacggcggttttgttttgtagagccgatacggcgaagctgtgtttgccttgtgatcagcaagttcacacggcgaatctgttgtcgaggaagcacgtgcgatctcagatctgcgataattgcggtaacgagccagtctctgttcggtgtttcaccgataatctgattttgtgtcaggagtgtgattgggatgttcacggaagttgttcagtttccgatgctcatgttcgatccgccgtggaaggtttttccggttgtccatcggcgttggagcttgctgctttatggggacttgatttggagcaagggaggaaagatgaagagaatcaagttccgatgatggcgatgatgatggataatttcgggatgcagttggattcttgggttttgggatctaatgaattgattgttcccagcgatacgacgtttaagaagcgtggatcttgtggatctagttgtgggaggtataagcaggtattgtgtaagcagcttgaggagttgcttaagagtggtgttgtcggtggtgatggcgatgatggtgatcgtgaccgtgattgtgaccgtgagggtgcttgtgatggagatggagatggagaagcaggagaggggcttatggttccggagatgtcagagagattgaaatggtcaagagatgttgaggagatcaatggtggcggaggaggaggagttaaccagcagtggaatgctactactactaatcctagtggtggccagagttctcagatatgggattttaacttgggacagtcacggggacctgaggatacgagtcgagtggaagctgcatatgtagggaaaggtgctgcttcttcattcacaatcaacaattttgttgaccatatgaatgaaacttgttccactaatgtgaaaggtgtcaaagagattaaaaaggatgactacaagcgatcaacttcaggccaggtacaaccaacaaaatctgagagcaacaatcgtccaattacctttggctctgagaaaggttcgaactcctccagtgacttgcatttcacagagcatattgctggaactagttgtaagaccacaagactagttgcaactaaggctgatctggagcggctggctcagaacagaggagatgcaatgcagcgttacaaggaaaagaggaagacacggagatatgataagaccataaggtatgaatcgaggaaggcaagagctgacactaggttgcgtgtcagaggcagatttgtgaaagctagtgaagctccttacccttaaccttaagttttttcacataggcttccttttagctacaaacttagttactttttttactccactgcctcataaatgtacagaccggtctcgtttcatctggccgcccttcttgttttattgccttatctggcccttttatgtaccttggaatcttatctagtttaaaaaagattgtaaccttctagaaaaccatattctgttgacagtatatacatgtctatccaagcaaaaa

SEQ ID NO: 940 - protein, 433 aa, Arabidopsis thaliana
  G1337,Z-CO-like domain coordinates 9-75
MSSSERVPCDFCGERTAVLFCRADTAKLCLPCDQQVHTANLLSRKHVRSQICDNCGNEPVSVRCFTDNLILCQECDWDVHGSCSVSDAHVRSAVEGFSGCPSALELAALWGLDLEQGRKDEENQVPMMAMMMDNFGMQLDSWVLGSNELIVPSDTTFKKRGSCGSSCGRYKQVLCKQLEELLKSGVVGGDGDDGDRDRDCDREGACDGDGDGEAGEGLMVPEMSERLKWSRDVEEINGGGGGGVNQQWNATTTNPSGGQSSQIWDFNLGQSRGPEDTSRVEAAYVGKGAASSFTINNFVDHMNETCSTNVKGVKEIKKDDYKRSTSGQVQPTKSESNNRPITFGSEKGSNSSSDLHFTEHIAGTSCKTTRLVATKADLERLAQNRGDAMQRYKEKRKTRRYDKTIRYESRKARADTRLRVRGRFVKASEAPYP

SEQ ID NO: 941 - DNA, 1435 bp, Arabidopsis thaliana
  G1340,family:TH
caattatttaatttagtaggaaacatagaataaaaaaacttgctttgtttttcatattttctcattattggaatcactgtcttttcgaacttggtgacaatcttagtactagaaaacaaaagactttgaccggtctttggctcatctctttcttctcccctttctccaacacttatttctttctctctctagttcatgaattcaagattcaaagacacacgtatggctacctcttggtaaatccaaagagacacatatatggctgacgctgatccatcgagtggtgaacagatagttatgagagagtgcagaaaagggaattggacagtgagtgagactttggttctcatagaagccaagaagatggacgaccagaggcgtgtacggcgatcggaaaaacaacctgaaggcagaaacaaaccagcagagctccggtggaaatggatagaggagtattgctggagaagaggatgttaccgcaaccagaatcagtgcaacgataagtgggacaatctcatgagggattacaagaagatcagagagtacgagagatcaagggtagaatcgtcttttaacaccgtcacttcttcctcttactggaagatggacaagactgagaggaaagagaagaacttgccgagtaacatgttgcctcagatatacgacgtgttgtctgagcttgttgacagaaaaactcttccttcctcctcctccgccgccgccgccgtaggaaacggtaacggtggccagatcctaagagtttgccaacaaagtttaggatttgtagctccgatgatggctcagccgatgcatcaaatcccgactactatagtgttatctcttccgccaccaccgccacagtctcttagcttatcacttccttcgccgcctcaacctccaccatcgtcttcatttcacgctgagcctataccgcccacagtaggtacatcatcgacaaagcgaatgagaacaacgccgggagaaaccaccgctggaggagagagggaggtagaggaggatgcggttggggtggcgttgtctagatgcacgtctgtgatcacacaagtgataagagagaatgaggagggacaagagaggaggcataaggaagtggtgaggctacaagagaggagactaaagattgaggaatcaaaaactgaaataaatagacaaggtatgaatggtttggtagacgccattaatcaactcgcaagctctattcttgctttggcttcttcttcttgccataataatcgcatcatcaaggaggtccaccatgatacctatattgaatagatgtgttactttaatacttaagttgatgattagttgcttagttaatatgtaggtatgtgtatataaagtgacgttatgttagcatataaaaccatgcaagatgttcttgtcatggagtaattaatgaatcattaatcaa

SEQ ID NO: 942 - protein, 345 aa, Arabidopsis thaliana
  G1340,TH domain coordinates 54-142
MADADPSSGEQIVMRECRKGNWTVSETLVLIEAKKMDDQRRVRRSEKQPEGRNKPAELRWKWIEEYCWRRGCYRNQNQCNDKWDNLMRDYKKIREYERSRVESSFNTVTSSSYWKMDKTERKEKNLPSNMLPQIYDVLSELVDRKTLPSSSSAAAAVGNGNGGQILRVCQQSLGFVAPMMAQPMHQIPTTIVLSLPPPPPQSLSLSLPSPPQPPPSSSFHAEPIPPTVGTSSTKRMRTTPGETTAGGEREVEEDAVGVALSRCTSVITQVIRENEEGQERRHKEVVRLQERRLKIEESKTEINRQGMNGLVDAINQLASSILALASSSCHNNRIIKEVHHDTYIE

SEQ ID NO: 943 - DNA, 2074 bp, Arabidopsis thaliana
  G1341,family:BZIPT2
ttcagacagagagtgagtacttgaagaaatgggttgttgtcagtcaagaatagatagcaaagagatagtgtctcgttgtaaagcaaggaagagatacttgaaacatcttgttaaagctagacaaactctctctgtttctcacgcgctttatctccgttctctacgcgccgttggctcttcccttgttcacttctcttccaaagagactcctcttcacctccaccacaaccctccgtctccttctcctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttgagtttatgctgttttcgaaatgaaattggttaaatgactttt

SEQ ID NO: 944 - protein, 640 aa, Arabidopsis thaliana
  G1341,BZIPT2 domain coordinates 1-34,288-398
MGCCQSRIDSKEIVSRCKARKRYLKHLVKARQTLSVSHALYLRSLRAVGSSLVHFSSKETPLHLHHNPPSPSPPPPPPPRPPPPPLSPGSETTTWTTTTTSSVLPPPPPPPPPPPPPSSTWDFWDPFIPPPPSSSEEEWEEETTTATRTATGTGSDAAVTTAPTTATPQASSVVSGFSKDTMTTTTTGSELAVVVSRNGKDLMEIIKEVDEYFLKAADSGAPLSSLLEISTSITDFSGHSKSGKMYSSSNYECNLNPTSFWTRGFAPSKLSEYRNAGGVIGGNCIVGSHSSTVDRLYAWEKKLYQEVKYAESIKMDHEKKVEQVRRLEMKRAEYVKTEKAKKDVEKLESQLSVSSQAIQSASNEIIKLRETELYPQLVELVKGLMCMWRSMYESHQVQTHIVQQLKYLNTIPSTEPTSELHRQSTLQLELEVQQWHHSFCNLVKAQRDYIQSLTGWLRLSLFQFSKNPLVRSSYESKIYSFCEEWHLAIDRIPDKVASEGIKSFLTAVHGIVAQQADEHKQKKRTESMLKDFEKKSASLRALESKYSPYSVPESRKKNPVIEKRVKVEMLKGKAEEEKSKHEKSVSVTRAMTLNNLQMGFPHVFQAMVGFSSVCMQAFESVYNQAKSIGEDQEEVKRLLP

SEQ ID NO: 945 - DNA, 1008 bp, Arabidopsis thaliana
  G1357,family:NAC
atggcagctgcaccaccgatcgagccggcggtgacgacgacgttccctggcttcaaattctccccgaccgacatcgaacttatatcttattacttgaagaggaagatggatggtttggagagatctgttgagattatacctgaggttgagatttacaacttcgagccttgggatttacctgataagtctatcgttaaatcggatagcgaatggttcttcttctgtgctcgcggtaagaagtatccccacggttcacagaacagaagagcaaccaagataggatattggaaagccacaggaaaagagcgtaatgtgaagtcaggttctgaggtcattggaacaaagagaacgcttgtattccacattggccgcgcgccaaaaggaggaagaacggaatggcttatgcatgagtactgcatgattggagtatcactggatgctctggttatttgccgacttaggaggaatactgaatttcaagggagtacaattcaaaagccaccacaaccaagtttaccactggataagcacgtaaacttgcggaatgaagctatttcagaaagtatttatggttgggaaactatggttgatttctacttatcaagtgagtcagggcaagaactacttagtgaaatagcagaatcttcacaatcttcacaaaatccacaggttcctagtgaagaagatttctatgccgatatactgagggatgaaatagtaaagctagatgatccggcggtatccggtaatacactgatcaatgtaccaaggcttcaaacagagtccaataccacaagagtactacctttacctgacatggtagacaaacaaatgcaatcgttgctacagaaactaccattacaaaatgacactggagaagagaacaacatatccatgtcaaattgctttatcggtatctactcgattaagtctataaaccgagcgcgatgggacgttgttgtttggttactcgttatgatagccgtgttggtgttttatttagtgtga

SEQ ID NO: 946 - protein, 335 aa, Arabidopsis thaliana
  G1357,NAC domain coordinates 17-158
MAAAPPIEPAVTTTFPGFKFSPTDIELISYYLKRKMDGLERSVEIIPEVEIYNFEPWDLPDKSIVKSDSEWFFFCARGKKYPHGSQNRRATKIGYWKATGKERNVKSGSEVIGTKRTLVFHIGRAPKGGRTEWLMHEYCMIGVSLDALVICRLRRNTEFQGSTIQKPPQPSLPLDKHVNLRNEAISESIYGWETMVDFYLSSESGQELLSEIAESSQSSQNPQVPSEEDFYADILRDEIVKLDDPAVSGNTLINVPRLQTESNTTRVLPLPDMVDKQMQSLLQKLPLQNDTGEENNISMSNCFIGIYSIKSINRARWDVVVWLLVMIAVLVFYLV

SEQ ID NO: 947 - DNA, 918 bp, Arabidopsis thaliana
  G1361,family:NAC
atgacttggtgcaatgaccgtagcgatgttcagaccgttgaaagaatcattccctccccgggggcggctgagtcccccgtagcctcacttccggtctcttgtcacaaaacttgcccttcttgtggccataacttcaagtttcacgaacaggctgggatccatgacttgccgggacttcctgctggagtaaaatttgatccgacggatcaagaggtcttggagcatcttgaaggcaaggtaagagatgacgcaaaaaagcttcatcctctcattgatgagtttatccgtaccatcgatggtgaaaacggcatttgttatacccatcctgaaaaattgccaggagtgaacaaggacgggacggtgcgtcatttcttccaccgaccgtcgaaggcatacacgacgggaacaagaaagcgacgtaaagtccacactgattctgacgtcggtggagagacacggtggcacaagacaggaaaaacacggccagttcttgctggaggaagagtgagaggctacaagaaaatcctagtgctctacacaaactacggcaaacaaaaaaaacccgagaagactaattgggtaatgcatcaatatcatcttggcactagcgaggaagagaaagaaggtgagctcgtcgtctccaaagtcttttaccagactcaaccacgtcaatgcggtggctccgttgctgctgcagccaccgctaaggaccgaccttacctccacggcctcggtggaggtggtggccgccaccttcattaccatcttcatcataacaacggtaacggtaagagcaacggcagtgggggaaccgccggagccggtgagtattatcacaatattccggctattatctcgttcaatcagaccgggatacagaaccacttggttcatgactctcaaccttttatcccttaa

SEQ ID NO: 948 - protein, 305 aa, Arabidopsis thaliana
  G1361,NAC domain coordinates 59-200
MTWCNDRSDVQTVERIIPSPGAAESPVASLPVSCHKTCPSCGHNFKFHEQAGIHDLPGLPAGVKFDPTDQEVLEHLEGKVRDDAKKLHPLIDEFIRTIDGENGICYTHPEKLPGVNKDGTVRHFFHRPSKAYTTGTRKRRKVHTDSDVGGETRWHKTGKTRPVLAGGRVRGYKKILVLYTNYGKQKKPEKTNWVMHQYHLGTSEEEKEGELVVSKVFYQTQPRQCGGSVAAAATAKDRPYLHGLGGGGGRHLHYHLHHNNGNGKSNGSGGTAGAGEYYHNIPAIISFNQTGIQNHLVHDSQPFIP

SEQ ID NO: 949 - DNA, 1011 bp, Arabidopsis thaliana
  G1363,family:CAAT
cgtctacctactatggtctggagattagttcgtttattgaactaatgttttagacaatgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggttacaaagaaaacccggaaaatcctattggaagtcattcgatatcaaaggtgtctcaagattcagtggttcttcctattgaggcggcttcttggcctttacacggcaatgtaacgccacatttcaatggtttcttgtcttttccttatgcatcacaacacacggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaaccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatgtgagagagctcccgcaagtggtggatgaggc

SEQ ID NO: 950 - protein, 308 aa, Arabidopsis thaliana
  G1363,CAAT domain coordinates 171-230
MQEFHSSKDSLPCPATSWDNSVFTNSNVQGSSSLTDNNTLSLTMEMKQTGFQMQHYDSSSTQSTGGESYSEVASLSEPTNRYGHNIVVTHLSGYKENPENPIGSHSISKVSQDSVVLPIEAASWPLHGNVTPHFNGFLSFPYASQHTVQHPQIRGLVPSRMPLPHNIPENEPIFVNAKQYQAILRRRERRAKLEAQNKLIKVRKPYLHESRHLHALKRVRGSGGRFLNTKKHQESNSSLSPPFLIPPHVFKNSPGKFRQMDISRGGVVSSVSTTSCSDITGNNNDMFQQNPQFRFSGYPSNHHVSVLM

SEQ ID NO: 951 - DNA, 823 bp, Arabidopsis thaliana
  G1364,family:CAAT
ctcttctctcgatctctctccctctctgcctcctctcttcctccaatcaacaaacacctctctgtttcactcccgccctttttcgaattcttctgatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagatggagggtgacacaaagggatcagcaaaaggtggggatccaaatgcaaagaaagatgggcaatcaagccaaaatggccagttctcgcagcttgctcaccaaggtccttatgggaactctcaagctcagcagcatatgatggttccaatgccgggaacagactagtatgagaggagtattcaactttggttatgttccaccaaaagaggttatcttatctgtatattatttgtgttgtaagagttttgctatgcagaacttgtgactataatcatctcattgttttgttttgtttttgtttccttggatttgttctgaatatgtcatcaagtcagtcagtctatttatatatttggtttgttgattatttc

SEQ ID NO: 952 - protein, 173 aa, Arabidopsis thaliana
  G1364,CAAT domain coordinates 29-118
MAESQAKSPGGCGSHESGGDQSPRSLHVREQDRFLPIANISRIMKRGLPANGKIAKDAKEIVQECVSEFISFVTSEASDKCQREKRKTINGDDLLWAMATLGFEDYMEPLKVYLMRYREMEGDTKGSAKGGDPNAKKDGQSSQNGQFSQLAHQGPYGNSQAQQHMMVPMPGTD

SEQ ID NO: 953 - DNA, 1177 bp, Arabidopsis thaliana
  G1380,family:AP2
tttcttctcttcttcacacaaacacacacagatctcttcttcatcacattacttctggctttacatcttttttcttctccatgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgcacgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctgatttgctgctttacaaaaaaaatccgttgattacacacaaaaaaaattctcaaattttacaaaatgataactttatgctcttttgtttttccattttcctttgatatcatattgaaagagaaaaaaaggaagaacaaaaaaaaaagattgagcgtgatgattttatcatcaacgaagatgatgacgattaaaaagagagagagattgtgttaagatctgttactgtaagaaccagatctgggtttcatttttatctgtttcttcttataaaagatccaacaaccctttgttacatatatataacattctgaagctggtgatgatttctgaatgattcaaatccattatcttaaaaaaaaaaaa

SEQ ID NO: 954 - protein, 244 aa, Arabidopsis thaliana
  G1380,AP2 domain coordinates 24-91
MRKGRGSSVVGPALPVTAGGSVKEPRYRGVRKRPWGRFAAEIRDPLKKSRVWLGTFDSAVDAARAYDTAARNLRGPKAKTNFPIDCSPSSPLQPLTYLHNQNLCSPPVIQNQIDPFMDHRLYGGGNFQEQQQQQIISRPASSSMSSTVKSCSGPRPMEAAAASSSVAKPLHAIKRYPRTPPVAPEDCHSDCDSSSSVIDDGDDIASSSSRRKTPFQFDLNFPPLDGVDLFAGGIDDLHCTDLRL

SEQ ID NO: 955 - DNA, 2008 bp, Arabidopsis thaliana
  G1382,family:WRKY
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatgagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatcttcttaggttaggaatgggacgaggccttgttctatataattcctatttcttcacagagagctgatcttgattcaaactatctccaccatatatatttgtttgtgtcacctgtattgagttccaaaaatgttatgtaaaaatacacaacaagatgttaatgcttttatttaaacaagaaacagcaatattactacaaaaaaaaaaaaaaaaaa

SEQ ID NO: 956 - protein, 557 aa, Arabidopsis thaliana
  G1382,WRKY domain coordinates 210-266,385-437
MNPQANDRKEFQGDCSATGDLTAKHDSAGGNGGGGARYKLMSPAKLPISRSTDITIPPGLSPTSFLESPVFISNIKPEPSPTTGSLFKPRPVHISASSSSYTGRGFHQNTFTEQKSSEFEFRPPASNMVYAELGKIRSEPPVHFQGQGHGSSHSPSSISDAAGSSSELSRPTPPCQMTPTSSDIPAGSDQEESIQTSQNDSRGSTPSILADDGYNWRKYGQKHVKGSEFPRSYYKCTHPNCEVKKLFERSHDGQITDIIYKGTHDHPKPQPGRRNSGGMAAQEERLDKYPSSTGRDEKGSGVYNLSNPNEQTGNPEVPPISASDDGGEAAASNRNKDEPDDDDPFSKRRRMEGAMEITPLVKPIREPRVVVQTLSEVDILDDGYRWRKYGQKVVRGNPNPRSYYKCTAHGCPVRKHVERASHDPKAVITTYEGKHDHDVPTSKSSSNHEIQPRFRPDETDTISLNLGVGISSDGPNHASNEHQHQNQQLVNQTHPNGVNFRFVHASPMSSYYASLNSGMNQYGQRETKNETQNGDISSLNNSSYPYPPNMGRVQSGP

SEQ ID NO: 957 - DNA, 979 bp, Arabidopsis thaliana
  G1384,family:AP2
ggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaac

SEQ ID NO: 958 - protein, 301 aa, Arabidopsis thaliana
  G1384,AP2 domain coordinates 127-194
MEALQPFYKSASTSASNPAFASSNDAFASAPNDLFSSSSYYNPHASLFPSHSTTSYPDIYSGSMTYPSSFGSDLQQPENYQSQFHYQNTITYTHQDNNTCMLNFIEPSQPGFMTQPGPSSGSVSKPAKLYRGVRQRHWGKWVAEIRLPRNRTRLWLGTFDTAEEAALAYDRAAFKLRGDSARLNFPALRYQTGSSPSDTGEYGPIQAAVDAKLEAILAEPKNQPGKTERTSRKRAKAAASSAEQPSAPQQHSGSGESDGSGSPTSDVMVQEMCQEPEMPWNENFMLGKCPSYEIDWASILS

SEQ ID NO: 959 - DNA, 844 bp, Arabidopsis thaliana
  G1387,family:AP2
tctctctcccactctcactttctctcctattcttagttcgtgtcagaaacacacagagaaattaagaaccctaatttaaaacagaagaatggtacattcgaagaagttccgaggtgtccgccagcgtcagtggggttcttgggtttctgagattcgtcatcctctcttgaagagaagagtgtggctaggaacattcgacacggcggaaacagcggctagagcctacgaccaagccgcggttctaatgaacggccagagcgcgaagactaacttccccgtcatcaaatcgaacggttcaaattccttggagattaactctgcgttaaggtctcccaaatcattatcggaactattgaacgctaagctaaggaagaactgtaaagaccagacaccgtatctgacgtgtctccgcctcgacaacgacagctcacacatcggcgtctggcagaaacgcgccgggtcaaaaacgagtccaaactgggtcaagcttgttgaactaggtgacaaagttaacgcacgtcccggtggtgatattgagactaataagatgaaggtacgaaacgaagacgttcaggaagatgatcaaatggcgatgcagatgatcgaggagttgcttaactggacctgtcctggatctggatccattgcacaggtctaaaggagaatcattgaattatatgatcaagataataatatagttgagggttaataataatcgagggtaagtaatttacgtgtagctaataattaatataattttcgaacatatatatgaatatatgatagctctagaaatgagtacgtatatatacgtaaacatttttcctcaaatatagtatatgtg

SEQ ID NO: 960 - protein, 189 aa, Arabidopsis thaliana
  G1387,AP2 domain coordinates 4-71
MVHSKKFRGVRQRQWGSWVSEIRHPLLKRRVWLGTFDTAETAARAYDQAAVLMNGQSAKTNFPVIKSNGSNSLEINSALRSPKSLSELLNAKLRKNCKDQTPYLTCLRLDNDSSHIGVWQKRAGSKTSPNWVKLVELGDKVNARPGGDIETNKMKVRNEDVQEDDQMAMQMIEELLNWTCPGSGSIAQV

SEQ ID NO: 961 - DNA, 1317 bp, Arabidopsis thaliana
  G1389,family:TEO
atgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaaactaagacaaccatggaggttcaaattcatgatgacatgcattgaacaagaaggaggaaattaatgtgatgaatggagctagagtaagcgctatattaattagtattaccatctatccatatatttatgattcaagactattattactcatttagtgtttgttattattattcaattttgcttgtttgtttcttatcatctttgcattgatcatcaagattgtgatatttg

SEQ ID NO: 962 - protein, 361 aa, Arabidopsis thaliana
  G1389,TEO domain coordinates 30-87
MGLKGYSVGEGGGEIVEVQGGHIIRATGRKDRHSKVFTSKGPRDRRVRLSAHTAIQFYDVQDRLGYDRPSKAVDWLIKKAKTAIDKLELGETTTTTTRQEPVNTKPESPTLVFQRENNDQTQFVAANLDPEDAMKTFFPATTTTNGGGGTNINFQNYPHQDDNNMVSRTTTPPPNLSQDLGLSLHPFQGNNNTVVVPETNNFTTTHFDTFGRISGWNHHDLTMTSSSSSEHQQQEQEERSNGGFMVNHHPHHHHHQPSMMTLLNSQQQQVFLGGQQQQQQRGTLQSSLFPHSFRSWDHHQTTSDHHHHQNQASSMFASSSQYGSHGMMMMQGLSFPNTTRLLHGEEATQPNSSSSPPNSHL

SEQ ID NO: 963 - DNA, 1674 bp, Arabidopsis thaliana
  G1399,family:AT-hook
aggtcgaattttctgaaattaagattcattcctccatggaagaagctctgtttttattctctttagcttagcttagcttctactgatctgtttttgctacaaaatcccatctttttctttaaaactctttatctctgaatcttgagtttcttgtagaagaagaagcaattttgaatctttcgtaatcataaagattcgtggaggatctctactgatttgtcggaatctctcactacagaatcacttgatcttatgtccggatggaggagagagaaggaaccaacatcaacaacaacatcactagcagtttcggcttgaagcagcaacatgaagctgctgcttctgatggtggttactcaatggacccaccaccaagacccgaaaaccctaacccgtttttagtcccacccactactgtccccgcggccgccaccgtagcagcagctgttactgagaatgcggctactccgtttagcttaacaatgccgacggagaacacttcagctgagcagctgaaaaagaagagaggtaggccgagaaagtataatcccgatgggactcttgtcgtgactttatcgccgatgccaatctcgtcctctgttccgttgacgtcggagtttcctccaaggaaacgaggaagaggacgtggcaagtctaatcgatggctcaagaagtctcaaatgttccaattcgatagaagtcctgttgataccaatttggcaggtgtaggaactgctgattttgttggtgccaactttacacctcatgtactgatcgtcaacgccggagaggatgtgacgatgaagataatgacattctctcaacaaggatctcgtgctatctgcatcctttcagctaatggtcccatctccaatgttacgcttcgtcaatctatgacatccggtggtactctaacttatgagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgattgttgagtatccttgttagaaacaaacttactgttgcaaaactctcttcaaaaaagtttcactttgctttccca

SEQ ID NO: 964 - protein, 404 aa, Arabidopsis thaliana
  G1399,AT-hook amino acids 86-94, DUF296 166-281
MEEREGTNINNNITSSFGLKQQHEAAASDGGYSMDPPPRPENPNPFLVPPTTVPAAATVAAAVTENAATPFSLTMPTENTSAEQLKKKRGRPRKYNPDGTLVVTLSPMPISSSVPLTSEFPPRKRGRGRGKSNRWLKKSQMFQFDRSPVDTNLAGVGTADFVGANFTPHVLIVNAGEDVTMKIMTFSQQGSRAICILSANGPISNVTLRQSMTSGGTLTYEGRFEILSLTGSFMQNDSGGTRSRAGGMSVCLAGPDGRVFGGGLAGLFLAAGPVQVMVGTFIAGQEQSQLELAKERRLRFGAQPSSISFNISAEERKARFERLNKSVAIPAPTTSYTHVNTTNAVHSYYTNSVNHVKDPFSSIPVGGGGGGEVGEEEGEEDDDELEGEDEEFGGDSQSDNEIPS

SEQ ID NO: 965 - DNA, 1034 bp, Arabidopsis thaliana
  G1411,family:AP2
taaagaaaaactgaacaaccctaaagtactgtataaatcctatatcaaattttttttttggaagaaaaggctatatttaaaagaaaatcaagcaaaagtagatcctcggatgtatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattaattaggagatttgatcagttacttgtgatgaagtaatgatacatttcccgtcaaaattgagatgatcatatgcttcctgaatgtttttgagtgtcatttttgtcttccgcgttaagatttattgaacgtgttttcttgtttttttggttaaaaaaaaaaaaaaaaaaaaaaaaaaaaaa

SEQ ID NO: 966 - protein, 248 aa, Arabidopsis thaliana
  G1411,AP2 domain coordinates 87-154
MYGKRPFGGDESEEREEDENLFPVFSARSQHDMRVMVSALTQVIGNQQSKSHDNISSIDDNYPSVYNPQDPNQQVAPTHQDQGDLRRRHYRGVRQRPWGKWAAEIRDPKKAARVWLGTFETAESAALAYDEAALKFKGSKAKLNFPERVQLGSNSTYYSSNQIPQMEPQSIPNYNQYYHDASSGDMLSFNLGGGYGSGTGYSMSHDNSTTTAATTSSSSGGSSRQQEEQDYARFWRFGDSSSSPHSGY

SEQ ID NO: 967 - DNA, 894 bp, Arabidopsis thaliana
  G1412,family:NAC
atgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatga

SEQ ID NO: 968 - protein, 297 aa, Arabidopsis thaliana
  G1412,NAC domain coordinates 13-162
MGVREKDPLAQLSLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKKTSGSQRQAVTPVQACREEHSTNGSSSSSSSQLDDVLDSFPEIKDQSFNLPRMNSLRTILNGNFDWASLAGLNPIPELAPTNGLPSYGGYDAFRAAEGEAESGHVNRQQNSSGLTQSFGYSSSGFGVSGQTFEFRQ

SEQ ID NO: 969 - DNA, 1651 bp, Arabidopsis thaliana
  G1417,family:WRKY
tctatctctatctatctctctttgtctgcaaatggaagaacatattcaagatcgccgtgaaattgcgttcttacactcaggagaatttctccacggagattctgactcaaaggatcatcaaccgaacgagtctccggtggaacgtcatcacgagtcgtctatcaaagaagttgatttcttcgctgctaaaagtcagccgtttgatcttggtcatgtgagaacaacgacgatcgttggatcatctggttttaatgatggattaggtttggtaaattcatgtcatggaacatcaagcaatgatggcgatgacaaaaccaaaactcaaattagtagactgaagttggagctagagaggcttcacgaggagaatcacaaactgaagcatttattagatgaggtcagtgagagttacaacgacctccaaagaagagttttgttagcaagacaaacacaagtggaaggtcttcatcataaacaacatgaggatgtacctcaagctggttcctcacaagctctagagaacagaagaccaaaggatatgaaccatgaaactccggccaccaccttgaaacgacggtctccagacgacgtggatggtcgtgatatgcaccgaggatcaccaaaaactcctcgaatagaccaaaacaagagtactaatcatgaagaacaacaaaaccctcatgatcaattaccctatagaaaagctagggtttccgttagagctagatctgatgccactacggtaaatgacggatgtcaatggagaaaatacggtcagaaaatggcgaaagggaatccatgtcctcgcgcttattatcgttgcaccatggccgttggatgtcctgtccgtaaacaggtccaacgatgcgcggaggatacaactatcttgacaacaacgtacgaaggaaaccataaccatcctcttcccccgtcagccacagccatggctgcaaccacctccgccgcagcagccatgctcttatcaggctcctcctccagcaacctccaccaaacactctctagcccctccgccacgtcatcatcatccttctaccataacttcccatacacctccacaatcgcaacactctctgcctcagctcctttccccaccataaccttagacctcaccaacccacctcgaccgctacaaccgccaccgcagtttctaagccagtatggtcccgccgcgtttttaccaaacgctaatcaaattaggtctatgaataataataaccagcagttattaatacctaatttgtttggcccacaagccccaccacgtgaaatggtcgattcagttagggctgcgattgcgatggatccgaacttcacggcggcacttgcggccgcgatctcaaacattatcggaggaggtaataacgacaacaataataatactgatattaatgataacaaggttgatgcaaaaagtggagggagtagtaacggagattcgccacagcttcctcagtcttgcaccactttctctacaaactaattttactaccattattatatgttatcttattatatattacacacacatattatacattatgcgtatcttaagtttttttttgggggccattatatatgaatgatatggagatcactgagagagagagagagctattatgggttttttttt

SEQ ID NO: 970 - protein, 489 aa, Arabidopsis thaliana
  G1417,WRKY domain coordinates 239-296
MEEHIQDRREIAFLHSGEFLHGDSDSKDHQPNESPVERHHESSIKEVDFFAAKSQPFDLGHVRTTTIVGSSGFNDGLGLVNSCHGTSSNDGDDKTKTQISRLKLELERLHEENHKLKHLLDEVSESYNDLQRRVLLARQTQVEGLHHKQHEDVPQAGSSQALENRRPKDMNHETPATTLKRRSPDDVDGRDMHRGSPKTPRIDQNKSTNHEEQQNPHDQLPYRKARVSVRARSDATTVNDGCQWRKYGQKMAKGNPCPRAYYRCTMAVGCPVRKQVQRCAEDTTILTTTYEGNHNHPLPPSATAMAATTSAAAAMLLSGSSSSNLHQTLSSPSATSSSSFYHNFPYTSTIATLSASAPFPTITLDLTNPPRPLQPPPQFLSQYGPAAFLPNANQIRSMNNNNQQLLIPNLFGPQAPPREMVDSVRAAIAMDPNFTAALAAAISNIIGGGNNDNNNNTDINDNKVDAKSGGSSNGDSPQLPQSCTTFSTN

SEQ ID NO: 971 - DNA, 820 bp, Arabidopsis thaliana
  G1419,family:AP2
gaagactccaacataattcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttcc

SEQ ID NO: 972 - protein, 221 aa, Arabidopsis thaliana
  G1419,AP2 domain coordinates 69-137
MASSHQQQQEQDQSALDLITQHLLTDFPSLDTFASTIHHCTTSTLSQRKPPLATIAVPTTAPVVQENDQRHYRGVRRRPWGKYAAEIRDPNKKGVRVWLGTFDTAMEAARGYDKAAFKLRGSKAILNFPLEAGKHEDLGDNKKTISLKAKRKRQVTEDESQLISRKAVKREEAQVQADACPLTPSSWKGFWDGADSKDMGIFSVPLLSPCPSLGHSQLVVT

SEQ ID NO: 973 - DNA, 1306 bp, Arabidopsis thaliana
  G1420,family:WRKY
aaagtatcatctcatagattccatcttttctctattacatggagaagaaaaaagaagaggatcatcatcatcaacaacaacaacaacaacaaaaggagatcaagaacacagagacaaagatcgagcaagaacaagaacaagaacaaaaacaagaaatctctcaagcatcatcatcatcaaacatggcgaatctagttacgtcatcagatcatcatccgttggagctagctggaaatctctcaagcatcttcgatacttcatctttaccttttccttattcttatttcgaagatcactcttctaataatcctaattctttcctagacttgctccgacaagatcatcagtttgcttcttcctctaattcctcttctttttcattcgatgcctttcctctccccaataacaacaacaacacctctttttttacggatttgcccttacctcaagctgagtcatcagaagtcgtgaacacaacaccgacttctccaaactcaacctcagtctcatcttcctccaacgaagctgcaaatgataacaacagtggtaaagaagttactgttaaagatcaagaagaaggagatcaacaacaagagcaaaagggtactaagccacagttgaaggcaaagaagaagaatcaaaagaaagctagagaagctaggtttgcgtttctgacgaagagcgatattgataatcttgacgacggttataggtggagaaaatacggccaaaaagctgtcaaaaacagtccttatcccagaagctattaccgttgcaccacagtgggttgcggagtgaagaagagagtggagagatcctccgatgatccttcgatcgtcatgacaacctacgaaggtcagcatacccatcctttccccatgacgccacgtggacacatcggaatgctcacgtcaccaatcctagaccacggtgcaaccaccgcgtcatcatcatcattctccatccctcagccacgttacttgctgactcaacatcaccagccctacaacatgtacaacaacaactctctaagtatgatcaatagaagatcatccgatggcactttcgtaaatccaggtccatcatcatcattccccggctttggttatgatatgtctcaagcttctacttcaacttcttcttccattagagatcatggattgcttcaagatattcttccttcgcagatcagatccgatactattaacactcaaaccaatgaagagaataagaaatgaagaagttttttttcccggggcaattgtttttttctttaggccggatccggtaggtaggtttcatgagc

SEQ ID NO: 974 - protein, 399 aa, Arabidopsis thaliana
  G1420,WRKY domain coordinates 221-280
MEKKKEEDHHHQQQQQQQKEIKNTETKIEQEQEQEQKQEISQASSSSNMANLVTSSDHHPLELAGNLSSIFDTSSLPFPYSYFEDHSSNNPNSFLDLLRQDHQFASSSNSSSFSFDAFPLPNNNNNTSFFTDLPLPQAESSEVVNTTPTSPNSTSVSSSSNEAANDNNSGKEVTVKDQEEGDQQQEQKGTKPQLKAKKKNQKKAREARFAFLTKSDIDNLDDGYRWRKYGQKAVKNSPYPRSYYRCTTVGCGVKKRVERSSDDPSIVMTTYEGQHTHPFPMTPRGHIGMLTSPILDHGATTASSSSFSIPQPRYLLTQHHQPYNMYNNNSLSMINRRSSDGTFVNPGPSSSFPGFGYDMSQASTSTSSSIRDHGLLQDILPSQIRSDTINTQTNEENKK

SEQ ID NO: 975 - DNA, 1260 bp, Arabidopsis thaliana
  G1421,family:AP2
gaaatttcatccctaaataagaaaaaagcatctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgtttagtgaagttttgttaccggcgacggcgaggattaaaaaaaaacggcgatttattttttgaatgaagatttgttaaata

SEQ ID NO: 976 - protein, 287 aa, Arabidopsis thaliana
  G1421,AP2 domain coordinates 84-146
METEKKVSLPRILRISVTDPYATDSSSDEEEEVDFDALSTKRRRVKKYVKEVVLDSVVSDKEKPMKKKRKKRVVTVPVVVTTATRKFRGVRQRPWGKWAAEIRDPSRRVRVWLGTFDTAEEAAIVYDNAAIQLRGPNAELNFPPPPVTENVEEASTEVKGVSDFIIGGGECLRSPVSVLESPFSGESTAVKEEFVGVSTAEIVVKKEPSFNGSDFSAPLFSDDDVFGFSTSMSESFGGDLFGDNLFADMSFGSGFGFGSGSGFSSWHVEDHFQDIGDLFGSDPVLTV

SEQ ID NO: 977 - DNA, 1005 bp, Arabidopsis thaliana
  G1423,family:MADS
atggtgaaaaaaggtggcacgaagaggaagattgcgattgagacgatacagaagagagattcccttagggttacctgcaccaaacgccgtgaaggtctctatagcaaagcctctcagctttgtcttctctcagacgcacagatcgctatcttagcgactcctccttcttctgaatccaacgtatccttctactctttcggtcactcctctgttgatgccgttgtctctgcttttctctccggacaacgtcctgttccgaaggataacaaagagacgagggaggacgttggtatctgtttgactcgcaataatctagggttaggtttttggtggaacgacgagagccttgccagatcggagaatcctcaagagattagtgaagcgatcgactctatgcggacgctgttgaggaatctcaaggaattgcgtgcggatgaagctttagcctgtaatcaagctttcgttaatgatcgcgaggacctgaagaacaacgacaagtgcgattttgtttcagaccacgaaactcatgatcaaaccctaattcttcagtccgcttctccaatttgttgcatcccagaaaatctcaacgagattactcaagagccaaatcaaaccctaaatattcagtcgagtacttctgcaatttgttgcgtccctgataattcacctgaaaatttcaatgagatcactgaagaacaagatcagattcgctcgatttgtgaaactttttgtgttatggataacaacgctgctttacctgaaatgaacctggattacgatcaagacattggcttcgacacgccttttgagagcgcgctaaatgattggttttcggacaacactactcatcaggagattagtgcaagtattttgaacgctgttgttgatgatcaagtctcggtggatctaactccgttttcttattttcagagatgtttggatggagataatctacgattctctgattgtttcaaagactttgcaaacactatttcagcactttga

SEQ ID NO: 978 - protein, 334 aa, Arabidopsis thaliana
  G1423,MADS domain coordinates 6-62
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISAL

SEQ ID NO: 979 - DNA, 1164 bp, Arabidopsis thaliana
  G1425,family:NAC
actctctcaaaccataaaaaatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgtatatatatacggtttgagtgattagggggcattgggggatttatttacggttgattattattgtagtgttatagaactaaggagattaaattaaatagattggaggaaaaaaaaaaaaaaaaa

SEQ ID NO: 980 - protein, 320 aa, Arabidopsis thaliana
  G1425,NAC domain coordinates 20-173
MESTDSSGGPPPPQPNLPPGFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCRIYKKNNSTASRHHHHLHHIHLDNDHHRHDMMIDDDRFRHVPPGLHFPAIFSDNNDPTAIYDGGGGGYGGGSYSMNHCFASGSKQEQLFPPVMMMTSLNQDSGIGSSSSPSKRFNGGGVGDCSTSMAATPLMQNQGGIYQLPGLNWYS

SEQ ID NO: 981 - DNA, 1281 bp, Arabidopsis thaliana
  G1435,family:GARP
gtgaaacatggggaaggaagttatggtgagcgattacggtgacgacgacggagaagacgccggcggcggcgatgaatataggattccggaatgggaaattggtttacccaacggagatgatttgactccgttatctcaatatctagtcccgtcgattctcgcgttagctttcagcatgatcccagaacgaagccgtacaattcacgacgtcaatcgcgcgtcgcaaatcacgctctcttcgttgagaagcagtaccaatgcttcgtctgtgatggaggaggtcgtggatcgagttgaatcgagtgttccaggatcagatccgaagaaacagaagaaatcggatggtggtgaagcagcggcggtggaggattccacggcggaggaaggagactccgggcctgaagacgcgtctgggaagacatcgaaacgaccgcgtttagtgtggacaccgcagctacacaagagatttgtggacgttgtggctcatctagggattaaaaacgcagtgccgaagacgattatgcagctgatgaacgtggaaggacttactcgtgagaacgttgcgtctcatttgcagaaatataggctttaccttaaacggattcaaggattgacgacggaagaagatccttattcgtcgtcggatcagctcttctcttcaacgccggttcctccacagagctttcaagacggcggaggaagtaacggaaagttgggggttccggttccggttccgtcgatggtgcctattccaggctatgggaatcaaatgggtatgcaaggatattatcaacagtatagtaaccatggcaatgaatcaaaccaatatatgatgcagcagaataagtttggaacaatggtgacatatccttctgttggtggtggtgacgtgaatgacaagtaaatggatcttaaaggtctataatttgctctacagagagatactggttcttggcttatggtttattttcccacttcatgaggttgttgtgacttttaattctccatgttttccacacaagtctttattgcctttgtatagaaaatgatttcgagaaaatcactgggaagcttggtattgttggaggatgaagccttctatgaatgatttagtttcctactgtctccattctttatgaggtaataaagccttcttttgctcatcgcttgtagtcttcttaaattcaagacagcgtcacatgtttgttcggttatgttaattgtttctttctttggataatgaagatagcatcaggtctcatgtctcctcactttgataaa

SEQ ID NO: 982 - protein, 298 aa, Arabidopsis thaliana
  G1435,GARP domain coordinates 146-194
MGKEVMVSDYGDDDGEDAGGGDEYRIPEWEIGLPNGDDLTPLSQYLVPSILALAFSMIPERSRTIHDVNRASQITLSSLRSSTNASSVMEEVVDRVESSVPGSDPKKQKKSDGGEAAAVEDSTAEEGDSGPEDASGKTSKRPRLVWTPQLHKRFVDVVAHLGIKNAVPKTIMQLMNVEGLTRENVASHLQKYRLYLKRIQGLTTEEDPYSSSDQLFSSTPVPPQSFQDGGGSNGKLGVPVPVPSMVPIPGYGNQMGMQGYYQQYSNHGNESNQYMMQQNKFGTMVTYPSVGGGDVNDK

SEQ ID NO: 983 - DNA, 968 bp, Arabidopsis thaliana
  G1444,family:GRF-like
cagtccttctttggtgcaaagatcccaaaaaatcaaaatcgaaagagagaataaatcaaaaggaagaatctttatctgctttctctcgatgaggatccggaaacgacaagtgcctcttcctttatcgtctctattaccagttcctctatcagatctctactttaaccgctcaccgacggccaccgcgagatactttcgcggtggttataaagacggcggtgatgattttggttctcttcagctttcgcttccgccgccgtcgcagatttctgatcggcttattcaaagagatttgataaagaagaaggaggaggtcaaggctttggatgatgataatggtgatgtagacgtcaagagtcgtactgatgcatcgggcagcaagaatgttaatccccgaggagaatccgtctcttcaatacaagttgtcgagaagaatgaaaaggttgtgtctttgaggaagagaagaggctttatcaactttgaggattacgaagatgaggaagatgaagaagctagtggcggtggaggccgtattaataaagggaaaaagaaagcgaaaaagagcggtggtgggttagaggaaggatcacggtgcagccgtgttaacggtagaggatggagatgttgtcagcaaacgcttgttggttattctctttgtgagcatcatctcggtaaaggaagggtaaggagcatgaacaagagtggtggtggtcgtggcggcgagaaaaaggcggtggtggtggaagtgaagaagaagagagtaaagcttggcatggtaaaggcacgttcaataagtagtttgcttggacaaaccagcactagtggtggtactagtggtgatgttgatcagggtgagataagtgcacctgctgatcagttcgctgcatgtgataagtaggtctgttgatcagcatttgcatgtatatggatatgtgtatgtttatgtacatgatgataatgggcatagc

SEQ ID NO: 984 - protein, 269 aa, Arabidopsis thaliana
  G1444,GRF-like domain coordinates 17-101
MRIRKRQVPLPLSSLLPVPLSDLYFNRSPTATARYFRGGYKDGGDDFGSLQLSLPPPSQISDRLIQRDLIKKKEEVKALDDDNGDVDVKSRTDASGSKNVNPRGESVSSIQVVEKNEKVVSLRKRRGFINFEDYEDEEDEEASGGGGRINKGKKKAKKSGGGLEEGSRCSRVNGRGWRCCQQTLVGYSLCEHHLGKGRVRSMNKSGGGRGGEKKAVVVEVKKKRVKLGMVKARSISSLLGQTSTSGGTSGDVDQGEISAPADQFAACDK

SEQ ID NO: 985 - DNA, 1646 bp, Arabidopsis thaliana
  G1446,family:MISC
cttccaaccagatcttcttctctatctcttcgacaaacccttttttctgggttcttcggagaggtgatttatcaccaaaaaaaagattttaaaagtctaaatccttttttctttctttccttcaacatgcctttaccttggaagaaatctaaatctagtcggatctctagattcgtatcagactttcaacaatctcctaaacatggtggatctctcgttgttgaaactggtttcccaacttctttaatcgatctctttgttaagaatcgcgatcgtctcaaaaaacaatcttcaaaacgtaacaacaagaacaacaaagcccagactgaaacgcgtgttttgtctccacctcctcctcatatgtctttgcagcgtcgtatgtctcttccttccaagcttgatccagctttggttacagaggattctcctttggtgagaaagatcgaggaaacttctgttccggagattatccatgaagacgacggtggtcatcgcggtggaggaggaggagggtgtgttttgatagtggtggtgtttaaggtttttatggtggctgtgcttgccttgagcacgaagaagctcgccgtggggatcacgctctctgcttttgcccttctcttcctcgagcttgcggtggcgcgtgtcttcacgtacttgaatctctgtcccgacgcgcagattcggatagattctttgatcgataagctcatagggaagcgacataaagagaagctagaagaagaagaagaatcaacatcgacgcatgacagaagaaacaatgtctactttgaaatcatcgaagaacctagagaggagattagagtcactcctcaatcggattcgtcgtcattggagaaggcgaaacttgtggtggatgagaagaaagaaatgcagacgataagagatgttatgtttaagactgagaaaagcaaaagcgcgaagctgaaatcaaagattgtgaagaagattgtgccaaagaagctaaggagttataagaagaagaagaagatgaagaacaaagaaaaagaagaagaagaagttgaacttgaaactgaagaagaagggtctatgacagaagtttctagcttgtattcagatgagagaatcgggagtgaaatctctgagagggatgatttgagttcgaatccgccatttttagagagttgtacagaggttgaagaagaagaagagactggaccaaaagaggatctaacgaaagtgattggtttgatagtgattgttcttgttggattgctgtgtgggaaagtctttgctattggtctgacactctcttggtgtctgattctcagagttttctgttgcaaatctcaaaccagtttctgaaacagaggaaaacatgattcagactttgggttcttttttttttgtggaagtccgtggcagtggtgggccttagggatcgccgttagttgttgacggtgacggtgttgacggtagagagacggtgacgggagtgttgttgttgggggtggttggcagttcgaagctagacaattggtttgcttatgaaactgtgtaaatttgttttgttgttaacagagatatatatcgtgttattatgatggtcaaagagtcaaagttgttgttatgaagaaccaaaaaaaactgagtaatatattcttaaa

SEQ ID NO: 986 - protein, 405 aa, Arabidopsis thaliana
  G1446,MISC domain coordinates 1-405
MPLPWKKSKSSRISRFVSDFQQSPKHGGSLVVETGFPTSLIDLFVKNRDRLKKQSSKRNNKNNKAQTETRVLSPPPPHMSLQRRMSLPSKLDPALVTEDSPLVRKIEETSVPEIIHEDDGGHRGGGGGGCVLIVVVFKVFMVAVLALSTKKLAVGITLSAFALLFLELAVARVFTYLNLCPDAQIRIDSLIDKLIGKRHKEKLEEEEESTSTHDRRNNVYFEIIEEPREEIRVTPQSDSSSLEKAKLVVDEKKEMQTIRDVMFKTEKSKSAKLKSKIVKKIVPKKLRSYKKKKKMKNKEKEEEEVELETEEEGSMTEVSSLYSDERIGSEISERDDLSSNPPFLESCTEVEEEEETGPKEDLTKVIGLIVIVLVGLLCGKVFAIGLTLSWCLILRVFCCKSQTSF

SEQ ID NO: 987 - DNA, 799 bp, Arabidopsis thaliana
  G1449,family:IAA
tagacagagagaaatagaaatagagagagagagacatgaagagcactctcaatagagaagagaaggaagcatgaagctagctctgcagcttcaaggtctcattaatggaggtctctaactcttgttcttcattttcttcatcctctgtcgacagtactaaaccttctccttctgaatcttctgttaatctctcccttagtctcacatttccttctacttctccacaaagagaagcaagacaagattggccaccgataaagtctagattaagagatacactaaagggtcgtcgtcttcttcgtcgtggtgatgacacttctctctttgttaaggtttatatggaaggtgttcccattggaagaaaactcgacctttgcgtattctcaggctacgagagtctattagaaaatctctctcacatgttcgatacttcaatcatctgcggtaatcgagatcgaaaacatcatgttttgacatatgaagacaaggatggagattggatgatggtcggagatattccatgggatatgtttcttgaaaccgtgagaagactaaagatcacgagaccggagaggtattaaaacttggatcggtcaaggctgtgattgcgcagttacgagacgtgtaagatttaggcattgatgaagagacttgaggcgggacggagctattgctgcatattgcaacaaaggccttgaagaagttggagaattgattgatgcatatatttatttatatgacacctttgagtgtgttttttcttataaataaatcacaatatccaagacttctctttaaa

SEQ ID NO: 988 - protein, 158 aa, Arabidopsis thaliana
  G1449,IAA domain coordinates 48-53,74-107,122-152
MEVSNSCSSFSSSSVDSTKPSPSESSVNLSLSLTFPSTSPQREARQDWPPIKSRLRDTLKGRRLLRRGDDTSLFVKVYMEGVPIGRKLDLCVFSGYESLLENLSHMFDTSIICGNRDRKHHVLTYEDKDGDWMMVGDIPWDMFLETVRRLKITRPERY

SEQ ID NO: 989 - DNA, 2816 bp, Arabidopsis thaliana
  G1451,family:ARF
tttgtacttccggagctaaagagttatagctactgtagtagctggaagtgaagaagattttttaatagattgtacggaaaaattagggttttcaaagtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcgggagccctttgtttcccatttgaagtcgtttccactcatctttatatgccattcgttcgcatctctctcgttttgacgtttttagaaagaaacataatcatatttgtgagtatgggtcctgaaactttaggacgtactttagcttgtattagacagacactctcgtcataaacataagaacctttatgtagctgtctcagggtaactaaacttttctag

SEQ ID NO: 990 - protein, 811 aa, Arabidopsis thaliana
  G1451,ARF domain coordinates 22-357
MKLSTSGLGQQGHEGEKCLNSELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEPLTTFPMYPSLFPLRLKRPWHAGTSSLPDGRGDLGSGLTWLRGGGGEQQGLLPLNYPSVGLFPWMQQRLDLSQMGTDNNQQYQAMLAAGLQNIGGGDPLRQQFVQLQEPHHQYLQQSASHNSDLMLQQQQQQQASRHLMHAQTQIMSENLPQQNMRQEVSNQPAGQQQQLQQPDQNAYLNAFKMQNGHLQQWQQQSEMPSPSFMKSDFTDSSNKFATTASPASGDGNLLNFSITGQSVLPEQLTTEGWSPKASNTFSEPLSLPQAYPGKSLALEPGNPQNPSLFGVDPDSGLFLPSTVPRFASSSGDAEASPMSLTDSGFQNSLYSCMQDTTHELLHGAGQINSSNQTKNFVKVYKSGSVGRSLDISRFSSYHELREELGKMFAIEGLLEDPLRSGWQLVFVDKENDILLLGDDPWESFVNNVWYIKILSPEDVHQMGDHGEGSGGLFPQNPTHL

SEQ ID NO: 991 - DNA, 1371 bp, Arabidopsis thaliana
  G1452,family:NAC
atttattaagcatcaatgagagaacttcagagctgggtttgagttctgtccaataatacataaccacgttatcatttttgtcctttactatctcattacactcttctgttattcgcccaattcttacagtcattactctctatagggctcgagcggccgcccgggcaggtttctatgcagatggttcacacttcccgctccattgcccagattgggttcggtgttaagtcgcaattagtactcactatagggctcgagcggccgcccgggcaggtaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggatgcattagtggtgtgccggttaagaaaaaatgctgattttcgggctagttcgacccaaaaaattgaggatggtgttgtgcaagacgatggctacgttggccaaagaggtggtttggacaaggaggacaaatcctactatgaatctgagcatcagataccaaatggtgacatcgcagaatcatcaaatgttgttgaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaataaatatagtattttgtctatggcaaaaaaaaaaaaaaaa

SEQ ID NO: 992 - protein, 373 aa, Arabidopsis thaliana
  G1452,NAC domain coordinates 55-196
MQMVHTSRSIAQIGFGVKSQLVLTIGLERPPGQVKDQTMSKEAEMSIAVSALFPGFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNADFRASSTQKIEDGVVQDDGYVGQRGGLDKEDKSYYESEHQIPNGDIAESSNVVEDQADTDDDCYAEILNDDIIKLDEEALKASQAFRPTNPTHQETISSESSSKRSKCGIKKESTETMNCYALFRIKNVAGTDSSWRFPNPFKIKKDDSQRLMKNVLATTVFLAILFSFFWTVLIARN

SEQ ID NO: 993 - DNA, 983 bp, Arabidopsis thaliana
  G1453,family:NAC
cgtcgacgcgaaataaatcctagaaaataactatcaatatgatgaaggttgatcaagattattcgtgtagtataccgcctggatttaggtttcatccgacagatgaagaacttgtcggatattatctcaagaagaaaatcgcctcccagaggattgatctcgacgttatcagagaaattgatctttacaagatcgaaccatgggatctacaagagagatgtaggatagggtacgaggagcaaacggagtggtatttcttcagccatagagacaagaagtatccgactgggactaggacaaaccgagccaccgtggccggtttctggaaagcaacgggccgggacaaggcggtttacctcaactccaaacttatcggtatgagaaaaacgcttgtcttttaccgaggtcgagcgcctaatggccaaaagtccgattggatcattcacgaatactacagcctcgagtcacaccagaactctcctccacaggaagaaggatgggtagtgtgtagagcatttaagaaacgaacgaccatcccaacaaaaaggaggcaactttgggatccgaactgcttattctacgacgacgccactctcttggaacctctcgacaagcgagccagacataatcctgattttaccgccacaccgttcaagcaagaactactctccgaggccagtcacgtccaggatggagatttcggatctatgtaccttcaatgcatcgatgatgatcaattctcccagcttcctcagctcgagagcccctctcttccgtcggaaataactccccatagtactactttttctgagaacagtagccggaaagatgacatgagctccgagaagaggatcactgactggagatatctagataagttcgtggcgtctcaatttttgatgagtggagaagactaaaaaaggctttcctatgcatgcatgcactagaaacgtcgtcgcattttggatttacatgcggccgct

SEQ ID NO: 994 - protein, 292 aa, Arabidopsis thaliana
  G1453,NAC domain coordinates 13-160
MMKVDQDYSCSIPPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAFKKRTTIPTKRRQLWDPNCLFYDDATLLEPLDKRARHNPDFTATPFKQELLSEASHVQDGDFGSMYLQCIDDDQFSQLPQLESPSLPSEITPHSTTFSENSSRKDDMSSEKRITDWRYLDKFVASQFLMSGED

SEQ ID NO: 995 - DNA, 1092 bp, Arabidopsis thaliana
  G1462,family:NAC
cattcttgcgattgatctttctctagataatttttttgatcgatttagtttcattatggaggacgacgacgcagcttatgatctaatcaaacacgaactgttatactcagaagacgaagtaataatctcacgttatctgaagggtatggtcgttaacggagattcttggccagatcacttcatcgaagacgcaaacgtgttcaccaagaatccagataaggtgttcaattctgagagacctagattcgtgatcgttaaaccacgaacagaggcttgtggtaaaaccgatggatgtgattcgggttgctggaggatcattggtcgtgataaactgataaagtcggaggagactgggaagattctagggttcaagaagatactcaagttttgcctaaagaggaaacctatagactacaagagaagttgggtaatggaagagtataggcttaccaataacttgaactggaagcaagatcatgtgatttgcaaaattcggtttatgtttgaagctgaaattagtttcttgctaagcaagcatttctacactacatcagaatcggttcttgaaaatgagctgttgccatcttatggatattatttatccaatacacaagaggaggatgaattttatctggacgcgataatgacttcggaaggaaacgagtggcctagctacgttaccaacaacgtgtactgtctgcatccattggagcttgtggatcttcaagatcggatgtttaatgattacggaacctgcatcttcgctaacaagacttgtggtgaaactgataaatgcgatggtggttactggaagatcctgcacggtgataagctgatcaagtcaaatttcggaaaggtcattggtttcaagaaggtatttgagttctatgaaacggtgagacaaatatatctttgtgatggagaagaagtgacggtaacttggactatacaagagtataggcttagcaaaaacgtgaagcagaataaagtgttgtgcgttatcaagttgacttatgatagataggatactttactttggtttttgtgatcatcttagtatcttacgaatattctagatacacacatctatag

SEQ ID NO: 996 - protein, 322 aa, Arabidopsis thaliana
  G1462,NAC domain coordinates 14-273
MEDDDAAYDLIKHELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKKVFEFYETVRQIYLCDGEEVTVTWTIQEYRLSKNVKQNKVLCVIKLTYDR

SEQ ID NO: 997 - DNA, 1142 bp, Arabidopsis thaliana
  G1463,family:NAC
agtttgagatttgcttcatccggtttttttattttctgcaaaatatgtcactctctcccattttgttcatatataatatgtttgaagtttgatcaacttagtatgcgtttctttttctctctagttcctctgtttcttggtcgatttagtttcgttatggcggacacactgctcaacgcagaagacgaagtaataatctcacgttatctgaagcctatgatcgttaacagagtatcatggcctgatctcttcatcgaagacgcagacgtgttcaacaaggatccatatgtgaagttccatgctgagatccctagcttcgtgatcgttaaaccacgaacaaaggcttgtggtaaaaccgatggatgtgattcgggttgctggaggatcattggtcgtgataagctgataaagtcggaggagactggtaagattctagggttcaagaagatactcaagttctgcctaaagtggaaacctagagaatacaagagaagtttggtaatggaagagtataggcttaccaataacttcaactggaagcaagatcatgtgatttgcaagattcggcttttgtttgaagcagaaattagtttcttgctagccaagcatttctacactacatcagactcacttcctcgaaatgtgctgttgccagcttatggattctgttcaccagataaacaagaggaggacgaattttatccggtgacgataatgatttcagaaggaaaagattggcctagctacgttaccaacaacgtgtattgtctgcatccatcggagcttgtgaatgttcacgatgggaagtttcatgataacggaatctgcatcttcgctaacaggacttgtggtgtaaccgataaatgcaatgaaggttactggaagattaagcaccgtgagaagctgatcatgtcacggtacgggcagaccattggttggaagaaagtttttcagttttatgaaacggagaaagaaagacattttggtaatggagaagaagtgaaggtaacttggactctaaaagagtataggcttaccagaaaaatgaacaagaataaagtggtgtgcgttatcaagtataaggtaaagtgtttaccgaggataactagctagggacttctactcttggtttcatgatcgat

SEQ ID NO: 998 - protein, 336 aa, Arabidopsis thaliana
  G1463,NAC domain coordinates 9-156
MRFFFSLVPLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRLLFEAEISFLLAKHFYTTSDSLPRNVLLPAYGFCSPDKQEEDEFYPVTIMISEGKDWPSYVTNNVYCLHPSELVNVHDGKFHDNGICIFANRTCGVTDKCNEGYWKIKHREKLIMSRYGQTIGWKKVFQFYETEKERHFGNGEEVKVTWTLKEYRLTRKMNKNKVVCVIKYKVKCLPRITS

SEQ ID NO: 999 - DNA, 1066 bp, Arabidopsis thaliana
  G1465,family:NAC
ctcattcttgcgtttgatctttctttctctagatcccatatttttcttgatcaatttagtttcattatggaggaagatgcagcttttgatctactcaaagccgaactcttaaacgcagaagacgatgcaataatctcacgttatctgaagcgtatggtcgtcaacggagactcatggcctgatcacttcatcgaagacgcagacgtgttcaacaagaatccaaatgtggagttcgatgctgagagccctagcttcgtgatagttaaacctcgaacagaggcttgtggtaaaaccgatggatgtgaaactggttgctggaggatcatgggtcgtgataaaccgataaaatcgacggagactgtgaagattcaagggttcaagaagattctcaagttctgcctaaagaggaaacctagaggatacaagagaagttgggtaatggaagagtataggcttaccaataacttgaactggaagcaagatcatgtgatttgcaagattcggtttatgtttgaagctgaaatcagtttcttgctagccaagcatttctacactacatcagaatcacttcctcgaaatgagctgttgccagcttacggattcctttcatcagataagcaattggaggatgtatcttatccggtgacgataatgacttctgaaggaaacgattggcctagctacgttaccaacaatgtgtattgtctgcatccattggagctcgttgatcttcaagatcggatgtttaatgattacggaacctgcatcttcgctaacaagacttgtggtaaaaccgatagatgcattaatggtggttactggaaaattttgcaccgtgataggctgatcaagtcaaagtccgggatagttattggtttcaagaaggtgtttaagtttcatgaaacggagaaagaaagatacttctgtggtggagaagatgtgaaggtaacttggactctagaagagtataggcttagcgtgaagcagaataaattcttgtgcgttatcaagtttacttatgataactaagaatcttttctttggattttatgatcatcttagtatc

SEQ ID NO: 1000 - protein, 320 aa, Arabidopsis thaliana
  G1465,NAC domain coordinates 242-306
MEEDAAFDLLKAELLNAEDDAIISRYLKRMVVNGDSWPDHFIEDADVFNKNPNVEFDAESPSFVIVKPRTEACGKTDGCETGCWRIMGRDKPIKSTETVKIQGFKKILKFCLKRKPRGYKRSWVMEEYRLTNNLNWKQDHVICKIRFMFEAEISFLLAKHFYTTSESLPRNELLPAYGFLSSDKQLEDVSYPVTIMTSEGNDWPSYVTNNVYCLHPLELVDLQDRMFNDYGTCIFANKTCGKTDRCINGGYWKILHRDRLIKSKSGIVIGFKKVFKFHETEKERYFCGGEDVKVTWTLEEYRLSVKQNKFLCVIKFTYDN

SEQ ID NO: 1001 - DNA, 1342 bp, Arabidopsis thaliana
  G1466,family:PMR
caacaagcttcaaaaatgggggaagaagaagagaaccctaattcgatcgacattcttcccgagctacttgaagaagttctccttagattgcccacgaaatcgatcctcaaatgcagaatcgtctcaaaacaatggaggtcactcctggaatcgagtaggttcgcggagaggcatatgagtcttcaaaacagccgccggagaatcttagctgcttacaactgcgactgcggcggacggaggaagctcctacccgagtcacggtttgaaggggacgaagagattgtctatctgcactgcgacgcctcacgaccctcgatgacttgccaaggtgtgatctgcttccccgagcaagattggatcatcgttttgaacccatcgactagccaacttcggcgattcccttccggcttgaaccataactgcagatttagaattggattatggaagactttctctccgggaaactgggtaatggggtttggtagagacaaagtgaatgggaggtataaagtggtgaggatgtcttttgctttctggagagttaggcaagaggagcctgtggtggaatgtggtgttcttgatgttgatactggtgaatggcggaagctgagtccacctccttatgtggtcaatgtgggaagcaaatcggtatgcgtgaatggatctatctactggttacacattcagacggtttacagaatactagccttggatcttcacaaacaagagtttcataaagtcccagtgccgcctacgcagatcactgtggacactcagatggtgaaccttgaggaccgtctcgtacttgctataaccagagttagccctgaatggatactagaggtatggggcatggatacatacaaagaaaaatggagcaagacttactccataagtttggatcatagagttgtttcctggcgaaggcagaaaaggtggttcacgcccgtggcagtttctaagcaagcgaatcttgtcttctatgacaataagaagaggctattcaaatattatccagtgaaagatgagattcgttgtctctccttagacatttgtgttctgtctccttacgtggaaaacttggtccctcttccgttaaagccaagccatccgcatcctactccgaaaaattcagattttgaaatgaggatatcaagatgccgcttgttttcgacgccaggttcttggatatccaaaattttgaaatggaatgttatgactctagagattttgtttacctctctagcaatagttggttatatatgcttacctctctaggagttatttatcttgtttcaaaatattagttggttatatatgctttcgagatctttctgataaa

SEQ ID NO: 1002 - protein, 420 aa, Arabidopsis thaliana
  G1466,PMR domain coordinates 154-420
MGEEEENPNSIDILPELLEEVLLRLPTKSILKCRIVSKQWRSLLESSRFAERHMSLQNSRRRILAAYNCDCGGRRKLLPESRFEGDEEIVYLHCDASRPSMTCQGVICFPEQDWIIVLNPSTSQLRRFPSGLNHNCRFRIGLWKTFSPGNWVMGFGRDKVNGRYKVVRMSFAFWRVRQEEPVVECGVLDVDTGEWRKLSPPPYVVNVGSKSVCVNGSIYWLHIQTVYRILALDLHKQEFHKVPVPPTQITVDTQMVNLEDRLVLAITRVSPEWILEVWGMDTYKEKWSKTYSISLDHRVVSWRRQKRWFTPVAVSKQANLVFYDNKKRLFKYYPVKDEIRCLSLDICVLSPYVENLVPLPLKPSHPHPTPKNSDFEMRISRCRLFSTPGSWISKILKWNVMTLEILFTSLAIVGYICLPL

SEQ ID NO: 1003 - DNA, 804 bp, Arabidopsis thaliana
  G1468,family:Z-C2H2
atgcatggagccatgaactcaccatgcattgatttcgtaatgttcagtcgtggacaacacgatgaggacaacatgtcacgtcgtcctccgtggaagagggagagatcgatgtccactcagcatcatcatcttaacttgtctccaaacgaagacgaagagcttgccaactgtcttgtcttgttgtccaattcaggggatgcgcatggtggtgatcagcataaacaacatggacatggtaagggcaaaaccgtcaaaaagcaaaaaaccgcccaggttttccaatgcaaagcttgcaagaaggtgttcacgtcgcatcaggcattgggtggacacagggcaagccacaagaaagtgaagggttgttttgcctctcaagataaagaagaggaagaggaagaggaatacaaagaagacgacgacgacaacgacgaggacgaagatgaggaggaggatgaggaagacaaatcaacggctcatatcgcaagaaagagatccaacgctcacgaatgcaccatctgccatcgcgtcttctcttcgggacaggccttaggaggccacaagcgatgccattggctaacaccttccaattatcttcgtatgacgtcgctccacgatcatcatcattccgtcggcagaccgcagccgttagatcaaccatctctcgatctcaacttagcttgccaagaatattccgtcgatccaacggccatgagcgtagggatgatcgagagagatggtggtggcaataatcacaacgctacttcatcttcgtggttaaaactcgcaagtggtgattggtcttga

SEQ ID NO: 1004 - protein, 267 aa, Arabidopsis thaliana
  G1468,Z-C2H2 domain coordinates 95-115,170-190
MHGAMNSPCIDFVMFSRGQHDEDNMSRRPPWKRERSMSTQHHHLNLSPNEDEELANCLVLLSNSGDAHGGDQHKQHGHGKGKTVKKQKTAQVFQCKACKKVFTSHQALGGHRASHKKVKGCFASQDKEEEEEEEYKEDDDDNDEDEDEEEDEEDKSTAHIARKRSNAHECTICHRVFSSGQALGGHKRCHWLTPSNYLRMTSLHDHHHSVGRPQPLDQPSLDLNLACQEYSVDPTAMSVGMIERDGGGNNHNATSSSWLKLASGDWS

SEQ ID NO: 1005 - DNA, 735 bp, Arabidopsis thaliana
  G1471,family:Z-C2H2
atggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataa

SEQ ID NO: 1006 - protein, 244 aa, Arabidopsis thaliana
  G1471,Z-C2H2 domain coordinates 49-70
MENQSMSSSSSSTHKHDQKLKSSVVAMEVLEEKETVNNPPQYYNKIYICYLCKRAFPTPHALGGHGTTHKEDRELERQQIESRLSNKDKSNLLFGGSSQDVLSNDNHLGLSLGPLKSIEGSSSSNNVNPLLNVGVPRGTTDMNMNNYSSHALSTDDINLDLTLGPSKSIGDSNNIINNNTNSSFDGNLIIPVRPRVSRYHFVAGNPLDSISRNIPPSITFPHLNINLSHDSFSLQENGSGSSHS

SEQ ID NO: 1007 - DNA, 813 bp, Arabidopsis thaliana
  G1472,family:Z-C2H2
atgaacaaccaatctatgtcttcttcaagctcctcctccccacacaaacatgatcaaaaactcaaaagtgcccttgtggccgtggaggagaaggagacaataaacaatccgaaacaaaggtctcctcaagagattgtgtctgaaaggacaaaccttgagatgcctagtttcagattaagttttttccgaaagaaaagagataccgtgctaatacatcctcccaaggataacaagatcagccacacctgtcgtttctgcaagaggaatttcaaaagctgttttgccctaggcggtcacatgaagtgccacaaaaaggaacgagaattggagaagcagcgaaagataatcgaggatgcgatgctttgtgatagtactcctttcaccttgcaaaggcttcctgttggcccttgtaagtatggccaaggtggtagctcacatgctttatcaactgatggtattaatcttgatctaactcttggtccatccaagtccacaggaggcagcaacaatagcactaataacaacactaactcatcgttccatgggaatctaatgactcccgtgggtccttgtgtgcctagatacagtttggttgctggaaaccaggttgattcaagcaatatacatgttcctgcttatccaaccaccgatctttgttatgatttttttgctttacaagagcatggttcgggctctagtcactcaaaaagtctcatctcaaaggggaaaaacaaagtcatggtgcctgaagatgatgaggatatcgggatgataaggtggttgcccaagaaaaaaagatcaagaggagagtag

SEQ ID NO: 1008 - protein, 270 aa, Arabidopsis thaliana
  G1472,Z-C2H2 domain coordinates 83-106
MNNQSMSSSSSSSPHKHDQKLKSALVAVEEKETINNPKQRSPQEIVSERTNLEMPSFRLSFFRKKRDTVLIHPPKDNKISHTCRFCKRNFKSCFALGGHMKCHKKERELEKQRKIIEDAMLCDSTPFTLQRLPVGPCKYGQGGSSHALSTDGINLDLTLGPSKSTGGSNNSTNNNTNSSFHGNLMTPVGPCVPRYSLVAGNQVDSSNIHVPAYPTTDLCYDFFALQEHGSGSSHSKSLISKGKNKVMVPEDDEDIGMIRWLPKKKRSRGE

SEQ ID NO: 1009 - DNA, 944 bp, Arabidopsis thaliana
  G1474,family:Z-C2H2
caatattgtcatatacaatggagaaacctggtggcttctggatccccaagaaaagcaacaaagagtcatcttgggaagagctggcctttgcagaagacgatgccgccggatctttgtggccgccaagatcttatacgtgtagcttctgccggagagaatttaaatcggctcaagccctcggtggccatatgaacgttcaccgaagagacagagcacggcttaagcaagccgacgaccaatacttattccccaaatcttcttcgtctccagagtatccatctcataaagatagcgataatattcatgaaacctcttgctatactttggtttttaacaccaaacctaattattttaagactcaacactcttgtgttattgatctttcttcgtcttcttctttaccatatttgactccttctagggtttcttctggtttgcctggaaagcaacatacttcttcttctcctccttctttcgttgtagaaccttccaagaactctaaatatattccctcttcttccccatggtcgtgcccaagtactgttgtggagcaaaagagttgtgatctatatgaaattccggctatggaaggagaaaagaagagaaagactgagagtgatgtgccaaaaatcgggcataaagcaaaacttagtcttggaaacaccactgatctctcggtgagtatgaatctggtcatccaccaaagttttccgattactgctcacggtagcgatgaagagattggtagggtggatatccgtaaaagaagacgaagacatgagagtccgtcgcagcagtcgattttcatttcaagtttatcttgtaagagtgacataattacaagaaacgaggaaagcaaacacaaaggtgatcgctttgaggatttagatcttgagcttaggctagggactgatccaccaaaaggaatttgattgatggaccga

SEQ ID NO: 1010 - protein, 304 aa, Arabidopsis thaliana
  G1474,Z-C2H2 domain coordinates 41-68
MEKPGGFWIPKKSNKESSWEELAFAEDDAAGSLWPPRSYTCSFCRREFKSAQALGGHMNVHRRDRARLKQADDQYLFPKSSSSPEYPSHKDSDNIHETSCYTLVFNTKPNYFKTQHSCVIDLSSSSSLPYLTPSRVSSGLPGKQHTSSSPPSFVVEPSKNSKYIPSSSPWSCPSTVVEQKSCDLYEIPAMEGEKKRKTESDVPKIGHKAKLSLGNTTDLSVSMNLVIHQSFPITAHGSDEEIGRVDIRKRRRRHESPSQQSIFISSLSCKSDIITRNEESKHKGDRFEDLDLELRLGTDPPKGI

SEQ ID NO: 1011 - DNA, 414 bp, Arabidopsis thaliana
  G1476,family:Z-C2H2
atggagtgtgagagatcatcgtcgtccacgtcatcagaaaccggagcagtcaggcaccgtcgtacgtcgtcgtcgtcagtctccaccgtgacgagacgaatgtacgagtgcactttctgcaaaagaggtttcacaaacgcacaagctttaggtggtcatatgaacatccatcgacgtgaccgtctcaacaaggccaaggtgcaaaacgatgctgacgtggcactctcgcaaactcatagatgtttccacgtggcgtctgaccttggaggctacgagcaagtagactccgtcgtgttgaggacgacgacctcgaactacatccaacacttacgaatcggctcgatggctacaaggagagaaaacgtcgtcgttgaaggaaatgaaatcgatttggagctgcgtcttggcttatga

SEQ ID NO: 1012 - protein, 137 aa, Arabidopsis thaliana
  G1476,Z-C2H2 domain coordinates 37-57
MECERSSSSTSSETGAVRHRRTSSSSVSTVTRRMYECTFCKRGFTNAQALGGHMNIHRRDRLNKAKVQNDADVALSQTHRCFHVASDLGGYEQVDSVVLRTTTSNYIQHLRIGSMATRRENVVVEGNEIDLELRLGL

SEQ ID NO: 1013 - DNA, 354 bp, Arabidopsis thaliana
  G1478,family:Z-CO-like
atgtgtagagggtttgagaaagaagaagagagaagaagcgacaatggaggatgccaaagactatgcacggagagtcacaaagctccggtaagctgtgagctttgcggcgagaacgccaccgtgtattgtgaggcagacgcagctttcctttgtaggaaatgcgatcgatgggtccattctgctaattttctagctcggagacatctccggcgcgtgatctgcacgacctgtcggaagctaactcgtcgatgtcttgtcggtgataattttaatgttgttttaccggagataaggatgatagcaaggattgaagaacatagtagtgatcacaaaattccctttgtgtttctctga

SEQ ID NO: 1014 - protein, 117 aa, Arabidopsis thaliana
  G1478,Z-CO-like domain coordinates 32-76
MCRGFEKEEERRSDNGGCQRLCTESHKAPVSCELCGENATVYCEADAAFLCRKCDRWVHSANFLARRHLRRVICTTCRKLTRRCLVGDNFNVVLPEIRMIARIEEHSSDHKIPFVFL

SEQ ID NO: 1015 - DNA, 1221 bp, Arabidopsis thaliana
  G1480,family:Z-CO-like
atggaccccacatggatagactcattgacacgctcatgtgaagccaatagtaacaccaaccacaaaagaaagagagagagagagacactgaaacatagagagaagaaaaagaagaggtttagagagagaaaaatggcgtcaaagctctgcgattcgtgcaaatcagcgacggcggcgttatactgccgaccagacgcagcgtttctatgcttaagctgcgattcaaaagtccacgcggcgaacaaactcgcgtcacgacacgcgcgcgtgtggatgtgtgaagtgtgcgagcaagcaccggcacacgtcacgtgcaaagcagacgcggccgcgttatgcgtcacgtgcgaccgtgatatccactcggctaatccgttagctcgccgtcacgaacgcgttcccgttactccgttttacgattccgtctctagtgacggttccgttaaacacaccgccgttaatttccttgacgactgttacttctccgatatagatggtaacggaagccgtgaagaagaggaggaagaagctgcttcgtggctgttacttcccaatccaaagactacaacgacggcgacggcggggatcgttgctgttacttcagctgaggaagttccgggagatagtccggagatgaacactggtcaacagtatttgttctcggatccggatccgtatctggatctggattatggaaatgttgatccgaaggtggaatcgttagagcagaatagctccggtactgatggtgttgttccggtggagaatcggacggttaggattccgacggtgaacgagaattgctttgaaatggattttaccggaggatctaaaggctttacttatggtggtggttacaattgcatcagtcacagcgtgtcatcatcgtcgatggaagtgggagtggtgccagatggtggttcggtggctgatgtatcgtatccttacggtggtcctgcaaccagtggagctgatccggggacacagcgggctgttccgctgacttcagctgagagagaagcgagggtaatgaggtacagagagaagaggaagaacaggaagtttgagaagactataaggtatgcttcaaggaaagcgtatgcggaaatgagaccgagaatcaagggacggtttgcgaagcggacggatacaaatgagagcaatgatgtggttggtcatggtggtatctttagtgggttcggacttgtacctacattttag

SEQ ID NO: 1016 - protein, 406 aa, Arabidopsis thaliana
  G1480,Z-CO-like domain coordinates 50-73,92-116
MDPTWIDSLTRSCEANSNTNHKRKRERETLKHREKKKKRFRERKMASKLCDSCKSATAALYCRPDAAFLCLSCDSKVHAANKLASRHARVWMCEVCEQAPAHVTCKADAAALCVTCDRDIHSANPLARRHERVPVTPFYDSVSSDGSVKHTAVNFLDDCYFSDIDGNGSREEEEEEAASWLLLPNPKTTTTATAGIVAVTSAEEVPGDSPEMNTGQQYLFSDPDPYLDLDYGNVDPKVESLEQNSSGTDGVVPVENRTVRIPTVNENCFEMDFTGGSKGFTYGGGYNCISHSVSSSSMEVGVVPDGGSVADVSYPYGGPATSGADPGTQRAVPLTSAEREARVMRYREKRKNRKFEKTIRYASRKAYAEMRPRIKGRFAKRTDTNESNDVVGHGGIFSGFGLVPTF

SEQ ID NO: 1017 - DNA, 1186 bp, Arabidopsis thaliana
  G1481,family:Z-CO-like
atagattttttagcagaaggcagaaaaagacgaaactagcctccaaagaattgttgaatcacagaaaactcgccacgaaaaatatcccaaatcctgcaacttgcactttcctattcttcttcttctttccttatctctccaaggaaccaaagcatagacacaaaacgaacaaccacagaaacttgaaagagagaaagagtttgattttgattaaaatggggaagaagtgtgatttatgtaacggtgttgcaagaatgtattgcgagtcagatcaagctagtttatgttgggattgcgacggtaaagttcacggcgctaatttcttgttagctaaacacacgcgttgtcttctctgtagcgcttgtcagtctcttacgccgtggaaagctactgggcttcgtcttggcccaactttctccgtctgcgagtcatgcgtcgctcttaaaaacgccggcggtggccgtggaaacagagttttatcggagaatcgtggtcaggaggaggttaatagtttcgagtccgaagaagatcggattagagaagatcacggtgacggtgacgacgcggagtcttacgatgatgatgaggaagaagatgaggatgaagagtacagcgacgatgaggatgaggatgatgatgaggatggtgatgatgaggaagcggagaatcaagttgtgccgtggtctgcggcggcgcaagttcctccggtgatgagttcttcatcttctgacggaggaagcggaggttcagtgacgaagaggacgagggctagagagaattcagatcttctctgctccgatgatgagatcggaagctcttcagctcaagggtcaaactattctcggccgttgaagcgatcggcgtttaaatcaacggttgttgtttaactcacactctaccgtatcgtcagaatgaacggcgccgatacatcgtcttctccgatctttgcgatctccaaaacaagaagagatctcagccgttgattcctttttttttcttgtttaagtaaatcaccaccgttcagttttctgacaatactttgttttagagatgaggtagtttctttctttctttgaatgtcgtacaaaatcaaatcttaactttttatttttcttatcaatatcattattatgttgattttttttttgtttgttaatctacgtaagtaaattaatttcgattcgtt

SEQ ID NO: 1018 - protein, 223 aa, Arabidopsis thaliana
  G1481,Z-CO-like domain coordinates 5-27,47-73
MGKKCDLCNGVARMYCESDQASLCWDCDGKVHGANFLLAKHTRCLLCSACQSLTPWKATGLRLGPTFSVCESCVALKNAGGGRGNRVLSENRGQEEVNSFESEEDRIREDHGDGDDAESYDDDEEEDEDEEYSDDEDEDDDEDGDDEEAENQVVPWSAAAQVPPVMSSSSSDGGSGGSVTKRTRARENSDLLCSDDEIGSSSAQGSNYSRPLKRSAFKSTVVV

SEQ ID NO: 1019 - DNA, 1131 bp, Arabidopsis thaliana
  G1482,family:Z-CO-like
cgtcgacaccaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatcttccctaaatgggggagttttttttttgtttgtttgtttctccttcatttctcccaactttgatctcagaattaggcgcggccgct

SEQ ID NO: 1020 - protein, 331 aa, Arabidopsis thaliana
  G1482,Z-CO-like domain coordinates 5-63
MKIRCDVCDKEEASVFCTADEASLCGGCDHQVHHANKLASKHLRFSLLYPSSSNTSSPLCDICQDKKALLFCQQDRAILCKDCDSSIHAANEHTKKHDRFLLTGVKLSATSSVYKPTSKSSSSSSSNQDFSVPGSSISNPPPLKKPLSAPPQSNKIQPFSKINGGDASVNQWGSTSTISEYLMDTLPGWHVEDFLDSSLPTYGFSKSGDDDGVLPYMEPEDDNNTKRNNNNNNNNNNNTVSLPSKNLGIWVPQIPQTLPSSYPNQYFSQDNNIQFGMYNKETSPEVVSFAPIQNMKQQGQNNKRWYDDGGFTVPQITPPPLSSNKKFRSFW

SEQ ID NO: 1021 - DNA, 525 bp, Arabidopsis thaliana
  G1483,family:Z-CO-like
gttgaaggatgaagatacaatgtgaagtgtgtgaaaaggctgaagcagaagtactttgttgttcagatgaagctgtactatgcaagccatgtgacattaaggttcatgaagctaataaacttttccaaagacatcaccgagtcgccttacaaaaagatgcagcctcagccaccacagcttctggagctcctctatgtgatatctgccaggagagaaaagggtacttcttctgcttagaggatagagcaatgctgtgcaatgattgtgatgaagccattcacacttgcaattctcaccaaagattcttactttctggagtacaagtttctgatcagtctttgactgaaaactccgaatgcagcactagttttagctctgaaacttaccagattcagtcaaaagtgtctctgaatagtcagtactctagtgaggaaactgaagctggaaactcaggtgagatagtacacaagaatccttctgtaatcttaagtccttagagatatacacacaacatcatggttccgg

SEQ ID NO: 1022 - protein, 162 aa, Arabidopsis thaliana
  G1483,Z-CO-like domain coordinates 17-66
MKIQCEVCEKAEAEVLCCSDEAVLCKPCDIKVHEANKLFQRHHRVALQKDAASATTASGAPLCDICQERKGYFFCLEDRAMLCNDCDEAIHTCNSHQRFLLSGVQVSDQSLTENSECSTSFSSETYQIQSKVSLNSQYSSEETEAGNSGEIVHKNPSVILSP

SEQ ID NO: 1023 - DNA, 996 bp, Arabidopsis thaliana
  G1488,family:GATA/Zn
atggaagatgaagcacatgaattcttccacacatctgattttgccgttgatgaccttttagttgatttctctaacgatgatgacgaagaaaacgatgttgttgctgattccaccactaccaccaccataaccgacagctctaacttctccgctgctgatcttcccagtttccacggtgatgttcaagacggcactagcttctccggtgacctttgtataccttctgatgatttggctgatgagttagagtggctttcgaacattgtggatgaatcattgtcgcctgaagatgtacacaagctcgagctaatatccggttttaagagtcgaccggacccgaaatccgataccggaagcccggaaaacccgaatagcagcagtccgatttttactaccgacgtttctgtaccggccaaagctagaagcaaacgctcacgcgccgctgcgtgtaattgggcctcacgtgggcttctcaaggaaacgttttacgacagtcctttcaccggagaaaccattctctctagccaacaacacttgtctccgccaacctcgccgcctttgttgatggctccgctagggaaaaagcaagccgttgatggaggacaccgacggaagaaggatgtttcttcaccggagtctggtggcgcagaggagagacggtgtctccactgcgccacggataagactccgcaatggcggacaggcccaatgggcccgaagacgttgtgcaacgcttgcggtgttaggtacaaatcgggacgtttagtgccggagtatcggcccgcggcgagtccgacgtttgtgctggcgaaacactcaaattctcatcggaaagttatggagctccggcgacagaaggagatgagtagggcccatcatgagttcatacatcaccatcacggtacggacactgccatgattttcgacgtttcatcggacggtgatgattacttgatccaccacaacgttggcccagatttcagacagcttatttga

SEQ ID NO: 1024 - protein, 331 aa, Arabidopsis thaliana
  G1488,GATA/Zn domain coordinates 221-246
MEDEAHEFFHTSDFAVDDLLVDFSNDDDEENDVVADSTTTTTITDSSNFSAADLPSFHGDVQDGTSFSGDLCIPSDDLADELEWLSNIVDESLSPEDVHKLELISGFKSRPDPKSDTGSPENPNSSSPIFTTDVSVPAKARSKRSRAAACNWASRGLLKETFYDSPFTGETILSSQQHLSPPTSPPLLMAPLGKKQAVDGGHRRKKDVSSPESGGAEERRCLHCATDKTPQWRTGPMGPKTLCNACGVRYKSGRLVPEYRPAASPTFVLAKHSNSHRKVMELRRQKEMSRAHHEFIHHHHGTDTAMIFDVSSDGDDYLIHHNVGPDFRQLI

SEQ ID NO: 1025 - DNA, 2090 bp, Arabidopsis thaliana
  G1493,family:GARP
cttgggttcgagctacatagagagaggtatgatgaatccgagtcacggaagaggactcggatcggctggtgggtccagctccggtagaaatcaaggaggtggtggtgagaccgtcgtcgagatgtttccttctggtcttcgagttcttgtcgttgacgatgacccaacttgtctcatgatcttagagaggatgcttaggacttgtctttacgaagtaacgaaatgcaacagagcagagatggcattgtctctgctccggaagaacaaacatggattcgatatagtaatcagtgatgttcatatgcctgacatggacggtttcaagcttcttgagcatgttggtctagagatggacttacctgttatcatgatgtctgcggatgattcaaagagtgtggttctaaagggagtaacgcacggtgcggttgattaccttatcaagcctgtacgtatggaggcacttaagaacatatggcagcatgtagttaggaagaggagaagtgaatggagtgtaccggaacattctgggagcattgaggagactggcgagagacagcagcagcaacatagaggaggtggtggtggtgcagctgtttctggtggagaggatgcggtggatgataactcatcctcggttaacgaaggtaacaattggaggagcagttcacggaagaggaaagacgaggaaggagaagagcaaggagatgataaggacgaagatgcgtcgaatttgaagaaaccgcgtgtcgtctggtctgttgaattgcatcagcagtttgttgctgctgttaatcagctcggcgttgagaaggcggttcctaaaaagatcttagagctgatgaatgttcctggtctaacccgagaaaacgtagcaagtcacctccagaaataccggatatatctaagacggcttggaggggtatcgcagcaccaaggcaatcttaacaactcgtttatgacgggtcaggatgcgagcttcggacctctttcgacattgaatgggtttgatcttcaagcactagccgtcacaggtcagttacctgcacagagtcttgcacagcttcaagccgctggtttaggccggcctgcgatggtctctaagtcaggtttgccggtttcctccattgtggatgagagaagcatcttcagctttgacaacacgaaaacaagatttggagaagggcttgggcatcacgggcaacaaccccaacagcaaccacagatgaacttacttcacggtgtccccacgggtttacaacagcagcttcctatgggtaatcgaatgagtattcaacaacagattgctgctgttcgagctggaaatagtgttcaaaacaacggaatgctgatgcctctagcgggtcagcagtctttgcctcggggaccaccgcctatgctaacctcttcgcaatcatccatcaggcagccgatgttatcaaaccgcatttccgagagaagtggtttctctggaaggaacaatatccccgagagcagcagagtgttaccgacaagttacactaatctcacaacacaacactcatcaagctcgatgccttataacaacttccaaccagaacttcccgtgaacagtttcccgctggcaagtgcaccagggatatcagtaccggttcggaaagccacttcttaccaggaagaggttaacagctccgaagcgggtttcactacgccgagctacgacatgttcaccaccagacagaatgattgggatctgaggaatattggaatagcctttgactcacatcaggactcagaatccgctgcgttttccgcttcagaagcctactcttcttcgtccatgtcaagacacaacacgacagttgcagccaccgagcatggccgaaaccaccagcagccaccatcgggaatggtacagcaccatcaggtttatgcagacggaaacggtggttcagtgagggtgaaatcagagagagtggctacggatacagcaacaatggcgtttcacgagcagtatagtaatcaagaagatcttatgagcgcacttcttaagcaggtttgatttgatttttttttttttttgtcaaacttatatagaagcataatctgatccg

SEQ ID NO: 1026 - protein, 669 aa, Arabidopsis thaliana
  G1493,GARP domain coordinates 242-289
MMNPSHGRGLGSAGGSSSGRNQGGGGETVVEMFPSGLRVLVVDDDPTCLMILERMLRTCLYEVTKCNRAEMALSLLRKNKHGFDIVISDVHMPDMDGFKLLEHVGLEMDLPVIMMSADDSKSVVLKGVTHGAVDYLIKPVRMEALKNIWQHVVRKRRSEWSVPEHSGSIEETGERQQQQHRGGGGGAAVSGGEDAVDDNSSSVNEGNNWRSSSRKRKDEEGEEQGDDKDEDASNLKKPRVVWSVELHQQFVAAVNQLGVEKAVPKKILELMNVPGLTRENVASHLQKYRIYLRRLGGVSQHQGNLNNSFMTGQDASFGPLSTLNGFDLQALAVTGQLPAQSLAQLQAAGLGRPAMVSKSGLPVSSIVDERSIFSFDNTKTRFGEGLGHHGQQPQQQPQMNLLHGVPTGLQQQLPMGNRMSIQQQIAAVRAGNSVQNNGMLMPLAGQQSLPRGPPPMLTSSQSSIRQPMLSNRISERSGFSGRNNIPESSRVLPTSYTNLTTQHSSSSMPYNNFQPELPVNSFPLASAPGISVPVRKATSYQEEVNSSEAGFTTPSYDMFTTRQNDWDLRNIGIAFDSHQDSESAAFSASEAYSSSSMSRHNTTVAATEHGRNHQQPPSGMVQHHQVYADGNGGSVRVKSERVATDTATMAFHEQYSNQEDLMSALLKQV

SEQ ID NO: 1027 - DNA, 1424 bp, Arabidopsis thaliana
  G1494,family:HLH/MYC
tcgacagagttgtgttgggcgtggaacttggactagttccacatatcaggttatatagatcttctctttcaacttctgattcgtccagaagctttcctaatctgagatctgacatggaacaccaaggttggagttttgaggagaattatagtttgtccactaatagaagatctatcaggccacaagatgaactagtggagttattatggcgagatggacaagtggttctgcagagccaaactcatagagaacaaacccaaacccagaaacaagatcatcatgaagaagccctaagatccagcacctttcttgaagatcaagaaactgtctcttggatccaataccctccagatgaagacccattcgaacccgacgacttctcctcccacttcttctcaaccatggatcccctccagagaccaacctcagagacggttaagcctaagtccagtcctgaacctcctcaagtcatggttaagcctaaggcctgtcctgaccctcctcctcaagtcatgcctcctccaaaatttaggttaacaaattcatcatcggggattagggaaacagaaatggaacagtactcggtaacgaccgttggacctagccattgcggaagcaacccatcacagaacgatctcgatgtctcaatgagtcatgatcgaagcaaaaacatagaagaaaagcttaatccgaacgcaagttcctcatcaggtggctcctctggttgcagctttggcaaagatatcaaagaaatggctagtggaagatgcatcacaaccgaccgtaagagaaaacgtataaatcacactgacgaatctgtatctctatcagatgcaatcggtaacaagtcgaaccaacgatcaggatcaaaccgaaggagtcgagcagctgaagttcataatctctccgaaaggaggaggagagataggatcaatgagagaatgaaggctttgcaagaactaatacctcactgcagtaaaactgataaagcttcgattttagacgaagccatagattatttgaaatcacttcagttacagcttcaagtgatgtggatggggagtggaatggcggcggcggcggcttcggctccgatgatgttccccggagttcaacctcagcagttcatacgtcagatacagagcccggtacagttacctcgatttccggttatggatcagtctgcaattcagaacaatcccggtttagtttgccaaaacccggtacaaaaccagatcatctccgaccggtttgctagatacatcggtgggttcccacacatgcaggccgcgactcagatgcagccgatggagatgttgagatttagttcaccggcgggacagcaaagtcaacaaccgtcgtctgtgccgacgaagaccaccgacggttctcgtttggaccactaggttggtgagccactttgc

SEQ ID NO: 1028 - protein, 430 aa, Arabidopsis thaliana
  G1494,HLH/MYC domain coordinates 254-311
MEHQGWSFEENYSLSTNRRSIRPQDELVELLWRDGQVVLQSQTHREQTQTQKQDHHEEALRSSTFLEDQETVSWIQYPPDEDPFEPDDFSSHFFSTMDPLQRPTSETVKPKSSPEPPQVMVKPKACPDPPPQVMPPPKFRLTNSSSGIRETEMEQYSVTTVGPSHCGSNPSQNDLDVSMSHDRSKNIEEKLNPNASSSSGGSSGCSFGKDIKEMASGRCITTDRKRKRINHTDESVSLSDAIGNKSNQRSGSNRRSRAAEVHNLSERRRRDRINERMKALQELIPHCSKTDKASILDEAIDYLKSLQLQLQVMWMGSGMAAAAASAPMMFPGVQPQQFIRQIQSPVQLPRFPVMDQSAIQNNPGLVCQNPVQNQIISDRFARYIGGFPHMQAATQMQPMEMLRFSSPAGQQSQQPSSVPTKTTDGSRLDH

SEQ ID NO: 1029 - DNA, 1306 bp, Arabidopsis thaliana
  G1496,family:HLH/MYC
aaacccaccaaataactcagagcttttttgcattttttcccattctctattttgttttgtacttttggtctcactttaaaagatcataagttgaaagatttctgcagagaacaatatgttggaaggtcttgtctctcaagaaagcttgtccttaaactctatggacatgtctgtacttgaaaggcttaaatgggtacaacagcaacaacagcaactgcaacaagttgtgtcccatagcagtaataattcacctgaacttcttcagatacttcagttccatggaagcaacaatgatgagttgttggagagtagtttcagccaatttcaaatgcttggatctggttttggaccaaactataacatgggttttggtcctccacatgaatccatttcaagaacaagtagctgccatatggaacctgtggatacaatggaggttttgttgaagaccggtgaagaaaccagagccgttgccttgaagaacaagagaaaaccagaggttaagacaagggaagagcaaaagacagagaagaagatcaaagtagaggctgagacagagtcaagcatgaaaggaaaatcaaacatgggaaacactgaagcatcttcagacacttcaaaggagacatcgaaaggagcttcagagaatcagaaattagattatatccacgtgagagctcgtcgaggccaagccactgacagacacagcttagcagaaagggcgagaagagaaaagatcagcaagaaaatgaaatatctgcaagatattgtgcctggatgcaataaggtcacaggaaaagctggtatgcttgatgagatcatcaattatgttcaatgtctccaaagacaagtcgagttcctgtcgatgaaacttgctgtcttgaacccggaactagagcttgccgtggaagatgtatccgtaaaacaggcttactttacaaatgtagttgcttcaaagcaatcaataatggttgatgtgccattgtttccgttagaccagcaaggatctctagatttgtctgcgataaacccgaaccaaacgacatctatcgaagctccatctggaagctgggaaactcaatcacagagtctctacaacacatctagcctcggttttcattactaagcaagattcattgaaacaacatggttgacatcaatcaatcatcaaaatcagaagcaaattctattacatttgctcatcaaagtagtaatttcgaaatttggttaatgcattatcctttgatccttgttttctgatatttaaaccagaagaactggagatagcaatccaatgatcttgtcacca

SEQ ID NO: 1030 - protein, 335 aa, Arabidopsis thaliana
  G1496,HLH/MYC domain coordinates 188-246
MLEGLVSQESLSLNSMDMSVLERLKWVQQQQQQLQQVVSHSSNNSPELLQILQFHGSNNDELLESSFSQFQMLGSGFGPNYNMGFGPPHESISRTSSCHMEPVDTMEVLLKTGEETRAVALKNKRKPEVKTREEQKTEKKIKVEAETESSMKGKSNMGNTEASSDTSKETSKGASENQKLDYIHVRARRGQATDRHSLAERARREKISKKMKYLQDIVPGCNKVTGKAGMLDEIINYVQCLQRQVEFLSMKLAVLNPELELAVEDVSVKQAYFTNVVASKQSIMVDVPLFPLDQQGSLDLSAINPNQTTSIEAPSGSWETQSQSLYNTSSLGFHY

SEQ ID NO: 1031 - DNA, 902 bp, Arabidopsis thaliana
  G1499,family:HLH/MYC
tcgactccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatgga

SEQ ID NO: 1032 - protein, 224 aa, Arabidopsis thaliana
  G1499,HLH/MYC domain coordinates 122-179
MNNYNMNPSLFQNYTWNNIINSSNNNNKNDDHHHQHNNDPIGMAMDQYTQLHIFNPFSSSHFPPLSSSLTTTTLLSGDQEDDEDEEEPLEELGAMKEMMYKIAAMQSVDIDPATVKKPKRRNVRISDDPQSVAARHRRERISERIRILQRLVPGGTKMDTASMLDEAIRYVKFLKRQIRLLNNNTGYTPPPPQDQASQAVTTSWVSPPPPPSFGRGGRGVGELI

SEQ ID NO: 1033 - DNA, 876 bp, Arabidopsis thaliana
  G1504,family:GATA/Zn
atgaataacgatttgtggttacctgaagaggacttcaagggtctaccggataatttccttgataatctcgttgatcctaccaatgatgtttctgtagaagatatagagaccggcgatgatgagggagattgggatgccaaatttcaaaagctcgtacctccaccattggatgagctaatgagtttgtcctatgagttcacttgcaatggacagcgtgtgcaagttcagaagcatgtgccaattttgaagcagtcgagttcttcagaagtcttctctactgttgataactcccctcctaatgtcaaagtctcaaagttgttgcaatctttaagcccagtctcagtcctcaagaacaccaacggttctggctcaccccaaaacccaaacggagatcagaaactggcctttctcgtgaaaggcatcagaagcaagcgcaaacgccccacactactgagagttacattcctcaaatcatttctattagagatgtcacagcagtttgctccggatgaatctgaatcttctgagatttccgccttgaagaaacgcaagaagaacaagagtcgtcgcttgaaatgcactcattgcgagacaaccactaccccgcagtggagggaaggacctaatgggcgtaaaaccctttgcaatgcttgtggaatccgctttagatcgggccgtcttgttttagaataccgtccagcagcaagcccgaccttcatcccaaccgtgcattcaaatttgcacaagaagatcatatatatgagaatgaaagataacgaccagtttgataccagaaagatccgtgctgagacatccggaccagagactagatcaaggcttcgtaacttcggcagaccaatgagttatggtcaatga

SEQ ID NO: 1034 - protein, 291 aa, Arabidopsis thaliana
  G1504,GATA/Zn domain coordinates 193-206
MNNDLWLPEEDFKGLPDNFLDNLVDPTNDVSVEDIETGDDEGDWDAKFQKLVPPPLDELMSLSYEFTCNGQRVQVQKHVPILKQSSSSEVFSTVDNSPPNVKVSKLLQSLSPVSVLKNTNGSGSPQNPNGDQKLAFLVKGIRSKRKRPTLLRVTFLKSFLLEMSQQFAPDESESSEISALKKRKKNKSRRLKCTHCETTTTPQWREGPNGRKTLCNACGIRFRSGRLVLEYRPAASPTFIPTVHSNLHKKIIYMRMKDNDQFDTRKIRAETSGPETRSRLRNFGRPMSYGQ

SEQ ID NO: 1035 - DNA, 1413 bp, Arabidopsis thaliana
  G1506,family:GATA/Zn
atggggaagcaaggtccttgctatcactgtggagttacaagtacacctctatggagaaacgggccaccagagaagccggtgttgtgcaatgcgtgtggttcgaggtggagaactaaaggatcattagtaaactacacacctcttcatgctcgtgctgaaggtgatgagactgagattgaggatcatagaactcaaacggtgatgattaagggaatgtctttgaacaaaaagattcccaagaggaaaccatatcaagaaaacttcacagtgaaaagagctaacttggaattccataccggtttcaagaggaaggctctggatgaagaagctagcaatagatcgagttcaggatcggttgtatcaaactccgagagctgtgcacaatctaatgcgtgggactcgacttttccttgtaagagaaggacatgtgtgggacgtccaaaggcagcttcttctgttgaaaagctcacaaaggatctttatactattctacaagaacagcaatcttcttgtctctctggtacttcagaggaagatttgctttttgagaatgaaacaccaatgctgttaggacatggtagtgttcttatgagagatcctcactcaggtgctcgagaagaggaatctgaagctagctcactcttagttgagagcagcaagtcttcatcagttcattctgttaaatttggtggaaaagcaatgaagcaggagcaagtgaagaggagcaaatctcaagtcttaggaagacatagttcactactctgtagcatagatttgaaggatgttttcaactttgatgagttcatagaaaatttcacagaggaagaacagcaaaaactgatgaaattacttcctcaagttgactctgttgatcgtcctgatagcctcagaagcatgtttgagagttctcaattcaaagagaacttatccttgtttcagcaacttgtggcagatggtgtttttgagacaaattcgtcttatgcaaaacttgaagacattaagacacttgcaaagcttgctttatcagatcctaacaaatcccatttgttggaaagctattacatgctcaagagaagagagattgaagactgtgttactacaacatcaagggtctcaagcttgagtccatcgaataataatagtcttgtaaccattgaaagaccttgtgaaagcttaaaccaaaacttctcagagacaagaggtgtgatgagaagcccgaaagaagtgatgaagattagatcaaagcacaccgaagagaatttagagaatagtgtatcttcctttaaacctgtgagctgtggtggacctctggtgtttagctatgaagataatgatatttctgatcaggatcttcttcttgatgtgccgtcgaacggctcattccctcaagcagagcttctaaacatgatatga

SEQ ID NO: 1036 - protein, 470 aa, Arabidopsis thaliana
  G1506,GATA/Zn domain coordinates 7-33
MGKQGPCYHCGVTSTPLWRNGPPEKPVLCNACGSRWRTKGSLVNYTPLHARAEGDETEIEDHRTQTVMIKGMSLNKKIPKRKPYQENFTVKRANLEFHTGFKRKALDEEASNRSSSGSVVSNSESCAQSNAWDSTFPCKRRTCVGRPKAASSVEKLTKDLYTILQEQQSSCLSGTSEEDLLFENETPMLLGHGSVLMRDPHSGAREEESEASSLLVESSKSSSVHSVKFGGKAMKQEQVKRSKSQVLGRHSSLLCSIDLKDVFNFDEFIENFTEEEQQKLMKLLPQVDSVDRPDSLRSMFESSQFKENLSLFQQLVADGVFETNSSYAKLEDIKTLAKLALSDPNKSHLLESYYMLKRREIEDCVTTTSRVSSLSPSNNNSLVTIERPCESLNQNFSETRGVMRSPKEVMKIRSKHTEENLENSVSSFKPVSCGGPLVFSYEDNDISDQDLLLDVPSNGSFPQAELLNMI

SEQ ID NO: 1037 - DNA, 1197 bp, Arabidopsis thaliana
  G1510,family:GATA/Zn
atggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggccaagatgtttgtggctaacggtggatcatcagcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcattgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttga

SEQ ID NO: 1038 - protein, 398 aa, Arabidopsis thaliana
  G1510,GATA/Zn domain coordinates 230-263
MDSNFHYSIDLNEDQNHHEQPFFYPLGSSSSLHHHHHHHHHQVPSNSSSSSSSISSLSSYLPFLINSQEDQHVAYNNTYHADHLHLSQPLKAKMFVANGGSSACDHMVPKKETRLKLTIRKKDHEDQPHPLHQNPTKPDSDSDKWLMSPKMRLIKKTITNNKQLIDQTNNNNHKESDHYPLNHKTNFDEDHHEDLNFKNVLTRKTTAATTENRYNTINENGYSNNNGVIRVCSDCNTTKTPLWRSGPRGPKSLCNACGIRQRKARRAAMAAAAAAGDQEVAVAPRVQQLPLKKKLQNKKKRSNGGEKYNHSPPMVAKAKKCKIKEEEEKEMEAETVAGDSEISKSTTSSNSSISSNKFCFDDLTIMLSKSSAYQQVFPQDEKEAAVLLMALSYGMVHG

SEQ ID NO: 1039 - DNA, 732 bp, Arabidopsis thaliana
  G1512,family:RING/C3HC4
atggaagggaacttcttcatcaggtctgatgctcaacgagcacatgacaatggcttcatagccaaacaaaaacctaatctcaccacggctccaacagcaggtcaagctaatgaaagtggctgttttgactgcaacatctgtttagacacagcccatgatccggtggtcactctctgcgggcaccttttctgctggccttgcatttacaagtggttacatgttcagttatcttctgtctccgttgatcagcaccagaacaattgccctgtttgtaaatccaacattactatcacctctttggttcctctctatggaagaggcatgtcttcgccttcttccacgtttggctccaagaaacaagacgcactgtccactgacataccccgcagacctgctccatcagccttacgcaatccgattacctcagcatcatctctgaacccaagcttgcaacatcaaactctgtctccttcatttcataatcatcagtattcccctcgtggcttcaccacaaccgaatcaaccgaccttgccaatgctgtaatgatgagtttcctctaccctgtgattggaatgtttggagacctggtctacaccaggatattcgggaccttcacaaacacaatagctcagccttaccaaagccagaggatgatgcagcgtgagaagtctcttaatcgggtatcgatattcttcctttgttgcatcatcctttgcctccttctcttctag

SEQ ID NO: 1040 - protein, 243 aa, Arabidopsis thaliana
  G1512,RING/C3HC4 domain coordinates 39-93
MEGNFFIRSDAQRAHDNGFIAKQKPNLTTAPTAGQANESGCFDCNICLDTAHDPVVTLCGHLFCWPCIYKWLHVQLSSVSVDQHQNNCPVCKSNITITSLVPLYGRGMSSPSSTFGSKKQDALSTDIPRRPAPSALRNPITSASSLNPSLQHQTLSPSFHNHQYSPRGFTTTESTDLANAVMMSFLYPVIGMFGDLVYTRIFGTFTNTIAQPYQSQRMMQREKSLNRVSIFFLCCIILCLLLF

SEQ ID NO: 1041 - DNA, 1137 bp, Arabidopsis thaliana
  G1517,family:RING/C3HC4
atggaaccattcgttgttaaggagaacatcgtcgcatccgcttcttcgccgatgaagaagcgacggatcgatcacactgagtcagctgatggttctgcgattaacgcttctaactctagtagcatcggtggtaacgatacggtgatgaacatggcggagtttggtaacgacaactccaacaatcaggagtctcaacaagtttgcactttcttcaagaagccaacgaaaagtaaaaacataaggaaaagaaccattgacgctgatgaagaagacggagattcgaaaagcgaaagctctattttacaaaatctaaagaaagttgcaaaacccgatagcaacttgtacttttcttctggaccatctactagaacgagtggagctcctgagagacccgtttttcactacgattcatccaaggaaatccaggttcagaacgacagtggagcaacagcgacccttgaaactgaaaccgacttcaatcaagacgctcgagctatccgtgaaagagttcttaaaaaagcagaccatgcattgaaggggaataagaaaaaggcttcagatgagaagctgtacaaaggaattcatggatatacagatcacaaagctgggtttagaagagaacaaacaatctcgagcgagaaagctggaggctcacacgggcctttaagagcttctgctcacatcagagtatcggctagattcgattaccagccagacatttgcaaggattacaaggaaaccggatactgtggatatggagattcgtgtaagttcttgcatgaccgtggggattacaagccgggatggcagatagagaaagagtgggaagaggcagagaaagttaggaagagaaataaagctatgggagttgaggatgacgatgatgaggctgacaaggatagcgacgaagacgaaaatgcattgccctttgcttgcttcatttgcagggagccttttcttgatccagttgtcaccaaatgcaagcattacttctgtgagcattgtgctttaaagcatcacacgaagaacaagaaatgctttgtgtgtaaccaaccaacaatggggattttcaatgcagcacatgagatcaagaagagaatggctgaagaacggagtaaagctgaacaaggattgtga

SEQ ID NO: 1042 - protein, 378 aa, Arabidopsis thaliana
  G1517,RING/C3HC4 domain coordinates 312-349
MEPFVVKENIVASASSPMKKRRIDHTESADGSAINASNSSSIGGNDTVMNMAEFGNDNSNNQESQQVCTFFKKPTKSKNIRKRTIDADEEDGDSKSESSILQNLKKVAKPDSNLYFSSGPSTRTSGAPERPVFHYDSSKEIQVQNDSGATATLETETDFNQDARAIRERVLKKADHALKGNKKKASDEKLYKGIHGYTDHKAGFRREQTISSEKAGGSHGPLRASAHIRVSARFDYQPDICKDYKETGYCGYGDSCKFLHDRGDYKPGWQIEKEWEEAEKVRKRNKAMGVEDDDDEADKDSDEDENALPFACFICREPFLDPVVTKCKHYFCEHCALKHHTKNKKCFVCNQPTMGIFNAAHEIKKRMAEERSKAEQGL

SEQ ID NO: 1043 - DNA, 1146 bp, Arabidopsis thaliana
  G1519,family:RING/C3HC4
atgaggcttaatggggattcgggtccgggtcaggatgaacccggttcgagcgggtttcacggcggaatcagacgattcccgttagcagctcagccggagattatgagagctgctgagaaagacgatcaatacgcttctttcatccacgaagcttgccgcgatgccttccgacaccttttcggtacaagaatcgctcttgcttaccagaaggagatgaagctacttggacagatgctttactatgttcttacgacaggttcagggcaacaaactttaggagaggaatattgtgacattatacaggttgcagggccttatggactctctcctacaccagctagacgtgctttgttcatattgtaccagaccgcagttccatatatcgcagagagaattagcactcgagctgctacgcaagcagtcacctttgatgagtctgatgagttttttggtgatagtcatatccactcaccaagaatgatagatcttccatcttcatctcaagttgaaacttcaacttctgtagtatctaggttaaacgatagacttatgagatcgtggcaccgagctattcagcgatggcctgtggttcttcctgttgcccgcgaagtcttacaactggttttgcgtgccaatctgatgctcttctactttgaaggtttttattatcatatatcgaaacgtgcatccggggttcgttatgttttcataggaaagcaactgaatcagagacctagataccaaattcttggggttttccttctaatccaattgtgcatccttgctgctgagggcttgcgtcggagtaatttgtcatctatcactagctccattcagcaggcttctataggatcttatcaaacttcaggagggagaggtttacctgttttaaatgaagaggggaatttgataacttcggaagctgaaaagggaaactggtctacctccgattcaacttcaacggaggcagtagggaaatgcactctctgcttaagcacccgtcagcacccaacggccactccttgtggtcatgtgttttgttggagctgcattatggaatggtgcaacgagaagcaagaatgccctctttgtcgaacgcccaatacccattcaagtttggtttgtttgtatcattctgatttttag

SEQ ID NO: 1044 - protein, 381 aa, Arabidopsis thaliana
  G1519,RING/C3HC4 domain coordinates 327-364
MRLNGDSGPGQDEPGSSGFHGGIRRFPLAAQPEIMRAAEKDDQYASFIHEACRDAFRHLFGTRIALAYQKEMKLLGQMLYYVLTTGSGQQTLGEEYCDIIQVAGPYGLSPTPARRALFILYQTAVPYIAERISTRAATQAVTFDESDEFFGDSHIHSPRMIDLPSSSQVETSTSVVSRLNDRLMRSWHRAIQRWPVVLPVAREVLQLVLRANLMLFYFEGFYYHISKRASGVRYVFIGKQLNQRPRYQILGVFLLIQLCILAAEGLRRSNLSSITSSIQQASIGSYQTSGGRGLPVLNEEGNLITSEAEKGNWSTSDSTSTEAVGKCTLCLSTRQHPTATPCGHVFCWSCIMEWCNEKQECPLCRTPNTHSSLVCLYHSDF

SEQ ID NO: 1045 - DNA, 891 bp, Arabidopsis thaliana
  G1521,family:RING/C3HC4
atgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggataattcaaaggtcgagggatgttttggaaaactctagctcaagatcaaggccattgccatggcggagatcatttggacgaccaggttcagttcctgattctgttatcttccagcgaaagcttcagtggcgagctagcatatacactaagcaattacgagctgttcgattacattcaaggcgcttggaactaagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaagatgttttgcggagagtatactcacgatggagacttatgatgcagtggttgaatacaatgaggtggagtaa

SEQ ID NO: 1046 - protein, 296 aa, Arabidopsis thaliana
  G1521,RING/C3HC4 domain coordinates 39-80
MPPLPSSTAPSSSRHLRSPESIAKFAGRAIFPALQGKSCPICLENLTERRSAAVITVCKHGYCLACIRKWSSFKRNCPLCNTRFDSWFIVSDFASRKYHKEQLPILRDRETLTYHRNNPSDRRRIIQRSRDVLENSSSRSRPLPWRRSFGRPGSVPDSVIFQRKLQWRASIYTKQLRAVRLHSRRLELSLAVNDYTKAKITERIEPWIRRELQAVLGDPDPSVIVHFASALFIKRLERENNRQTGQTGMLVEDEVSSLRKFLSDKVDIFWHELRCFAESILTMETYDAVVEYNEVE

SEQ ID NO: 1047 - DNA, 3090 bp, Arabidopsis thaliana
  G1526,family:SWI/SNF
atgggaacgaaagtctcagacgatcttgtttccaccgtcagatcagtcgtgggttccgattactcagatatggatataatcagggctttacacatggcgaatcatgatccaacggctgctatcaatataatcttcgacactccaagtttcgccaaacctgatgtagccactcctaccccgagcggctctaatggagggaagcgagttgatagtggattaaagggctgtacttttggtgacagcggaagtgttggagcgaatcatcgcgtggaggaagaaaatgagagtgttaatggtggaggagaagagagtgtttcagggaatgagtggtggtttgttggttgttctgaattggctgggttatcgacatgtaaaggaaggaaattgaagtctggtgatgaattggtgttcacgtttccgcatagtaaaggattaaagcctgagactacgcctgggaagcgcggttttgggcggggaaggccagctttgcgtggtgcttctgatatcgttaggttctctacaaaggattcaggagagattggtagaataccaaacgagtgggctcggtgtcttctaccacttgtgagagacaagaaaattaggatagaaggcagttgcaagtcggcgcctgaagctttgagcatcatggatacaattcttctgtctgtaagcgtgtacattaatagttccatgtttcaaaagcatagtgcgacttcatttaagacagctagtaatacggcagaggaatcaatgttccatcctctcccaaatctctttcggttactcggtttgatcccctttaagaaggcagagtttactccagaggatttttactctaagaagcgacctttgagttccaaggatggttctgctattcctacttcgttgcttcaattaaacaaggtcaagaatatgaatcaagatgcaaacggagatgaaaatgagcagtgtatcagcgatggtgatcttgataacattgttggtgttggggacagttctggattaaaggaaatggaaactccacatacacttctgtgtgagcttcgtccataccaaaagcaggcacttcattggatgacccaactggagaaaggaaattgcactgatgaggcagcaacaatgcttcacccgtgttgggaagcatactgtttagcagacaagagggaactggttgtctacctgaattcttttactggtgatgctacaatacacttccctagcacacttcaaatggcaagaggaggaatattagcagacgcaatgggtcttggaaagactgtaatgaccatatcccttttgcttgcccattcttggaaagctgcatcaactgggtttctatgccccaactatgaaggagacaaagtgatcagcagttctgtagatgatctcactagtcccccggtgaaggcaaccaaatttctaggctttgataagaggcttcttgaacaaaaaagtgtacttcaaaatggtggtaacctgattgtatgtccgatgacacttttaggacagtggaagacagagattgaaatgcatgcaaagcctgggtctctatctgtctatgttcactatgggcaaagcaggccgaaggatgcaaaacttctttcccagagtgatgtggtaatcaccacatatggagttctaacatccgaattctcgcaagagaactcagcagaccatgaaggaatttatgcagttcgatggtttaggattgttcttgacgaggcacataccatcaaaaactcaaaaagccaaatttccttggctgctgcagctctggttgctgataggcgttggtgtcttacgggtactcctattcagaacaatctggaggatttatacagccttctacggtttttgaggattgaaccatggggaacttgggcatggtggaataaacttgtccaaaagccatttgaagagggtgatgagagagggttaaagctagtgcagtctatcttaaaacctatcatgcttaggagaacaaagtctagcacagaccgagaaggaaggccgattcttgttctaccccctgctgatgcacgggtcatttactgtgaactttcggagtctgagagggatttctacgacgcgctatttaaaagatccaaggtcaaatttgatcaatttgttgaacaaggcaaagttcttcataactatgcttcgatcctggaactgcttttgcgtcttcgacaatgttgtgatcacccatttttagtaatgagtcgaggggatacagcggaatactctgatctgaataagctttctaaacgtttccttagtggaaagtcttctggcttagaaagggaaggaaaagatgtaccgtcagaggcttttgttcaggaggtggtagaggaactgcgcaaaggagagcaaggagagtgtccaatatgccttgaagcacttgaggatgctgtattaacgccatgtgctcatagattatgtcgtgagtgtctcttggcaagttggagaaattctacttctgggttatgtcctgtgtgtaggaacactgtaagcaaacaagaactcatcacagcaccaaccgaaagtagattccaggttgacgtggaaaagaattgggtggaatcatcgaaaatcactgctcttctggaagagcttgaaggtcttcgttcttcaggctctaagagcattctctttagccagtggaccgctttcctcgatctcctccaaattcccctctctcggaataacttttcatttgtccgtcttgatggcacgctaagtcagcagcaacgagagaaggtccttaaagaattttccgaagatggcagtatcctggtactgttgatgtctctaaaagctggtggcgttgggataaatctaacagctgcgtccaatgcttttgtcatggatccatggtggaacccagcggtagaggaacaagctgttatgcgtattcatcgtatagggcaaactaaggaagtcaaaatcagaagattcatcgttaagggaacggttgaagagagaatggaggcggttcaggcgaggaagcagagaatgatctctggggctttaaccgatcaagaagtacgaagtgcacgtatagaggaactcaagatgttatttacctga

SEQ ID NO: 1048 - protein, 1029 aa, Arabidopsis thaliana
  G1526,SWI/SNF domain coordinates 344-641,794-833,893-976
MGTKVSDDLVSTVRSVVGSDYSDMDIIRALHMANHDPTAAINIIFDTPSFAKPDVATPTPSGSNGGKRVDSGLKGCTFGDSGSVGANHRVEEENESVNGGGEESVSGNEWWFVGCSELAGLSTCKGRKLKSGDELVFTFPHSKGLKPETTPGKRGFGRGRPALRGASDIVRFSTKDSGEIGRIPNEWARCLLPLVRDKKIRIEGSCKSAPEALSIMDTILLSVSVYINSSMFQKHSATSFKTASNTAEESMFHPLPNLFRLLGLIPFKKAEFTPEDFYSKKRPLSSKDGSAIPTSLLQLNKVKNMNQDANGDENEQCISDGDLDNIVGVGDSSGLKEMETPHTLLCELRPYQKQALHWMTQLEKGNCTDEAATMLHPCWEAYCLADKRELVVYLNSFTGDATIHFPSTLQMARGGILADAMGLGKTVMTISLLLAHSWKAASTGFLCPNYEGDKVISSSVDDLTSPPVKATKFLGFDKRLLEQKSVLQNGGNLIVCPMTLLGQWKTEIEMHAKPGSLSVYVHYGQSRPKDAKLLSQSDVVITTYGVLTSEFSQENSADHEGIYAVRWFRIVLDEAHTIKNSKSQISLAAAALVADRRWCLTGTPIQNNLEDLYSLLRFLRIEPWGTWAWWNKLVQKPFEEGDERGLKLVQSILKPIMLRRTKSSTDREGRPILVLPPADARVIYCELSESERDFYDALFKRSKVKFDQFVEQGKVLHNYASILELLLRLRQCCDHPFLVMSRGDTAEYSDLNKLSKRFLSGKSSGLEREGKDVPSEAFVQEVVEELRKGEQGECPICLEALEDAVLTPCAHRLCRECLLASWRNSTSGLCPVCRNTVSKQELITAPTESRFQVDVEKNWVESSKITALLEELEGLRSSGSKSILFSQWTAFLDLLQIPLSRNNFSFVRLDGTLSQQQREKVLKEFSEDGSILVLLMSLKAGGVGINLTAASNAFVMDPWWNPAVEEQAVMRIHRIGQTKEVKIRRFIVKGTVEERMEAVQARKQRMISGALTDQEVRSARIEELKMLFT

SEQ ID NO: 1049 - DNA, 666 bp, Arabidopsis thaliana
  G1531,family:RING/C3HC4
atgtgtgagtcaagcaacaaagtcagagtatcgccatacccgcttcggtcttcgaggaccgacaaacacaaggcgtcagagtcgcctattgagacaggttgggaggatgtgcgtggatgtcatccttacatgtgcgatacgagtgttcgtcactccaattgtttcaagcagttccgcagaaaaaccataaaaaagcgcctataccccaagaccttacattgtcctctctgtagaggtgaagtatccgagacgacaaaggtgacgagcactgcaagaagatttatgaatgctaaaccgaggtcttgctccgtagaggattgcaaattctctgggacgttttctcagcttactaagcacttgaaaactgagcatcgcggtattgtgccaccaaaggtcgatccactgagacaacagagatgggaaatgatggagagacattctgaatacgttgaactcatgactgcagctgggatttcgcgtatggctgaggtgatgcaacaacagcttccccaggatcagaatcatcctcatgtgtttcaagtgaccgttaatggaaccatatggaatctaattgatccgagtcagggaaggaatggattaggcatcaccaactatagcgcaatgcagtttgtaccattaagcataaatcacagtagaactctgtga

SEQ ID NO: 1050 - protein, 221 aa, Arabidopsis thaliana
  G1531,RING/C3HC4 domain coordinates 41-77
MCESSNKVRVSPYPLRSSRTDKHKASESPIETGWEDVRGCHPYMCDTSVRHSNCFKQFRRKTIKKRLYPKTLHCPLCRGEVSETTKVTSTARRFMNAKPRSCSVEDCKFSGTFSQLTKHLKTEHRGIVPPKVDPLRQQRWEMMERHSEYVELMTAAGISRMAEVMQQQLPQDQNHPHVFQVTVNGTIWNLIDPSQGRNGLGITNYSAMQFVPLSINHSRTL

SEQ ID NO: 1051 - DNA, 2385 bp, Arabidopsis thaliana
  G1535,family:HB
atgttgacaatgggagaaggtaatgtgatgacttcaaacaacagatttgcttcgccgccgcagcagccgtcttcttcttctccgggaacaatccaaaaccctaatttcaatttcatacctttcaactcatattcatccattatcccgaaggaagagcatgggatgatgagtatgatgatgatgatgggagatggaacagtagaggaaatgatggaaaacgggtcggcgggtgggtcattcgggtcaggtagtgaacaagcagaagatccaaagtttggaaacgaatctgatgtcaatgagcttcatgacgatgaacaacctcctccggctaagaagaaacgttatcacagacacactaatcgtcagatccaagaaatggaagcgttgtttaaagaaaaccctcatccagacgacaaacaaagaaagagattaagtgctgaacttggtcttaagcctcgacaagtcaagttttggttccaaaataggcgtacccaaatgaaggcacaacaagacagaaatgagaatgtgatgttaagggcagagaacgataatcttaagtcggagaattgtcatcttcaggcggagctacggtgcctctcttgtccttcttgcggcggccccaccgtccttggcgacattcctttcaacgagatccacattgagaactgtcgcctccgtgaagagcttgatcgtctgtgctgcattgcctcgagatacactggccgtccgatgcaatctatgccaccatctcagccattgatcaatccttctccgatgcttccacatcatcaaccttcattggagctagacatgagtgtatacgctgggaactttccagaacaatcttgtacagacatgatgatgcttcctccacaagatacagcttgtttcttcccagatcaaactgccaacaataacaacaacaacaacatgttacttgcggatgaagaaaaggttatcgctatggaattcgctgtctcttgtgttcaagaacttactaaaatgtgtgacacagaagagcctttgtggattaagaagaaatcagacaagattggcggcgaaattttgtgtcttaacgaggaagagtacatgaggttgttcccatggccgatggagaatcaaaacaacaaaggagattttcttagagaagcttcaaaggcgaatgcagtcgttatcatgaacagcataacactagttgacgcctttctaaacgctgataaatggtcagagatgttctgttcaatcgtggctagggcgaaaactgttcagataatttcatcaggagtttctggagctagtggttctctccttctgatgtttgcagagttacaggtactatctcctctggttccaactagagaagcttattttcttcggtatgtggaacaaaacgcagaaaccggaaattgggcaatcgtggatttcccgatcgatagcttccatgaccaaatgcagccaatgaatactattactcatgagtataagagaaaaccttcaggctgcatcattcaggacatgcctaatggatactcacaagtcaagtgggtggagcatgttgaagtagacgagaaacatgtgcacgagacttttgctgagtatgtgaaaagcggaatggcttttggagctaaccgttggctcgacgtgttgcagagacaatgcgagaggatcgctagtctaatggctagaaacataactgatcttggagtaatttcatctgcagaagcaaggaggaacataatgaggttatcacagagacttgtgaaaacattctgtgtgaatataagcactgcatatggacagtcttggaccgctttgtctgagacaactaaggacaccgtgaggatcacgacaaggaaaatgtgtgaacctggtcagccaacaggagttgttctttgtgctgtctcaaccacttggcttccattttctcaccatcaagtctttgatcttatccgtgatcaacatcaccaatctctggtcgcaagcaactcatggcataatgttgagctgatgcttcaagaaagctgcattgataactccggtagcttaatcgtctactccaccgtcgacgttgactcaattcagcaggcgatgaacggtgaagattcttccaatattccgattttacccctcggattctccattgtccccgtgaatcctcccgagggtatttccgtcaattcgcattctccgccgtcgtgtcttctcaccgtcgggattcaggtcttggcgagtaacgtcccaacagcgaaaccaaatctctccaccgtcaccaccatcaataaccatctctgcgccaccgttaatcagatcacttctgccctcagcaacaccattacgccggtgattgcatcttccgctgacgtgtccaatcaagaagtcagctag

SEQ ID NO: 1052 - protein, 794 aa, Arabidopsis thaliana
  G1535,HB domain coordinates 109-169
MLTMGEGNVMTSNNRFASPPQQPSSSSPGTIQNPNFNFIPFNSYSSIIPKEEHGMMSMMMMMGDGTVEEMMENGSAGGSFGSGSEQAEDPKFGNESDVNELHDDEQPPPAKKKRYHRHTNRQIQEMEALFKENPHPDDKQRKRLSAELGLKPRQVKFWFQNRRTQMKAQQDRNENVMLRAENDNLKSENCHLQAELRCLSCPSCGGPTVLGDIPFNEIHIENCRLREELDRLCCIASRYTGRPMQSMPPSQPLINPSPMLPHHQPSLELDMSVYAGNFPEQSCTDMMMLPPQDTACFFPDQTANNNNNNNMLLADEEKVIAMEFAVSCVQELTKMCDTEEPLWIKKKSDKIGGEILCLNEEEYMRLFPWPMENQNNKGDFLREASKANAVVIMNSITLVDAFLNADKWSEMFCSIVARAKTVQIISSGVSGASGSLLLMFAELQVLSPLVPTREAYFLRYVEQNAETGNWAIVDFPIDSFHDQMQPMNTITHEYKRKPSGCIIQDMPNGYSQVKWVEHVEVDEKHVHETFAEYVKSGMAFGANRWLDVLQRQCERIASLMARNITDLGVISSAEARRNIMRLSQRLVKTFCVNISTAYGQSWTALSETTKDTVRITTRKMCEPGQPTGVVLCAVSTTWLPFSHHQVFDLIRDQHHQSLVASNSWHNVELMLQESCIDNSGSLIVYSTVDVDSIQQAMNGEDSSNIPILPLGFSIVPVNPPEGISVNSHSPPSCLLTVGIQVLASNVPTAKPNLSTVTTINNHLCATVNQITSALSNTITPVIASSADVSNQEVS

SEQ ID NO: 1053 - DNA, 783 bp, Arabidopsis thaliana
  G1537,family:HB
atggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaa

SEQ ID NO: 1054 - protein, 260 aa, Arabidopsis thaliana
  G1537,HB domain coordinates 14-74
MENEVNAGTASSSRWNPTKDQITLLENLYKEGIRTPSADQIQQITGRLRAYGHIEGKNVFYWFQNHKARQRQKQKQERMAYFNRLLHKTSRFFYPPPCSNVGCVSPYYLQQASDHHMNQHGSVYTNDLLHRNNVMIPSGGYEKRTVTQHQKQLSDIRTTAATRMPISPSSLRFDRFALRDNCYAGEDINVNSSGRKTLPLFPLQPLNASNADGMGSSSFALGSDSPVDCSSDGAGREQPFIDFFSGGSTSTRFDSNGNGL

SEQ ID NO: 1055 - DNA, 462 bp, Arabidopsis thaliana
  G1538,family:HB
atggatcatggtaggttaatggatgatcaaatgatgctaggctctcaagtgtacccctacacgacccaaccccaaaattcacactgcatcatcgttaaccagatcgatggaggcgaagaatcaaaaccggtgaagcggaggaggaagaggaggagtaaaggttcatcagccaccaacgaagaagacgtggcggagatcggagggatgttgaggaagaggaagttgaccgatgaacaagtgaacatgctcgaatatagcttcgggaacgagcataagctggagtcagggaggaaggagaagatcgccggagagttaggtcttgacccgagacaggtggctgtttggttccagaaccgccgtgcacgttggaagaacaagaaactagaggaagagtacgccaaactcaaaaaccaccacgacaacgtcgtactcggccaatgccaactcgagtctcaggtataa

SEQ ID NO: 1056 - protein, 153 aa, Arabidopsis thaliana
  G1538,HB domain coordinates 66-126
MDHGRLMDDQMMLGSQVYPYTTQPQNSHCIIVNQIDGGEESKPVKRRRKRRSKGSSATNEEDVAEIGGMLRKRKLTDEQVNMLEYSFGNEHKLESGRKEKIAGELGLDPRQVAVWFQNRRARWKNKKLEEEYAKLKNHHDNVVLGQCQLESQV

SEQ ID NO: 1057 - DNA, 1291 bp, Arabidopsis thaliana
  G1539,family:HB
tttttctccaaacccataagccaaaatagccaaaactactttctaccatttgtctattactccttcaaccatatcattcacatctcctcagtttcgataaaacaaacaaagccctaatatttttacttgctatatcgctgtctctctcccttctcctctataaacatacatataaattaagtacacaccaaaatgtggacgatgggttacaacgaaggaggcgcagattccttcaacggaggaagaaagcttcgtcctctcatcccacgtctcacttcttgccccaccgccgccgtaaacaccaactccgaccaccgctttaatatggcagtggtgacgatgacggcggagcagaacaagagggagctgatgatgctaaactcagaacctcaacatccaccggtaatggtgagctcacggtggaatccgacaccagatcagttaagggttcttgaagagctttaccgacaaggaactagaactccttctgccgaccacatccaacaaatcaccgcacagctacgacggtacgggaagatagaaggcaaaaacgttttctattggttccaaaaccacaaagcccgagaacgccagaaacgacggcgacaaatggaaactggccacgaagaaacggtcctttcaacagcaagtcttgtctcaaaccacggattcgacaagaaagatcctccaggttacaaggttgaacaggtcaagaactggatatgttcggtcggatgcgacacgcaaccagagaaaccttcccgtgattatcatctggaggagccagcgaatatacgggtggagcacaatgctcgttgtggaggagacgagagacgaagctttttagggataaacaccacgtggcagatgatgcagttgccacctagtttctactcttcttcacatcatcatcatcaacgtaacctcattctcaattcacctactgtttcctccaacatgtccaacagcaacaatgctgtctctgcttctaaagatacggtcacggtttcacctgtatttctacgtacgagagaagcaacgaacacagagacttgtcatcgaaatggtgatgataataaagatcaagaacaacatgaagattgctccaacggtgaattggatcatcaagaacagacacttgagctgtttccactgagaaaagaagggttttgtagcgatggtgagaaagacaagaacattagtggcattcactgtttctatgagtttctgccattgaagaactaaacctaattgaagtctttcaagaaaaaaaaaaaaaaaaaaaaaaaaa

SEQ ID NO: 1058 - protein, 350 aa, Arabidopsis thaliana
  G1539,HB domain coordinates 76-136
MWTMGYNEGGADSFNGGRKLRPLIPRLTSCPTAAVNTNSDHRFNMAVVTMTAEQNKRELMMLNSEPQHPPVMVSSRWNPTPDQLRVLEELYRQGTRTPSADHIQQITAQLRRYGKIEGKNVFYWFQNHKARERQKRRRQMETGHEETVLSTASLVSNHGFDKKDPPGYKVEQVKNWICSVGCDTQPEKPSRDYHLEEPANIRVEHNARCGGDERRSFLGINTTWQMMQLPPSFYSSSHHHHQRNLILNSPTVSSNMSNSNNAVSASKDTVTVSPVFLRTREATNTETCHRNGDDNKDQEQHEDCSNGELDHQEQTLELFPLRKEGFCSDGEKDKNISGIHCFYEFLPLKN

SEQ ID NO: 1059 - DNA, 1227 bp, Arabidopsis thaliana
  G1540,family:HB
atctctttactaccagcaagttgttttcttgctaacttcaaacttctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcgggattaaagctctttcctctctctctctctttcgtactcgtatgttcacaactatgcttcgctagtgattaatgatgcagttgttatattagtagttaactagttatctctcgttatgtgtaatttgtaattactagctaagtatcgtctaggtttaattgtaattgacaaccgtttatctctatgatgaataagttaaatttatatat

SEQ ID NO: 1060 - protein, 291 aa, Arabidopsis thaliana
  G1540,HB domain coordinates 35-98
MEPPQHQHHHHQADQESGNNNNKSGSGGYTCRQTSTRWTPTTEQIKILKELYYNNAIRSPTADQIQKITARLRQFGKIEGKNVFYWFQNHKARERQKKRFNGTNMTTPSSSPNSVMMAANDHYHPLLHHHHGVPMQRPANSVNVKLNQDHHLYHHNKPYPSFNNGNLNHASSGTECGVVNASNGYMSSHVYGSMEQDCSMNYNNVGGGWANMDHHYSSAPYNFFDRAKPLFGLEGHQDEEECGGDAYLEHRRTLPLFPMHGEDHINGGSGAIWKYGQSEVRPCASLELRLN

SEQ ID NO: 1061 - DNA, 828 bp, Arabidopsis thaliana
  G1543,family:HB
atgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttga

SEQ ID NO: 1062 - protein, 275 aa, Arabidopsis thaliana
  G1543,HB domain coordinates 135-195
MIKLLFTYICTYTYKLYALYHMDYACVCMYKYKGIVTLQVCLFYIKLRVFLSNFTFSSSILALKNPNNSLIKIMAILPENSSNLDLTISVPGFSSSPLSDEGSGGGRDQLRLDMNRLPSSEDGDDEEFSHDDGSAPPRKKLRLTREQSRLLEDSFRQNHTLNPKQKEVLAKHLMLRPRQIEVWFQNRRARSKLKQTEMECEYLKRWFGSLTEENHRLHREVEELRAIKVGPTTVNSASSLTMCPRCERVTPAASPSRAVVPVPAKKTFPPQERDR

SEQ ID NO: 1063 - DNA, 766 bp, Arabidopsis thaliana
  G1545,family:HB
catcaccaatcttttgaatctaagagagagaagaagaagaaggtctagagaacgaaaagaagaaacatgaataaccagaatgtagatgatcataatcttctactcatttctcaattgtaccctaatgtctatactccattagtaccacaacaaggaggagaagcaaaaccaacacggcggaggaaaaggaagagcaagagtgttgtggtggcagaggagggtgaaaacgaaggcaatgggtggtttagaaagagaaaattgagtgatgagcaagtaagaatgttggagattagctttgaagacgatcataagcttgaatccgagaggaaagatcggcttgcttctgagttagggcttgatcctcgtcaagtcgccgtctggttccaaaaccgccgtgcacggtggaagaacaaacgagtcgaggatgaatacactaaactcaagaatgcatacgaaaccaccgtcgttgagaaatgtcgtcttgattctgaggttattcacctaaaggaacaactttacgaggctgaaagagagatccaacggcttgcaaaaagagttgaaggaactttaagtaacagtcctatctcatcctctgtgaccattgaagccaatcatacgacaccgttttttggagattacgacatcggatttgacggtgaggctgacgagaacttgctctactcgccagattacattgatggattagactggatgagccaatttatgtaaaaaactataagctaatctattttcagtcgtagtatag

SEQ ID NO: 1064 - protein, 220 aa, Arabidopsis thaliana
  G1545,HB domain coordinates 54-117
MNNQNVDDHNLLLISQLYPNVYTPLVPQQGGEAKPTRRRKRKSKSVVVAEEGENEGNGWFRKRKLSDEQVRMLEISFEDDHKLESERKDRLASELGLDPRQVAVWFQNRRARWKNKRVEDEYTKLKNAYETTVVEKCRLDSEVIHLKEQLYEAEREIQRLAKRVEGTLSNSPISSSVTIEANHTTPFFGDYDIGFDGEADENLLYSPDYIDGLDWMSQFM

SEQ ID NO: 1065 - DNA, 774 bp, Arabidopsis thaliana
  G1549,family:HB
caaaagaggtaaaaaaaaagaagaagagaagatggaatattggagcagctccttcatcgatggcgcgtcttcttccagcttcatctctcctttctataactttgaccatttttcaggaaaccaagacaacagatgtttaggtacaatgatgggtgcacaacaagatatacttcatgttcctctagcaatggtagagagtggctatggagaagaaagcaacagttttaatggacaggagaagaaaaaaaagaagatgacgagcgagcagctaaagttcctcgagagaagtttccaagaagagataaagctgaatccggacaggaagatgaagctgaatccggacaggaagatgaagctgtccaaagaactggggctgcagccgagacagattgcggtttggttccagaacaggaaagccaggtggaagaacaaacaacttgagcatctctatgaatcactaagacaagagtttgatattgtctctagagaaaaggaattgctacaagaagagctaatacaactgaaatcaatgataagagaggatagttcatgcaagaagaaacaaacctgggaaaaagcctgcagctgaggcaatagtatataagttccacttcagttatatctccaaaatggctcaaatttgtagctttagtcccaaacaagcaacaatttctatggctgattctgttttcctttgtattaagtattgtttaagtgattttcgtgtaaagggttctttactaagttgaagttaatgaagaaacatcgtgattc

SEQ ID NO: 1066 - protein, 185 aa, Arabidopsis thaliana
  G1549,HB domain coordinates 75-135
MEYWSSSFIDGASSSSFISPFYNFDHFSGNQDNRCLGTMMGAQQDILHVPLAMVESGYGEESNSFNGQEKKKKKMTSEQLKFLERSFQEEIKLNPDRKMKLNPDRKMKLSKELGLQPRQIAVWFQNRKARWKNKQLEHLYESLRQEFDIVSREKELLQEELIQLKSMIREDSSCKKKQTWEKACS

SEQ ID NO: 1067 - DNA, 1473 bp, Arabidopsis thaliana
  G1554,family:GARP
ggcaccacaaattcttcttgattccttgatcatctatattatatttatataatcaataaatattcttcctatacagcgagagagagagagtatataagctataaatatggcgtcctcatcagaactaagcttggattgcaagccacaaagctactctatgcttttgaaatcctttggagataactttcagagcgatccaaccacacataagcttgaagatcttctctctcgcctagaacaagaacgtctcaagatcgatgccttcaaacgcgagcttcccctttgcatgcaactccttaacaatgctgtggaagtttacaaacaacaactagaagcatatagagcaaatagtaataacaataaccaaagtgttggtacaagaccagttctcgaagagttcatacccttaaggaaccaacccgaaaagacaaacaacaaaggaagtaattggatgacgactgctcagctatggagccaatccgaaaccaaaccaaaaaacattgattcaactactgatcaatctcttcccaaagacgagattaatagtagtccgaaactcggacattttgatgcaaaacaaagaaatggcagcggtgcttttcttcccttctctaaggaacaatctttgcctgaattagctctatccacggaggtcaagagggtctctccgaccaacgaacatactaatggccaagacggtaatgatgagagcatgatcaacaatgataataactataataataataataataacaattcgaacagcaatggagtttcttctacaacgagtcaaagtaatagaaaggcacgacgttgctggtcgccggacttgcaccggagatttgtccaagctcttcaaatgcttggtggctcgcaagtggctacacctaaacaaataagggaactcatgaaagttgatggtttgaccaatgatgaagtcaaaagccatctccagaagtatcggcttcacactagaagaccaagcccaagcccacaaacgtcaggtgggccaggtccacatttggtggtcctaggtggcatatgggttccaccggagtacacctccgcacatggtggcactccgactctctaccaccaccaagtccaccaccaccataccaacacggcagggccgcctccaccacacttttgctcctctcaagaattctacacaactccaccgcctcctcagccgctccaccaccaccactttcaaacgtttaacggttcatccggtggcaccgcctctaccgattctactcatcatcaggtgacggacagtcccacagttgaagggaagtcaccggagagtggtggtggagagagaaaagggttggctgctcttagggaagaatgtgaagatcacagcaatattaatggaagtgaaataactctcaaattctaaaaaaaataaagattcttgattaattaattagagtaatgagattttagggttagggtttgtgggtgcct

SEQ ID NO: 1068 - protein, 432 aa, Arabidopsis thaliana
  G1554,GARP domain coordinates 238-287
MASSSELSLDCKPQSYSMLLKSFGDNFQSDPTTHKLEDLLSRLEQERLKIDAFKRELPLCMQLLNNAVEVYKQQLEAYRANSNNNNQSVGTRPVLEEFIPLRNQPEKTNNKGSNWMTTAQLWSQSETKPKNIDSTTDQSLPKDEINSSPKLGHFDAKQRNGSGAFLPFSKEQSLPELALSTEVKRVSPTNEHTNGQDGNDESMINNDNNYNNNNNNNSNSNGVSSTTSQSNRKARRCWSPDLHRRFVQALQMLGGSQVATPKQIRELMKVDGLTNDEVKSHLQKYRLHTRRPSPSPQTSGGPGPHLVVLGGIWVPPEYTSAHGGTPTLYHHQVHHHHTNTAGPPPPHFCSSQEFYTTPPPPQPLHHHHFQTFNGSSGGTASTDSTHHQVTDSPTVEGKSPESGGGERKGLAALREECEDHSNINGSEITLKF

SEQ ID NO: 1069 - DNA, 703 bp, Arabidopsis thaliana
  G1556,family:GARP
aacctaaaaattttacgagagataaaaaaaatgcaagatccgatggttagatcttacattaggtcagacaatccgcgaatgcactggaccgacgatcttgatatccgttttattcaagttattgaaaaactcggtggcgaagagagtgcaactcctaagagaattttgagtcttatgggtgtgagagacctcacaatatcacatgtcaaaagtcatctccagatgtataggaacaaaaagaaagaagaatctagtaaagaaataaaaatgatgcgggagatgacacagaggcaatctcagcaatatcttcaaatctatgaacgtgctacccaatttatccaaaatcaacaaaggctacaactggataatactgagaagataaccccagttttgggatcaagtaacaagtctctagatcaatcttcaaaggttggactaaatgaaaacagaggcaatgatgttgttgttgttggtggtgcaactggtgaagaagaattgtcccttgaactcactcttggtcgcaagtactaagaggagtttggtttctatctttttttttatgcttgctctctattttatgtaatgcttatctcatatatataatgggataagaaaaataaaaactgaacaatattttatggtattctatttataatgctattatgtgattttgcatccatgctatttgggggaaatattattt

SEQ ID NO: 1070 - protein, 166 aa, Arabidopsis thaliana
  G1556,GARP domain coordinates 19-67
MQDPMVRSYIRSDNPRMHWTDDLDIRFIQVIEKLGGEESATPKRILSLMGVRDLTISHVKSHLQMYRNKKKEESSKEIKMMREMTQRQSQQYLQIYERATQFIQNQQRLQLDNTEKITPVLGSSNKSLDQSSKVGLNENRGNDVVVVGGATGEEELSLELTLGRKY

SEQ ID NO: 1071 - DNA, 844 bp, Arabidopsis thaliana
  G1557,family:GARP
ccctttgagtttttttttggggtgaaactcatctctttgagttccttcaaccattttgaaaacagcttgccggaaacattggtgaattttcatcgaatcgcgagtttcagtaagatataaaacagatgaagaacccaatcgttagatcttatgttagatcaaaagtgccgcggttgcggtggaactctgatcttcataactcttttgttcaagctgttgaacaactaggtggagaaaatagagcaactcctaaaatggttttacagttaatggatgtgagaggactcacaatatcacatgtgaagagtcatctccagatgtataggggcatgaagcttgaagaatccatgcaagaagagatattagcaaagagaagtgttagagtgacaggacaagtaacttggtggcaatttcaacattaccttcataactaccaacgtcttcagggcaatgccaactttttccaaaatcaacaaaggcaagaagcgggaatatatgaaaaaattataacatttggacaatcaagtaatgaaactaaggaagtaccaagtgactactttacctgcaagtctctctatgaaacatccagagctccacaaaataaaacgagagatgatgatgaaaatggtgaagctgttgttgctattgaagatgatggtaatgttgttgatgaacatgatgatgaggatgctaatgatgatgaggttactttgtcactaaactcaataaaagtttcaaaaagtgaagaagaattgtcccttgagctcactcttggtctcaaagcataacatgttttgattttgatttttttttttttgtagaaaccgttggaagtatgttgtag

SEQ ID NO: 1072 - protein, 220 aa, Arabidopsis thaliana
  G1557,GARP domain coordinates 19-67
MKNPIVRSYVRSKVPRLRWNSDLHNSFVQAVEQLGGENRATPKMVLQLMDVRGLTISHVKSHLQMYRGMKLEESMQEEILAKRSVRVTGQVTWWQFQHYLHNYQRLQGNANFFQNQQRQEAGIYEKIITFGQSSNETKEVPSDYFTCKSLYETSRAPQNKTRDDDENGEAVVAIEDDGNVVDEHDDEDANDDEVTLSLNSIKVSKSEEELSLELTLGLKA

SEQ ID NO: 1073 - DNA, 1440 bp, Arabidopsis thaliana
  G1560,family:HS
atcctttcaatttccactcctctctaatataattcacattttcccactattgctgattcatttttttttgtgaattatttcaaacccacataaaaaaatctttgtttaaatttaaaaccatggatccttcatttaggttcattaaagaggagtttcctgctggattcagtgattctccatcaccaccatcttcttcttcatacctttattcatcttccatggctgaagcagccataaatgatccaacaacattgagctatccacaaccattagaaggtctccatgaatcagggccacctccatttttgacaaagacatatgacttggtggaagattcaagaaccaatcatgtcgtgtcttggagcaaatccaataacagcttcattgtctgggatccacaggccttttctgtaactctccttcccagattcttcaagcacaataacttctccagttttgtccgccagctcaacacatatggtttcagaaaggtgaatccggatcggtgggagtttgcaaacgaagggtttcttagagggcaaaagcatctcctcaagaacataaggagaagaaaaacaagtaataatagtaatcaaatgcaacaacctcaaagttctgaacaacaatctctagacaatttttgcatagaagtgggtaggtacggtctagatggagagatggacagcctaaggcgagacaagcaagtgttgatgatggagctagtgagactaagacagcaacaacaaagcaccaaaatgtatctcacattgattgaagagaagctcaagaagaccgagtcaaaacaaaaacaaatgatgagcttccttgcccgcgcaatgcagaatccagattttattcagcagctagtagagcagaaggaaaagaggaaagagatcgaagaggcgatcagcaagaagagacaaagaccgatcgatcaaggaaaaagaaatgtggaagattatggtgatgaaagtggttatgggaatgatgttgcagcctcatcctcagcattgattggtatgagtcaggaatatacatatggaaacatgtctgaattcgagatgtcggagttggacaaacttgctatgcacattcaaggacttggagataattccagtgctagggaagaagtcttgaatgtggaaaaaggaaatgatgaggaagaagtagaagatcaacaacaagggtaccataaggagaacaatgagatttatggtgaaggtttttgggaagatttgttaaatgaaggtcaaaattttgattttgaaggagatcaagaaaatgttgatgtgttaattcagcaacttggttatttgggttctagttcacacactaattaagaagaaattgaaatgatgactactttaagcatttgaatcaacttgtttcctattagtaatttggctttgtttcaatcaagtgagtcgtggactaacttgc

SEQ ID NO: 1074 - protein, 406 aa, Arabidopsis thaliana
  G1560,HS domain coordinates 61-152
MDPSFRFIKEEFPAGFSDSPSPPSSSSYLYSSSMAEAAINDPTTLSYPQPLEGLHESGPPPFLTKTYDLVEDSRTNHVVSWSKSNNSFIVWDPQAFSVTLLPRFFKHNNFSSFVRQLNTYGFRKVNPDRWEFANEGFLRGQKHLLKNIRRRKTSNNSNQMQQPQSSEQQSLDNFCIEVGRYGLDGEMDSLRRDKQVLMMELVRLRQQQQSTKMYLTLIEEKLKKTESKQKQMMSFLARAMQNPDFIQQLVEQKEKRKEIEEAISKKRQRPIDQGKRNVEDYGDESGYGNDVAASSSALIGMSQEYTYGNMSEFEMSELDKLAMHIQGLGDNSSAREEVLNVEKGNDEEEVEDQQQGYHKENNEIYGEGFWEDLLNEGQNFDFEGDQENVDVLIQQLGYLGSSSHTN

SEQ ID NO: 1075 - DNA, 1238 bp, Arabidopsis thaliana
  G1585,family:HB
ttagatttgctattctctcattaccctatcaaccctaagtaatctctttagctctcgattatcatcattacaccatcatcatgtcctcctcaaacaaaaattggccaagcatgttcaaatccaaaccttgcaacaataatcatcatcatcaacatgaaatcgatactccatcttacatgcactactctaattgcaacctatcatcttccttttcctcagatcggataccagatcctaaaccgagatggaatcctaaaccggagcagattaggatactcgaatcaatcttcaattccggtactattaacccacctagagaggagattcaaagaatccggatccggcttcaagaatatggtcaaatcggtgacgcaaacgtgttttactggtttcaaaaccggaaatctcgagcaaaacacaagcttcgtgttcatcacaaaagccctaaaatgtcaaagaaggacaagacggttattcctagtactgacgctgatcattgttttggttttgttaaccaagaaaccggattatatccggttcaaaacaatgagttggtggtaaccgaaccggccggttttctatttccggttcataatgatccgagcgctgctcaatcagcgtttggttttggcgattttgttgtaccggtggtaacggaagaagggatggcattctctaccgttaataacggcgttaatttggagactaacgaaaattttgataaaattccggcgatcaatttatacggcggagatggaaatggcggtggaaattgttttcctcctttgactgttccattaaccatcaatcaatctcaagaaaaacgagatgtaggattatccggtggtgaagacgtcggagataatgtttatccggtgagaatgacggtgtttattaacgagatgcctatcgaagtagtgtctggattattcaacgttaaggcagctttcggaaacgatgccgttttgatcaactcgtttggccagcctattcttacagatgaatttggtgttacttatcaacctctccaaaatggcgcaatctattatcttatttagaagatattgaaaagcaaatgttatggtgctatggataaatattaatataataataaaagatttctgcgatttatttagttattaattatataagaatttcatttcttatcttttaaatttatgaaccaatttccgggcaatttcctttttcgagaactttggaaaaattaaggaatggaa

SEQ ID NO: 1076 - protein, 325 aa, Arabidopsis thaliana
  G1585,HB domain coordinates 55-115
MSSSNKNWPSMFKSKPCNNNHHHQHEIDTPSYMHYSNCNLSSSFSSDRIPDPKPRWNPKPEQIRILESIFNSGTINPPREEIQRIRIRLQEYGQIGDANVFYWFQNRKSRAKHKLRVHHKSPKMSKKDKTVIPSTDADHCFGFVNQETGLYPVQNNELVVTEPAGFLFPVHNDPSAAQSAFGFGDFVVPVVTEEGMAFSTVNNGVNLETNENFDKIPAINLYGGDGNGGGNCFPPLTVPLTINQSQEKRDVGLSGGEDVGDNVYPVRMTVFINEMPIEVVSGLFNVKAAFGNDAVLINSFGQPILTDEFGVTYQPLQNGAIYYLI

SEQ ID NO: 1077 - DNA, 816 bp, Arabidopsis thaliana
  G1587,family:HB
atgggctacatctccaacaacaacctcatcaactatttgcccctctctactactcaacctcctcttcttctcacccactgtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtggtcatcgagttgatcagacaaagctctgcccatcttttccacacacaaaccgaccacagccacagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactga

SEQ ID NO: 1078 - protein, 271 aa, Arabidopsis thaliana
  G1587,HB domain coordinates 61-121
MGYISNNNLINYLPLSTTQPPLLLTHCDINGNDHHQLITASSGEHDIDERKNNIPAAATLRWNPTPEQITTLEELYRSGTRTPTTEQIQQIASKLRKYGRIEGKNVFYWFQNHKARERLKRRRREGGAIIKPHKDVKDSSSGGHRVDQTKLCPSFPHTNRPQPQHELDPASYNKDNNANNEDHGTTEESDQRASEVGKYATWRNLVTWSITQQPEEINIDENVNGEEEETRDNRTLNLFPVREYQEKTGRLIEKTKACNYCYYYEFMPLKN

SEQ ID NO: 1079 - DNA, 904 bp, Arabidopsis thaliana
  G1591,family:HB
atccacacacacacacatctctctctatataaccctaagtgtttggagatagcatcactagagaacacacacacaaagcatcaatatttgtctgaacggagaatgagtcctgtggcttcaacgaggtggtgtccgacgccggagcaactgatgatcttggaagagatgtaccggagtggtatacggactccgaatgcggtgcagatacaacagatcacagctcacttggcgttctatggaagaatcgagggcaaaaacgtcttttactggttccagaaccataaggctagagatagacagaagctgaggaagaaactagccaagcaacttcaccagcaacaacatcaacttcaactccaacttcagcagatcaaaccaaaaccaatatcatcgatgatttctcaaccagttaataagaatatcatcgatcatcacaatccttatcatcatcaccatcataatcatcatcataatcatcatcgtccatatgatcatatgtcctttgattgctgctctcatccttctcccatgtgtcttcctcatcagggaactggagtaggagaagctccaagcaaagtgatgaatgaatattactgcaccaaaagtggagctgaagagatattgatgcaaaaatcaatcacgggtccaaactcatcgtacggtcgagattggatgatgatgatggatatgggcccacgaccatcatatccctcatcatcatcatcacccatttcatgttgtaacatgatgatgagcagtccaaagataccattgaaaaccctggaacttttcccaatctcatctatcaactccaaacaagacagtaccaaactttaaagaaaagacaacaaatacaaaagagattctgcaggtgtttcattcatgtatcactgtatgatgtgtc

SEQ ID NO: 1080 - protein, 244 aa, Arabidopsis thaliana
  G1591,HB domain coordinates 8-68
MSPVASTRWCPTPEQLMILEEMYRSGIRTPNAVQIQQITAHLAFYGRIEGKNVFYWFQNHKARDRQKLRKKLAKQLHQQQHQLQLQLQQIKPKPISSMISQPVNKNIIDHHNPYHHHHHNHHHNHHRPYDHMSFDCCSHPSPMCLPHQGTGVGEAPSKVMNEYYCTKSGAEEILMQKSITGPNSSYGRDWMMMMDMGPRPSYPSSSSSPISCCNMMMSSPKIPLKTLELFPISSINSKQDSTKL

SEQ ID NO: 1081 - DNA, 1296 bp, Arabidopsis thaliana
  G1593,family:HB
atggctgctttctttcttggagaatctgaaatgagagaacactcttctgatctttttatgatgactctgaatccgtttcgcgagcagacaacgaccactaatgctcatgacgatcacttctacaacttgtgctttggttcccaacaatatagacctcgagatgaagtaggtcatatagaacaaggaaattcttccatctccactttttcaaacggaggagtcttcagggctttggctccgatctacttgaaagcggctcaagaattactcaatgagattgtcaatgttggaaacggtagccacggcgcaaaacaagagcgaccggtgagtaaagagtccacgatttatggagttgaggacatcaatggtggctataagcctggcgtagctgctttgcaaatgaagaaagcaaaactcatctccatgggtgaaatggtggaacagagatacaagcaataccatgaccaaatgcagactataatctcatcgtttgagcaagctgcgggtttaggctcagcaaactcatacacacatatggcgttacaaacaatatcaaagcagtttcgtgctgtaaaagacatgataagtttgcaaatcaagcaaataaacaagctcttgggacaaaaggaatttgacgagcagcttaagaagttgggaaagatggcacatcaccattcaaatgcttggagaccgcagagaggtttgcccgaaaaagctgtttccgttctacgctcttggctctttgagcattttcttcatccatatccgagggatttggataaggtaatgcttgccaaacagactggccttactaagagtcaggtgtcaaattggttcattaatgctcgagttcgaatgtggaagccactggtggaggaactttattcggaagaaatggatattgaagaaagcagaaaaggaagtgaccggtatagtaccaaaggttcatcttcaaagcaaccgtacaataatacaacttcaaatgaatcttcgaacacgatcctacccgcctttcgtcaaggattcactgaaactgaaacccctaggcaaaattcatcctcaagttgcagcgtagtcatgaggttcacgaagcaacacatgaatcaagcgaacttcatcaatttcaacggagggttcgaaaactatcacacaatggatggaaacagcgtctccctttccctcggcctgcctcattcttgtgaccaaacctttaataacattcattttgagtcaacaagtcatggaactgagaactcggccatatattcatcttcaacttatcaaatcatggattag

SEQ ID NO: 1082 - protein, 431 aa, Arabidopsis thaliana
  G1593,HB domain coordinates 227-290
MAAFFLGESEMREHSSDLFMMTLNPFREQTTTTNAHDDHFYNLCFGSQQYRPRDEVGHIEQGNSSISTFSNGGVFRALAPIYLKAAQELLNEIVNVGNGSHGAKQERPVSKESTIYGVEDINGGYKPGVAALQMKKAKLISMGEMVEQRYKQYHDQMQTIISSFEQAAGLGSANSYTHMALQTISKQFRAVKDMISLQIKQINKLLGQKEFDEQLKKLGKMAHHHSNAWRPQRGLPEKAVSVLRSWLFEHFLHPYPRDLDKVMLAKQTGLTKSQVSNWFINARVRMWKPLVEELYSEEMDIEESRKGSDRYSTKGSSSKQPYNNTTSNESSNTILPAFRQGFTETETPRQNSSSSCSVVMRFTKQHMNQANFINFNGGFENYHTMDGNSVSLSLGLPHSCDQTFNNIHFESTSHGTENSAIYSSSTYQIMD

SEQ ID NO: 1083 - DNA, 984 bp, Arabidopsis thaliana
  G1594,family:HB
atggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatga

SEQ ID NO: 1084 - protein, 327 aa, Arabidopsis thaliana
  G1594,HB domain coordinates 308-343
MDGMYNFHSAGDYSDKSVLMMSPESLMFPSDYQALLCSSAGENRVSDVFGSDELLSVAVSALSSEAASIAPEIRRNDDNVSLTVIKAKIACHPSYPRLLQAYIDCQKVGAPPEIACLLEEIQRESDVYKQEVVPSSCFGADPELDEFMETYCDILVKYKSDLARPFDEATCFLNKIEMQLRNLCTGVESARGVSEDGVISSDEELSGGDHEVAEDGRQRCEDRDLKDRLLRKFGSRISTLKLEFSKKKKKGKLPREARQALLDWWNLHYKWPYPTEGDKIALADATGLDQKQINNWFINQRKRHWKPSENMPFAMMDDSSGSFFTEE

SEQ ID NO: 1085 - DNA, 896 bp, Arabidopsis thaliana
  G1634,family:MYB-related
ttatctcgtagcctttaaacgatggagactctgcatccactactctcgcacgtgccaacttctgaccaccggtttgtagttcaagagatgatgtgcttgcaaagctcgagctggactaaagaagagaacaagaagtttgagcgagctcttgctgtctacgctgatgacacgcctgatcgctggttcaaagttgctgctatgatccctggaaagaccatatcagatgtcatgaggcaatactctaagcttgaagaagacctcttcgatatcgaagcaggacttgtcccgatcccgggttaccgttcagttactccttgtggatttgatcaggttgtgagtccacgtgactttgatgcgtatcgtaaacttcctaatggagccagaggatttgatcaagaccgtaggaaaggagttccatggacggaggaagaacacaggagattcttgttagggcttctcaagtatgggaaaggagattggagaaacatatcgaggaactttgtgggatcaaaaacaccaactcaggttgcaagtcatgcccaaaagtactaccaaagacagctttccggtgcgaaagacaaacgacggcctagcattcacgacatcaccaccgtcaatcttctcaatgccaatcttagccgtccatcgtctgatcacggttgcttagtctcaaaacaggccgagccgaaactagggttcaccgacagggataatgcagaggagggagttatgtttcttggtcagaatctatcctcggtcttctcttcctacgatcctgccattaagttttccggagcaaatgtttacggtgaaggaggttactgtatctcacaagatcttgaaacgagaaaatgagaattttgaaattttaactattgcaacgaaaccataattgc

SEQ ID NO: 1086 - protein, 277 aa, Arabidopsis thaliana
  G1634,MYB-related domain coordinates 29-79,131-179
METLHPLLSHVPTSDHRFVVQEMMCLQSSSWTKEENKKFERALAVYADDTPDRWFKVAAMIPGKTISDVMRQYSKLEEDLFDIEAGLVPIPGYRSVTPCGFDQVVSPRDFDAYRKLPNGARGFDQDRRKGVPWTEEEHRRFLLGLLKYGKGDWRNISRNFVGSKTPTQVASHAQKYYQRQLSGAKDKRRPSIHDITTVNLLNANLSRPSSDHGCLVSKQAEPKLGFTDRDNAEEGVMFLGQNLSSVFSSYDPAIKFSGANVYGEGGYCISQDLETRK

SEQ ID NO: 1087 - DNA, 1164 bp, Arabidopsis thaliana
  G1635,family:MYB-related
atggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataa

SEQ ID NO: 1088 - protein, 387 aa, Arabidopsis thaliana
  G1635,MYB-related domain coordinates 56-102
MASSPLTANVQGTNASLRNRDEETADKQIQFNDQSFGGNDYAPKVRKPYTITKERERWTDEEHKKFVEALKLYGRAWRRIEEHVGSKTAVQIRSHAQKFFSKVAREATGGDGSSVEPIVIPPPRPKRKPAHPYPRKFGNEADQTSRSVSPSERDTQSPTSVLSTVGSEALCSLDSSSPNRSLSPVSSASPPAALTTTANAPEELETLKLELFPSERLLNRESSIKEPTKQSLKLFGKTVLVSDSGMSSSLTTSTYCKSPIQPLPRKLSSSKTLPIIRNSQEELLSCWIQVPLKQEDVENRCLDSGKAVQNEGSSTGSNTGSVDDTGHTEKTTEPETMLCQWEFKPSERSAFSELRRTNSESNSRGFGPYKKRKMVTEEEEHEIHLHL

SEQ ID NO: 1089 - DNA, 954 bp, Arabidopsis thaliana
  G1637,family:MYB-related
atggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatga

SEQ ID NO: 1090 - protein, 317 aa, Arabidopsis thaliana
  G1637,MYB-related domain coordinates 108-156
MVKETVTVAKTCSHCGHNGHNARTCLNGVNKASVKLFGVNISSDPIRPPEVTALRKSLSLGNLDALLANDESNGSGDPIAAVDDTGYHSDGQIHSKKGKTAHEKKKGKPWTEEEHRNFLIGLNKLGKGDWRGIAKSFVSTRTPTQVASHAQKYFIRLNVNDKRKRRASLFDISLEDQKEKERNSQDASTKTPPKQPITGIQQPVVQGHTQTEISNRFQNLSMEYMPIYQPIPPYYNFPPIMYHPNYPMYYANPQVPVRFVHPSGIPVPRHIPIGLPLSQPSEASNMTNKDGLDLHIGLPPQATGASDLTGHGVIHVK

SEQ ID NO: 1091 - DNA, 942 bp, Arabidopsis thaliana
  G1638,family:MYB-related
gattcgatcaacaatcgttgaaaacatgaacagaggaatcgaagttatgtcaccagcaacatatctagagacatcaaactggttgtttcaagaaaacagaggaaccaaatggacagctgaagaaaacaagaaattcgaaaacgctttagccttttacgacaaagatactcccgacagatggtccagagtcgctgccatgcttcccggtaaaacagtcggagatgtgatcaaacaatacagagagcttgaggaagacgttagcgacatcgaagctggtcttataccaatccctggttacgcctctgattcattcacacttgattggggtggctacgacggagcaagcggtaacaatgggtttaacatgaacggttactacttttccgccgccggaggaaagagaggatccgccgcacgaacggcggagcatgagaggaagaaaggtgttccatggacagaagaagaacacagacaatttctgatgggtttgaagaaatatggaaaaggagattggagaaacatagctcgtaactttgtgaccacaagaacgccaacgcaagtcgcaagtcacgctcaaaagtatttcatacggcaagtcaatggtggcaaagacaaacgccgttcaagcatccatgatatcacaaccgtcaacatccccgactctcctgacgctgcagccgcggataacgcaaccgcaaacgcaccttgctcgccaccttccgtaggaggaaaccagcgggagacatcggagtgggaaggtcaaacactatacgatgaaacggcagctgcgttttataatcaaaacgcgttttcagaaacgctacttggaatgtcttcgacgccctacatggcaaaacttcaggagcagagttttctgaacgcatcgcaattcgaatcgtacaatgcgtatctccaaatgtagctcacaaggtgaagatctcg

SEQ ID NO: 1092 - protein, 298 aa, Arabidopsis thaliana
  G1638,MYB-related domain coordinates 27-77,141-189
MNRGIEVMSPATYLETSNWLFQENRGTKWTAEENKKFENALAFYDKDTPDRWSRVAAMLPGKTVGDVIKQYRELEEDVSDIEAGLIPIPGYASDSFTLDWGGYDGASGNNGFNMNGYYFSAAGGKRGSAARTAEHERKKGVPWTEEEHRQFLMGLKKYGKGDWRNIARNFVTTRTPTQVASHAQKYFIRQVNGGKDKRRSSIHDITTVNIPDSPDAAAADNATANAPCSPPSVGGNQRETSEWEGQTLYDETAAAFYNQNAFSETLLGMSSTPYMAKLQEQSFLNASQFESYNAYLQM

SEQ ID NO: 1093 - DNA, 1127 bp, Arabidopsis thaliana
  G1640,family:MYB-(R1)R2R3
ctctcactcaagggtccaaaagtgttttctctttttcagtttctctttctctttttgacagaagagaccgagaagcaatgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggagtgattgtaccgagcaagtggattg

SEQ ID NO: 1094 - protein, 342 aa, Arabidopsis thaliana
  G1640,MYB-(R1)R2R3 domain coordinates 14-115
MGRAPCCEKIGLKRGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRKIYAFTAVSGDGHNLLVNDVVLKKSCSSSSGAKNNNKTKKKKKGRTSRSSMKKHKQMVTASQCFSQPKELESDFSEGGQNGNFEGESLGPYEWLDGELERLLSSCVWECTSEEAVIGVNDEKVCESGDNSSCCVNLFEEEQGSETKIGHVGITEVDHDMTVEREREGSFLSSNSNENNDKDWWVGLCNSSEVGFGVDEELLDWEFQGNVTCQSDDLWDLSDIGEITLE

SEQ ID NO: 1095 - DNA, 867 bp, Arabidopsis thaliana
  G1641,family:MYB-related
atggaggttatgagaccgtcgacgtcacacgtgtcaggtgggaactggctcatggaggaaactaagagcggcgtcgcagcttctggtgaaggtgccacgtggacggcggcagagaacaaggcattcgagaatgctttggcggtttacgacgacaacactcctgatcggtggcagaaggtggctgcggtgattccggggaagacagtgagtgacgtaattagacagtataacgatttggaagctgatgtcagcagcatcgaggccggtttaatcccggtccccggttacatcacctcgccgcctttcactctagattgggccggcggcggtggcggatgtaacgggtttaaaccgggtcatcaggtttgtaataaacggtcgcaggccggtagatcgccggagctggagcggaagaaaggcgttccttggacggaggaagaacacaagctatttctaatgggtttgaagaaatatgggaaaggagattggagaaacatatctcggaactttgtgataacgcgaacgccaacacaagtagctagccacgcccaaaagtacttcatccggcaactttccggcggcaaggacaagagacgagcaagcattcacgacataaccaccgtaaatctcgaagaggaggcttctttggagaccaataagagctccattgttgttggagatcagcgttcaaggctaaccgcgtttccttggaaccaaacggacaacaatggaacacaggcagacgctttcaatataacgattggaaacgctattagtggcgttcattcatacggccaggttatgattggagggtataacaatgcagattcttgctatgacgcccaaaacacaatgtttcaactatag

SEQ ID NO: 1096 - protein, 288 aa, Arabidopsis thaliana
  G1641,MYB-related domain coordinates 32-82,141-189
MEVMRPSTSHVSGGNWLMEETKSGVAASGEGATWTAAENKAFENALAVYDDNTPDRWQKVAAVIPGKTVSDVIRQYNDLEADVSSIEAGLIPVPGYITSPPFTLDWAGGGGGCNGFKPGHQVCNKRSQAGRSPELERKKGVPWTEEEHKLFLMGLKKYGKGDWRNISRNFVITRTPTQVASHAQKYFIRQLSGGKDKRRASIHDITTVNLEEEASLETNKSSIVVGDQRSRLTAFPWNQTDNNGTQADAFNITIGNAISGVHSYGQVMIGGYNNADSCYDAQNTMFQL

SEQ ID NO: 1097 - DNA, 1144 bp, Arabidopsis thaliana
  G1645,family:MYB-(R1)R2R3
cgtcgacctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtggc

SEQ ID NO: 1098 - protein, 359 aa, Arabidopsis thaliana
  G1645,MYB-(R1)R2R3 domain coordinates 90-210
MFITEKQVWMDEIVARRASSSWDFPFNDINIHQHHHRHCNTSHEFEILKSPLGDVAVHEEESNNNNPNFSNSESGKKETTDSGQSWSSSSSKPSVLGRGHWRPAEDVKLKELVSIYGPQNWNLIAEKLQGRSGKSCRLRWFNQLDPRINRRAFTEEEEERLMQAHRLYGNKWAMIARLFPGRTDNSVKNHWHVVMARKYREHSSAYRRRKLMSNNPLKPHLTNNHHPNPNPNYHSFISTNHYFAQPFPEFNLTHHLVNNAPITSDHNQLVLPFHCFQGYENNEPPMVVSMFGNQMMVGDNVGATSDALCNIPHIDPSNQEKPEPNDAMHWIGMDAVDEEVFEKAKQQPHFFDFLGLGTA

SEQ ID NO: 1099 - DNA, 800 bp, Arabidopsis thaliana
  G1646,family:CAAT
gatcttttgatccaatcacaaggcaaagatccaatggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaagggtaagtgaattctagtag

SEQ ID NO: 1100 - protein, 250 aa, Arabidopsis thaliana
  G1646,CAAT domain coordinates 66-162
MDNNNNNNNQQPPPTSVYPPGSAVTTVIPPPPSGSASIVTGGGATYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPREEIKEEEDAASALGGGGMVAPAASGVPYYYPPMGQPAVPGGMMIGRPAMDPSGVYAQPPSQAWQSVWQNSAGGGDDVSYGSGGSSGHGNLDSQG

SEQ ID NO: 1101 - DNA, 1471 bp, Arabidopsis thaliana
  G1649,family:HLH/MYC
attcacaaaaaccggaaaaaaaaaaagacaagtaaagaaagctttgttcagtttacttcaatggaagcaaaacccttagcatcatcatcatctgaaccaaacatgatttctccatcatcaaacattaaaccaaaattaaaagatgaagattatatggagctggtgtgtgaaaatgggcagattcttgcaaagattcgaagaccaaagaacaacggttcttttcaaaagcaacgtaggcaatctctcctggatttgtatgagaccgagtacagcgagggtttcaagaaaaacatcaagattcttggagacacacaagttgttccggtgagtcagtctaagccacaacaagataaagaaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaataattcagatgatgaatcagatgatgcgaagacacaagttcatgcgagaacaagaaagccggtgactaaaagaaaacgaagcacagaagtccataagttatatgaaagaaaacgaagagatgaattcaacaagaaaatgcgtgctttgcaggacctactaccaaattgttacaaggatgataaggcttcattgttggatgaggctatcaaatatatgcggacccttcaacttcaagttcagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaactaatgatttgtagaaagttgatgttttctccaactaactaactttaagcaaaaaaaaatgatcgtctactctgtgttgttagtctatgggcttttgggccttgattcttggaacgatttgaacttaattccaactattttcaaagtggatgtacaaagtaaaa

SEQ ID NO: 1102 - protein, 416 aa, Arabidopsis thaliana
  G1649,HLH/MYC domain coordinates 226-283
MEAKPLASSSSEPNMISPSSNIKPKLKDEDYMELVCENGQILAKIRRPKNNGSFQKQRRQSLLDLYETEYSEGFKKNIKILGDTQVVPVSQSKPQQDKETNEQMNNNKKKLKSSKIEFERNVSKSNKCVESSTLIDVSAKGPKNVEVTTAPPDEQSAAVGRSTELYFASSSKFSRGTSRDLSCCSLKRKYGDIEEEESTYLSNNSDDESDDAKTQVHARTRKPVTKRKRSTEVHKLYERKRRDEFNKKMRALQDLLPNCYKDDKASLLDEAIKYMRTLQLQVQMMSMGNGLIRPPTMLPMGHYSPMGLGMHMGAAATPTSIPQFLPMNVQATGFPGMNNAPPQMLSFLNHPSGLIPNTPIFSPLENCSQPFVVPSCVSQTQATSFTQFPKSASASNLEDAMQYRGSNGFSYYRSPN

SEQ ID NO: 1103 - DNA, 1423 bp, Arabidopsis thaliana
  G1650,family:HLH/MYC
tcgacagtcacaaatgtccatatgagtttctgggcgacttctatcagaatttttgttcataattttttttattgtatcaagggatgacttggaaaccgaagatgcttatattatcccatgatctaatctcaccagaaaaatacatcatgggtgaagatgatatcgtggagctcttagggaagagcagccaagtagttacaagtagccagacacaaacaccctcttgcgatcctcctctcattctccggggcagcggaagcggggacggagaaggaaatggtcctctaccgcagcctccgcctcccctgtaccatcagcagagtctctttatccaagaagacgaaatggcttcttggcttcaccagcctaatcgccaagattatctctactcccaacttctttactccggagtagcctcgactcacccgcaaagtttggcctccctagaaccaccaccaccacctagggctcagtacattctggcggcggatagaccgaccggtcatattttggccgagagaagggcggagaattttatgaatatctcgaggcaaagagggaacatatttcttggcggtgttgaagctgtaccgtcgaactcgaccctgttgtcttcagccactgaatcaataccagcgactcacggcaccgagagtcgagcaacagtcactggcggagtatctcgtacttttgcagttcctggtcttggtccgaggggaaaggcggtggcgattgagacggcgggaacacaatcttgggggttgtgcaaggccgaaacagagccggttcagagacaaccagcgacggagacggatatcaccgatgaacggaagagaaaaacgagagaggaaacaaatgtcgaaaaccagggaactgaagaagctcgtgattcgacgtctagtaagaggtcacgagctgcaataatgcataaactctccgaaaggagacggagacaaaagattaacgagatgatgaaggctttgcaagaactccttcctcgctgcacaaagactgatagatcttccatgctggatgatgttatagagtacgtgaaatctctacagagccaaatacaggatgttctcaatgggacatgttatgattccaccgatgatgtatgcggggaatatacaacaacagtacatgccccacatggccatgggtatgaatcggcctcctgcattcatacctttccctaggcaggctcatatggcggaaggtgtaggtcctgttgatttatttagagagaatgaagaaacagagcaagagacaatgtctcttctccttagagaagacaaaagaacaaaacagaaaatgttttcttgaactgaaacttgttagttcttttattaagacaagacacactcttatatacatgttcacataactactctacgttggtaacagttgtaacttctccagc

SEQ ID NO: 1104 - protein, 371 aa, Arabidopsis thaliana
  G1650,HLH/MYC domain coordinates 274-331
MTWKPKMLILSHDLISPEKYIMGEDDIVELLGKSSQVVTSSQTQTPSCDPPLILRGSGSGDGEGNGPLPQPPPPLYHQQSLFIQEDEMASWLHQPNRQDYLYSQLLYSGVASTHPQSLASLEPPPPPRAQYILAADRPTGHILAERRAENFMNISRQRGNIFLGGVEAVPSNSTLLSSATESIPATHGTESRATVTGGVSRTFAVPGLGPRGKAVAIETAGTQSWGLCKAETEPVQRQPATETDITDERKRKTREETNVENQGTEEARDSTSSKRSRAAIMHKLSERRRRQKINEMMKALQELLPRCTKTDRSSMLDDVIEYVKSLQSQIQDVLNGTCYDSTDDVCGEYTTTVHAPHGHGYESASCIHTFP

SEQ ID NO: 1105 - DNA, 1387 bp, Arabidopsis thaliana
  G1652,family:HLH/MYC
agcaagtccaaatctccctctctctctctctatctatctctctatagaagattttttaactaagaagctagcgatcatggccacagcgatgaacgttttctctaccaaatggtcctccgaattggatatagaagaatatagtatcatccaccaattccacatgaactcactcgtcggagatgttccacagtctctctcatctcttgatgataccaccacttgttataaccttgatgcttcttgtaataaaagtttggtagaagaaagaccttcaaagatcctcaagaccactcacatatcaccaaacttacatcctttttcttcttctaatcctcctcctccaaagcaccagccctcttctaggattctttcttttgaaaagacaggtttacatgttatgaatcacaactctccaaacttaatatttagccccaaggacgaagaaattggattaccagagcataagaaagccgagctgataataagagggacaaagagagctcaatccttgactcgaagccaatcaaatgctcaagatcacatactggcagagagaaaacggagagagaagcttactcaaagatttgtagctctttccgcgctaattcctggcctaaagaagatggacaaggcttctgtgttgggagatgcaataaagcatataaagtacctccaagagagtgtgaaagagtatgaggaacaaaagaaggaaaagacaatggaatcagtggttcttgtaaagaagtctagtctggttttagatgaaaatcatcaaccatcatcatcatcttcctcagatggaaatcgcaatagctcgagctcaaatcttccagaaatagaagttagggtttcaggaaaagatgttcttattaagatcctatgcgagaagcaaaagggtaatgtgatcaagattatgggggagattgaaaagcttggtttgtctatcaccaacagcaatgtcttgccctttggacccacttttgacatctctattatcgctcagaagaataacaattttgatatgaaaatcgaggatgttgtgaagaacttgagttttggcttatcaaagctcacttaattggtttcacgttacatacatatacacattcatcatcgatttctccgatcgaagaatccaaaatcagtttttccatgaaagtggttttttagttgttaagtttgttgtatggagattcttaagtcatttaaagatccttgttcttgtgttgttaagtgtgctttaagatgcatatcatcaaatgtttagtaattatttctctccagtttcatttgggacggaatttttttcgcagttgttggatatatatttcctgcgatgtaaagcatttcgttagtttaataaacgtccgatatgtttctttgaaaa

SEQ ID NO: 1106 - protein, 333 aa, Arabidopsis thaliana
  G1652,HLH/MYC domain coordinates 147-204
MATAMNVFSTKWSSELDIEEYSIIHQFHMNSLVGDVPQSLSSLDDTTTCYNLDASCNKSLVEERPSKILKTTHISPNLHPFSSSNPPPPKHQPSSRILSFEKTGLHVMNHNSPNLIFSPKDEEIGLPEHKKAELIIRGTKRAQSLTRSQSNAQDHILAERKRREKLTQRFVALSALIPGLKKMDKASVLGDAIKHIKYLQESVKEYEEQKKEKTMESVVLVKKSSLVLDENHQPSSSSSSDGNRNSSSSNLPEIEVRVSGKDVLIKILCEKQKGNVIKIMGEIEKLGLSITNSNVLPFGPTFDISIIAQKNNNFDMKIEDVVKNLSFGLSKLT

SEQ ID NO: 1107 - DNA, 871 bp, Arabidopsis thaliana
  G1655,family:HLH/MYC
tttctaactagtcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgttaattagcttttcttttacctttttacccctttattttggcttcaagtgttttttttttctcgtcgacgcgattttaatttattaaattca

SEQ ID NO: 1108 - protein, 207 aa, Arabidopsis thaliana
  G1655,HLH/MYC domain coordinates 129-186
MVESLFPSIENTGESSRRKKPRISETAEAEIEARRVNEESLKRWKTNRVQQIYACKLVEALRRVRQRSSTTSNNETDKLVSGAAREIRDTADRVLAASARGTTRWSRAILASRVRAKLKKHRKAKKSTGNCKSRKGLTETNRIKLPAVERKLKILGRLVPGCRKVSVPNLLDEATDYIAALEMQVRAMEALAELLTAAAPRTTLTGT

SEQ ID NO: 1109 - DNA, 1721 bp, Arabidopsis thaliana
  G1660,family:DBP
aaagaaaagagagaagctttgagaaagaaagaaagaaagacacagtgtgtatcaatctctgtactttcacaagcttccaagctctcttatcattcactgatttttggttctcgagaaaaaagtgaagatttttgagattctctttcgatggattacgaacgaatcggaaagacccaggttactagtagcggcggcggattttctccggggaagttaaggagtatgcttcttctaggtgttgatagaaagaagaatgaagaagaagaatcaactcctacaatgagatctgggtctaatcaaattgatgaccctagggtttatgttgctagtggattagatgattgcaaagatgttgatgttgtgagtgagattactgattgttctacttcagggatagctagatcgattagtttgggtcttcaagagtattctgattatgataatgtgaatgagatcaagagtgtttctgcatcatctgtctttgagtttcaaaagactgagaaggaaaaagttaatcaaagaatgcctattagatcattctctaaaccagctccatctaaatgggatgatgctcagaaatggattgctagtcctacggctaaccgaccgaagactggacaggttcaggttccgggttcgaagaaagggcctagctttggtcgtcagtcttctatgaagattgttgaagttgctgaacatagagtggttgaagagcctgatacaaagagaatagatgtaagccaagtgaaaaaggatatgggaaacaagtttggtagctgggaagttgattcgtacactaccgtggattcatatgtcaaaccggttcttatggttgagaactctattgtagaatcagcaactgaagttaatctcagccgtcatgactcgtcagtcgcaactgcgtttgctcaaccgccttcaacggcaaggtctgtgtcaatgagagacatgggaactgaaatgactcctatagcgagccaagaaccttctagaaacgggacaccgattagggcaacaacgccaatacgaagtcctatatcttctgaaccttcaagtccaggcagacaagcatcagcttctcctatgagtaacaaggaactgtcagagaaagagcttcaaatgaaaactaggagagagataatggtgttgggtactcaacttggtaaatttaacattgctgcttgggctagcaaggaggatgaagataaagacgcatccacatcattaaagaccaaagcttctctacaaacttctaaaagtgtttctgaagctcgtgctacagcgtgggaggaagcggaaaaagctaagcacatggctaggttcagacgcgaagagatgaagattcaagcatgggagaatcatcagaaggcgaaatctgaagccgagatgaagaaaaccgaggttaaagttgagaggattaagggacgagcacaagaccggttgatgaagaaactcgctacaatcgagcgcaaagcagaggaaaagcgagcagcggctgaagcaaagaaggatcatcaggcagctaaaacagagaaacaagctgaacaaatccgaagaacaggcaaagtaccttcattgttgttctcttgctttagcttttgttcttaaatccaatcctattgtgaatgtgatgttgttaattctcaagaacacatctttctatcatcatttgtataataaaagctttgaaaaacttatttcttgtgatcttttagaaaaaa

SEQ ID NO: 1110 - protein, 486 aa, Arabidopsis thaliana
  G1660,DBP domain coordinates 362-476
MDYERIGKTQVTSSGGGFSPGKLRSMLLLGVDRKKNEEEESTPTMRSGSNQIDDPRVYVASGLDDCKDVDVVSEITDCSTSGIARSISLGLQEYSDYDNVNEIKSVSASSVFEFQKTEKEKVNQRMPIRSFSKPAPSKWDDAQKWIASPTANRPKTGQVQVPGSKKGPSFGRQSSMKIVEVAEHRVVEEPDTKRIDVSQVKKDMGNKFGSWEVDSYTTVDSYVKPVLMVENSIVESATEVNLSRHDSSVATAFAQPPSTARSVSMRDMGTEMTPIASQEPSRNGTPIRATTPIRSPISSEPSSPGRQASASPMSNKELSEKELQMKTRREIMVLGTQLGKFNIAAWASKEDEDKDASTSLKTKASLQTSKSVSEARATAWEEAEKAKHMARFRREEMKIQAWENHQKAKSEAEMKKTEVKVERIKGRAQDRLMKKLATIERKAEEKRAAAEAKKDHQAAKTEKQAEQIRRTGKVPSLLFSCFSFCS

SEQ ID NO: 1111 - DNA, 1946 bp, Arabidopsis thaliana
  G1662,family:DBP
atcatccttttcatcttcaaaagctttttccttttaaaatcattttcttaaacaagtggtatcaacgcagagtacgagttcatttttttcaagttttaattctgaaactcagagctggttctctgttttgatcacatggttttgttcagaacataactcttgttccaccaggacaataaataccatcttctgatcacacgtcatctttccatattcaagaaaacttcattttccatcggaagattcgtttaggagagaaaatggaaagtggcttttattcagattggaaagatacttcttcttcttcgttctttggatcagagaatatggaggaagagttggaagatggagttcttagagctgaagagcttttctcatcgattcctcaacctcagacacctaaagagccaatggagtttctgtctagatcctggagtctctctacttctgaaatctccaaagcacttgctctcaaacatagacaacaacaagatcagttttgtgttggccagaacagtcctcctgttttgttccctgatgctgctgcagatccactcgtggctgggaagatcatgaactctgttggcacacgtagagcagggacattgtctaaatggtttcaccacaacaaggaacacagcaccagcagtactactaccaatctcaagaagaaagataaagtgcgtgtggagaacgcccacgtgcattctgccgtctctatagcggctctggctgcaggtttagcctctgtgacatctgctagcaattgcaaagggtcaggctccaagatggcactggctttagcctcagccactgaactgttggcctcacactgtgttgagatggctgagcgagccggtgctgaccatgcacgtgttacttccacggttagatcttctgtggatatccacagccccggtgatctcatgactctaacagccgctgctgcaactgctttgagaggagaagcggctctgaaggcgaggcagccaaaggaagcaaggaaaaatgcagctattaccccttttgagagaagtttctctgattctcattggcatgcaaattttcagtatagattggaagaaccaaatcttccatttgaaggcgaactgatgcaatgtgcacgaaatggagtgcagcgaactaagcgtgtctgtgtctatatcaacaagaagtctcaggtaatgatcaaactcaaaagcaaacatgttggaggggcattctctaagaaaatcaaatgcgttgtctatggagtctgcgatgagaaatcagcttggccttacaggaaagagagggaaaattcagaagaagtctacttcggtctgaaaaccggacaaggtcttttggagttcaagtgcaagagcaagattcacaagcagagatgggttgatggggttcagtctcttctccgccaagtaaattgctttgaggctgccaaatgctcgctgggatctctgaatctcactggtcacacgtgatgcaggatcctgtatatatttgattatattcatatatataatatccaaatttttgctgttgtgaggtatttgcaaaacctggcaatgtaacctcagaagacttttggataaaacaaagcaggttgttcaaatgatcacaacaagtgttaggaacattgctatgtacagaaagacatcagaagaatgatgaatctcaattgaactttttatttccaatgattcagtttctatgaagagtcaaaaaattgtagagaagtggtatgtatatttttgtttgagtgagaagttcatatgaagaatcacgtgagagacatgtcagagatattcatatagaccgtattagaatacgacagtcctttgtgtcccataaggcaatactcgcagttcgcagtaagattttatagctttcatgagacactttttctcaaggtcctctgatttctggacaaagctcctcaaattgtctcg

SEQ ID NO: 1112 - protein, 405 aa, Arabidopsis thaliana
  G1662,DBP domain coordinates 44-69,295-330
MESGFYSDWKDTSSSSFFGSENMEEELEDGVLRAEELFSSIPQPQTPKEPMEFLSRSWSLSTSEISKALALKHRQQQDQFCVGQNSPPVLFPDAAADPLVAGKIMNSVGTRRAGTLSKWFHHNKEHSTSSTTTNLKKKDKVRVENAHVHSAVSIAALAAGLASVTSASNCKGSGSKMALALASATELLASHCVEMAERAGADHARVTSTVRSSVDIHSPGDLMTLTAAAATALRGEAALKARQPKEARKNAAITPFERSFSDSHWHANFQYRLEEPNLPFEGELMQCARNGVQRTKRVCVYINKKSQVMIKLKSKHVGGAFSKKIKCVVYGVCDEKSAWPYRKERENSEEVYFGLKTGQGLLEFKCKSKIHKQRWVDGVQSLLRQVNCFEAAKCSLGSLNLTGHT

SEQ ID NO: 1113 - DNA, 1891 bp, Arabidopsis thaliana
  G1666,family:HLH/MYC
catcatgagcgtatgagagtaaattcttctcacatattaataacaacccttcaaagttataagatttttagagagagagctaccacgttttcgtatctccgggaacgatggatgaatcaagtattattccggcagagaaagtggccggagctgagaaaaaagagcttcaagggctgcttaagacggcggttcaatctgtggactggacttatagtgtcttctggcaattttgtcctcaacaacgggtcttggtgtgggggaatggatactacaacggtgcaataaagacgaggaagacaactcaaccagcggaggtgacggcagaagaggcggcgttagagaggagccaacagctcagggagctttatgagacacttttagccggagagtcaacgtcagaagcaagagcatgcaccgcattgtcaccggaggatttgacggagacagaatggttttatctaatgtgcgtctctttctcttttcctcctccatctgggatgccaggaaaagcgtatgcaaggaggaagcacgtatggctaagtggtgcaaatgaagttgacagtaaaactttttctagagctattctcgctaagagtgctaaaattcagacagtggtttgcattccaatgcttgatggtgttgtggaactaggcacaacgaaaaaggtaagagaagatgtagagtttgttgagctcacaaagagtttcttctatgaccactgcaagacgaacccaaagccggctctttctgaacactccacctacgaagtgcatgaagaagccgaagacgaagaagaagtagaagaagagatgacaatgtcagaggaaatgaggcttggctctcctgatgatgaagatgtttccaatcaaaatctacactctgatcttcatattgaatcaacccatacgttagacacacatatggacatgatgaatctaatggaggaaggtggaaactattctcagacagtaacaacacttctcatgtcacaccccacaagtcttctttcagattcagtttccacatcttcttacatccaatcatcgtttgccacgtggagggttgagaatggcaaagagcatcagcaagtgaaaacggcgccgtcgtcacaatgggtgctcaaacaaatgatcttcagagttcctttcctccatgacaacactaaagataagaggctaccgcgggaagatctgagccacgtagtagcagagcgacgcaggagggagaagctgaacgagaaattcataacgttgagatcaatggttccatttgtgaccaagatggataaagtctcaatccttggagacaccattgcgtacgtaaatcatcttcgaaagagggtccatgagcttgagaatactcatcatgagcaacagcataagcggacgcgtacttgtaagagaaaaacatcggaggaggtggaggtttccatcatagagaatgatgttttgttagagatgagatgtgagtaccgagatggtttgttgcttgacattcttcaggttcttcatgagcttggtatagagactacggcagttcatacctcggtgaacgaccatgatttcgaggcggagataagggcgaaagtaagagggaagaaagcaagcatcgctgaggtcaaaagagccatccaccaagtcataatacatgatactaatctatagaccctaactttattgatgccaactctagagaaggataattaagcgtatttttgttttagcctcacatgtattaagacatcagttacatatatagccggatgcaacatataaatgaaaatgtactagatgatattgttcatttgtccaatgtagtacttgtgtatgatgcaattgcaacatataaatgcaaatgtactagatgacgatgttgttcgttgtccaattta

SEQ ID NO: 1114 - protein, 518 aa, Arabidopsis thaliana
  G1666,HLH/MYC domain coordinates 356-413
MDESSIIPAEKVAGAEKKELQGLLKTAVQSVDWTYSVFWQFCPQQRVLVWGNGYYNGAIKTRKTTQPAEVTAEEAALERSQQLRELYETLLAGESTSEARACTALSPEDLTETEWFYLMCVSFSFPPPSGMPGKAYARRKHVWLSGANEVDSKTFSRAILAKSAKIQTVVCIPMLDGVVELGTTKKVREDVEFVELTKSFFYDHCKTNPKPALSEHSTYEVHEEAEDEEEVEEEMTMSEEMRLGSPDDEDVSNQNLHSDLHIESTHTLDTHMDMMNLMEEGGNYSQTVTTLLMSHPTSLLSDSVSTSSYIQSSFATWRVENGKEHQQVKTAPSSQWVLKQMIFRVPFLHDNTKDKRLPREDLSHVVAERRRREKLNEKFITLRSMVPFVTKMDKVSILGDTIAYVNHLRKRVHELENTHHEQQHKRTRTCKRKTSEEVEVSIIENDVLLEMRCEYRDGLLLDILQVLHELGIETTAVHTSVNDHDFEAEIRAKVRGKKASIAEVKRAIHQVIIHDTNL

SEQ ID NO: 1115 - DNA, 938 bp, Arabidopsis thaliana
  G1667,family:AT-hook
tcgacccatccctactcctcacaatcattcttttggtgtctctaccatttaataattcaccaaaatctccttacttaaactcacaaactcctcacaaattttctgaatctttcagttgaacatataacaacattcataacaatggctggaggtacagctctaactccaacctctgtaggatccaagtctgttccaatgaggaaccatgaagcaacagagagaggcaacaccaacaacaacctgagagcattacccaaagccgtccaaccggtttcatcaatcgaaggagagatggctaagaggccacgtggcagacccgctggctccaagaacaaacccaaaccaccaatcattgtgactcacgacagtccaaattccctcagagctaacgccgttgagatcagctcaggttgtgacatctgtgagactttatcggattttgcaagaaggaaacagagaggtctctgcattctcagtgccaatggttgtgtcaccaatgtgacattaaggcaaccagcttcatcaggagcaattgtcacattacacggacgttacgagatcctctcattgcttggatcaatcttgcctccaccagcaccacttggaataactggtctgaccatttacttagccggacctcaaggacaggttgttggtggaggagtggttggtgggctaatcgcatctggtcctgttgttctcatggctgcatctttcatgaatgctgtttttgatcgtcttcctatggatgatgatgaagctgcctctatgcagaaccagcagtactaccagaatggaagatcccgtcctttagatgacattcatggactgcctcaaaatctgctcactaatggaaactcggcttctgatatctactcttgggggccttggaatcaaagataaatgtgtctgtaggttgagagagaaccgtaagtctg

SEQ ID NO: 1116 - protein, 253 aa, Arabidopsis thaliana
  G1667,At-hook amino acids 53-61,2nd cons. domain 61-204,DUF296 80-197
MAGGTALTPTSVGSKSVPMRNHEATERGNTNNNLRALPKAVQPVSSIEGEMAKRPRGRPAGSKNKPKPPIIVTHDSPNSLRANAVEISSGCDICETLSDFARRKQRGLCILSANGCVTNVTLRQPASSGAIVTLHGRYEILSLLGSILPPPAPLGITGLTIYLAGPQGQVVGGGVVGGLIASGPVVLMAASFMNAVFDRLPMDDDEAASMQNQQYYQNGRSRPLDDIHGLPQNLLTNGNSASDIYSWGPWNQR

SEQ ID NO: 1117 - DNA, 1537 bp, Arabidopsis thaliana
  G1672,family:NAC
gatcactcccgtctttatcaaattcttcttcctcttacattttccctatccaatcgatctcacgcagatctgatcaatttctcatcaaatcatttagagatcaaaagaaaactatgaagaatagtaaatgtaacctcatagattcaaagctcgaagaacatcatcatctttgcggatcaaaacattgtcctggatgtggtcgcatgattcaagctgctactaaaccaaattgggttggattgccggcaggagtgaaattcgatccgacagatcaagaacttatagaacatttagaagcaaaagtgaagggaaaagaagaaaataagaaatggtcgtcgtctcatccacttatagatgaatttattcccaccattgatggagaagatggaatatgttacactcatcctcagaagcttccaggggtgacaagagatggcttgagcaaacacttcttccacaaaccatcaagagcttacacaaccggaacaagaaaacgacgtaaaataattcaaaccgatcacgactctgagttaaccggatcatcagaaaccaggtggcacaaaacgggcaaaacaagaccggttatgatcaacggtcaacaaagaggatgcaagaagatattagtactctacacaaacttcggcaagaatcgtcgaccggagaaaacaaattgggtgatgcatcaatatcatttagggattaatgaggaagagagagaaggagaacttgtggtctccaagatattttatcagacacaaccaagacagtgtgttagtaatactaattggtctgatcaccatggttccaaggacgtgatcggaattggtgtcggagatgagatttccagcgtagctgccacgttgcagagtcttggctccggtgacgtcgtttctagggttaatatgcatccccatacaagatcctttgatgaggggacagccgaagcttcaaagggaagagagaaccagcatgtgtctggcacgtgcgaggaagtacatgatgggatcataacatcatcaatgtcatctcatcatatgattcatgatcatcataatcaacatcatcaaatcggagatagaagagaatttcacatgtcatcatcatatcccatgacccctactatcacatcacaacatgagtcaatcttccatgttacaagtactatgccctttcagcggcagcaattaaggggtcggtcgtctggttcgggattagaagacctaattatgggttgtaccacagctacgtgtacagaagacaataatcacaaatgattaaattcgcaggagcattcagaagcaaaccctcagcgaaatgcagagtggttaacgtttccacaattctggaaccaagccgaatcagatgatcaaaaccgaagattttaacagaaccaaaaggaagcagagaaatcttgcaaaaagctcctgcttagctgttgatcaatgccggaaatgctgagctatgactgactagtctctgccatttaacttacaatatcaccagaggttgcgatgaatgttgattcgctcaaaggaga

SEQ ID NO: 1118 - protein, 386 aa, Arabidopsis thaliana
  G1672,NAC domain coordinates 41-194
MKNSKCNLIDSKLEEHHHLCGSKHCPGCGRMIQAATKPNWVGLPAGVKFDPTDQELIEHLEAKVKGKEENKKWSSSHPLIDEFIPTIDGEDGICYTHPQKLPGVTRDGLSKHFFHKPSRAYTTGTRKRRKIIQTDHDSELTGSSETRWHKTGKTRPVMINGQQRGCKKILVLYTNFGKNRRPEKTNWVMHQYHLGINEEEREGELVVSKIFYQTQPRQCVSNTNWSDHHGSKDVIGIGVGDEISSVAATLQSLGSGDVVSRVNMHPHTRSFDEGTAEASKGRENQHVSGTCEEVHDGIITSSMSSHHMIHDHHNQHHQIGDRREFHMSSSYPMTPTITSQHESIFHVTSTMPFQRQQLRGRSSGSGLEDLIMGCTTATCTEDNNHK

SEQ ID NO: 1119 - DNA, 1130 bp, Arabidopsis thaliana
  G1677,family:NAC
cagtactaattctgtgtgtgttaatggttctagttatggatgatgaagagagtaacaacgttgaaagatatgacgacgtcgtattgccagggtttaggttccatcccactgatgaagaactcgtaagtttctacttgaaacggaaggttttacacaaatctcttccctttgatctcatcaagaaagtcgacatttacaaatacgatccatgggacctcccaaagcttgcagcgatgggggaaaaagagtggtacttttattgtcctagagacaggaaataccgcaacagcacaagacctaaccgagtaactggaggtggcttctggaaagcaaccggaacagaccggcctatatactcattggactccactcgatgcatcggtttgaagaaatcacttgtgttctaccgtggtcgagctgctaaaggagtcaaaaccgattggatgatgcatgaatttcgtctcccttctctctctgactctcatcactcatcatatcccaattacaataacaagaagcaacaccttaacaataacaacaacagcaaggagcttccttcaaacgatgcttgggcgatatgtagaatatttaagaagacaaatgcagtatcctcacaaagatcaatcccacaatcttgggtttatccaacgattcctgacaacaatcaacagtcacacaacaacaccgcaactctcttagcttcatcagacgttctcagccacatatcaacaagacaaaactttattccttctccagtcaacgaacccgcaagcttcacagaatcagctgcttcttacttcgcgtctcagatgctcggagtcacgtacaatacagccagaaacaacggaacaggggatgctctgtttctgagaaacaatggaacaggggatgctctggttctgagcaacaatgagaataactacttcaacaacttgactggagggttgactcatgaggttccgaatgtaagatcaatggtgatggaggagactacggggagtgagatgtcggcgacgtcgtattccactaacaattaagatcatagtactattaacacttgaattagtgtagacgttgatcatcgctaatatgtattaatttttcttgtcttactataaacgaaaaaaaaa

SEQ ID NO: 1120 - protein, 337 aa, Arabidopsis thaliana
  G1677,NAC domain coordinates 17-181
MVLVMDDEESNNVERYDDVVLPGFRFHPTDEELVSFYLKRKVLHKSLPFDLIKKVDIYKYDPWDLPKLAAMGEKEWYFYCPRDRKYRNSTRPNRVTGGGFWKATGTDRPIYSLDSTRCIGLKKSLVFYRGRAAKGVKTDWMMHEFRLPSLSDSHHSSYPNYNNKKQHLNNNNNSKELPSNDAWAICRIFKKTNAVSSQRSIPQSWVYPTIPDNNQQSHNNTATLLASSDVLSHISTRQNFIPSPVNEPASFTESAASYFASQMLGVTYNTARNNGTGDALFLRNNGTGDALVLSNNENNYFNNLTGGLTHEVPNVRSMVMEETTGSEMSATSYSTNN

SEQ ID NO: 1121 - DNA, 711 bp, Arabidopsis thaliana
  G1700,family:RING/C3H2C3
atgtcttacagtgacccaaaccaaaacccgattccagaaacttacgctccatcaaactcaactgaatcagagaaactgaaactttaccaagcttttatcttctctgttccaatctgtttcacattcatcgttctcttcgttctttacgtcatttaccttcgtcgaaacagcaccaccaatgttgattggtcttctcttggcatgcgtggtggtacctttgtccccaccaacaacaatctctcaacggctgaattaggactgagcaaagatattagagagatgcttcctgttgtcatctacaaggagagtttcatagtcaaagattcacaatgttcagtgtgtcttggggactaccaagcagaagagaaactccaacaaatgccatcatgtgggcacacttttcacatggaatgtattgatctatggctcacatcacacacaacatgccctctttgtcgtctctctcttatccccaaaccgtccctagacctgtcccatcaaagcacagagattgtctcttccatagaaaactctaatggaggagaagcttcaactcaaccagattcccagtcagcaaccgaagcaataagtcacaccgatgatgtcgaagaaggtaaccgagatagtcaagaggtctctaaggagacggaagagaatgaccgaaacagcgtagggacatctgatggttgttgtacttgtagacttggttaa

SEQ ID NO: 1122 - protein, 236 aa, Arabidopsis thaliana
  G1700,RING/C3H2C3 domain coordinates 93-134
MSYSDPNQNPIPETYAPSNSTESEKLKLYQAFIFSVPICFTFIVLFVLYVIYLRRNSTTNVDWSSLGMRGGTFVPTNNNLSTAELGLSKDIREMLPVVIYKESFIVKDSQCSVCLGDYQAEEKLQQMPSCGHTFHMECIDLWLTSHTTCPLCRLSLIPKPSLDLSHQSTEIVSSIENSNGGEASTQPDSQSATEAISHTDDVEEGNRDSQEVSKETEENDRNSVGTSDGCCTCRLG

SEQ ID NO: 1123 - DNA, 1221 bp, Arabidopsis thaliana
  G1706,family:RING/C3H2C3
atgaaaaataaaacccaaaaatatatagataagaagacgtggaactatataaatatggaccaccatcacgcctttgcatcacattcatacaactcagttttcataagcaaaaaggcaatggaagagtcacgatcctacagaaaggagaggaagcagacaaagaagaaaacgggtcgtgggtcaggatccaggtcgatccatataaagatgaggaagcttcgagtgcttataccgggtggacgaagattgaaccaaccggatctgcttctatcaaagactgctgattatattatgcatttggagttgaggattagcattctacatttgttggtcagatattacttaaagaagaaaagatcaaacctttcgtcatcaccaaacgaatctaatcaaaacccagaattttccgactccgatacttaccaaagacagcttcaacagctctttcatctccatgattcaggtctagatcaagctttaatcgatgctcttcctgtgtttctttacaaagagatcaaaggtacgaaagagccttttgattgtgcagtgtgtctctgtgaattctcggaagatgataagcttagattgcttccgaattgtagtcacgcttttcacatagattgtatcgatacttggcttctctcgaattcgacttgtccactttgtagaggaacccttttctctttaggtcatcaatttgaataccctgatttcaatttcgggtttttcgccggagatgatggaggaggaggagttagggtttctccggttcagaaaccagctgagaatgagattgggaagagagtgttttcagtgaggcttggtaagtttaggagcagtaatattgtcaacaatggtgaagtagtagtaggaggaggaggagagacaagtagtagtagtcttgataatagaagatgtttctcaatggggtcttatcagtacatagtggctgaatcagatctggttgttgctttgtgtcctaataatgaaggattgaagaataataaggatgttgaagggaagaagattaatatgagaagtaaaggtgagagcttttctgtgtcaaagatttggcaatggtctaataagagatcaaagtttcctaataatcatccatcagagactaatcttgtggttggtggttcttcttcttcttcttcttatgtttgttctggatctgatgggttatcattgaatggaaggagatttcagggtccatga

SEQ ID NO: 1124 - protein, 406 aa, Arabidopsis thaliana
  G1706,RING/C3H2C3 domain coordinates 180-212
MKNKTQKYIDKKTWNYINMDHHHAFASHSYNSVFISKKAMEESRSYRKERKQTKKKTGRGSGSRSIHIKMRKLRVLIPGGRRLNQPDLLLSKTADYIMHLELRISILHLLVRYYLKKKRSNLSSSPNESNQNPEFSDSDTYQRQLQQLFHLHDSGLDQALIDALPVFLYKEIKGTKEPFDCAVCLCEFSEDDKLRLLPNCSHAFHIDCIDTWLLSNSTCPLCRGTLFSLGHQFEYPDFNFGFFAGDDGGGGVRVSPVQKPAENEIGKRVFSVRLGKFRSSNIVNNGEVVVGGGGETSSSSLDNRRCFSMGSYQYIVAESDLVVALCPNNEGLKNNKDVEGKKINMRSKGESFSVSKIWQWSNKRSKFPNNHPSETNLVVGGSSSSSSYVCSGSDGLSLNGRRFQGP

SEQ ID NO: 1125 - DNA, 642 bp, Arabidopsis thaliana
  G1718,family:RING/C3H2C3
gtttgtttgcgatggcgacagaacaagaagctgaagttggaacagagacatcctctgtttccggaaggtttttgaggaacagagatttatatctcttcttgccttttctcttaggcttctctgatcaagaatcatcaaacggagatgatgatgatgttgcttcatcgcgtgagagaatcattttagtcaacccttttacacaaggaatgattgtgctcgaaggctcatcaggaatgaatcctctgcttcgtagcttactggagtcacgtgaggaaggtcgtcctcctgcgtccaaggcttccatcgatgcgatgccgatcgttgagattgatggctgtgaaggagagtgtgtgatctgtttggaggagtggaagtccgaggagacggtgaaggagatgccgtgtaagcataggtttcacggtggatgtatagagaaatggttagggtttcatgggtcgtgtcctgtttgtaggtacgagatgcctgttgatggagatgagattgggaagaaaagaaacgatgggaatgagatttgggttaggttcagtttcaacgatggtcggagaattagagatttttctgcgcaggacggtggaaacagtgatggtgttgagtccgagaattaggatttacataagaagc

SEQ ID NO: 1126 - protein, 204 aa, Arabidopsis thaliana
  G1718,RING/C3H2C3 domain coordinates 113-153
MATEQEAEVGTETSSVSGRFLRNRDLYLFLPFLLGFSDQESSNGDDDDVASSRERIILVNPFTQGMIVLEGSSGMNPLLRSLLESREEGRPPASKASIDAMPIVEIDGCEGECVICLEEWKSEETVKEMPCKHRFHGGCIEKWLGFHGSCPVCRYEMPVDGDEIGKKRNDGNEIWVRFSFNDGRRIRDFSAQDGGNSDGVESEN

SEQ ID NO: 1127 - DNA, 869 bp, Arabidopsis thaliana
  G1730,family:RING/C3H2C3
gcaatctacgaaactggtagcaatctgggggtttctctaatcatcaaccttcaaatgtcgtcaacaacatcaatagattcaataccagctactgctgttttccctagtgtttccatgcctgtcaccgtagttttgaccggtgttcttctctttgtaattttcgccggattcttctctcttttcttatggcagtttcttctgaatcgattatttactacttggaaccttcaacgaacaccttacggtgacctaatccatgtggccactccgcctgaaaatactggcctcgacccgtttatcatccggtcctttcctgtattccactattcatctgcaactaagaaaaatcatgggacggaatgcgctatttgcttgtcagagttttcagatgaagatacagttaggctcataacggtttgtcgtcatccctttcattcaaattgcattgatctttggtttgagttacacaagacttgtcctgtttgccggtgtgagttagatcctggcatgattggatctggaaggcttgaatcattccacaacacagtcacaattactattcaggacataaaccatgatgaggaaaatcctccaaccgctggttcaagcaaaaggctaatagaagcctcggcttggcgattctcgaggtcacattctactggacatttcatggttaagactacggatgctaatgtgaagtccaaaagaaggcattaccaaacaggaagctgtgtctcgttcgacgaacttactcggtatgaaggagcaggatggcaatggcttggtgattcatcacacattagcaggattgaagtatagtttactgaatttctgttacatcttcattattgtgttctttgtagcagtag

SEQ ID NO: 1128 - protein, 254 aa, Arabidopsis thaliana
  G1730,RING/C3H2C3 domain coordinates 103-144
MSSTTSIDSIPATAVFPSVSMPVTVVLTGVLLFVIFAGFFSLFLWQFLLNRLFTTWNLQRTPYGDLIHVATPPENTGLDPFIIRSFPVFHYSSATKKNHGTECAICLSEFSDEDTVRLITVCRHPFHSNCIDLWFELHKTCPVCRCELDPGMIGSGRLESFHNTVTITIQDINHDEENPPTAGSSKRLIEASAWRFSRSHSTGHFMVKTTDANVKSKRRHYQTGSCVSFDELTRYEGAGWQWLGDSSHISRIEV

SEQ ID NO: 1129 - DNA, 529 bp, Arabidopsis thaliana
  G1743,family:RING/C3H2C3
tttctccatgggctttcccgtaggttacacagaggttttcttaccgaagcttttcgtacaaacgctttcgattctcggattcatcagaaccatcgtcttctctatcttccgcttcttgggtctctcagattttctcgaaatggatcaaacctggcccgattacacatcgtacccgacccgaatacccgaaacccgctcacctttctccgcactcctaattagagagatcctaccggttatcaaattcgaagagttaacgaattccggcgaagatctaccggaaaactgcgccgtttgtctatacgaattcgaaggagaacaagagatccggtggctgagaaattgcagacatatatttcaccggagctgtcttgaccgttggatggatcatgatcagaagacgtgtccactttgtagaacaccgtttgttccagatgagatgcaagaagagtttaatcaacggctatgggctgcttctggtgttcatgattttcactgtcccgtgaccgaattattatagaagaagcca

SEQ ID NO: 1130 - protein, 170 aa, Arabidopsis thaliana
  G1743,RING/C3H2C3 domain coordinates 94-136
MGFPVGYTEVFLPKLFVQTLSILGFIRTIVFSIFRFLGLSDFLEMDQTWPDYTSYPTRIPETRSPFSALLIREILPVIKFEELTNSGEDLPENCAVCLYEFEGEQEIRWLRNCRHIFHRSCLDRWMDHDQKTCPLCRTPFVPDEMQEEFNQRLWAASGVHDFHCPVTELL

SEQ ID NO: 1131 - DNA, 755 bp, Arabidopsis thaliana
  G1749,family:AP2
caacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtgt

SEQ ID NO: 1132 - protein, 158 aa, Arabidopsis thaliana
  G1749,AP2 domain coordinates 84-152
MENSENVPSYDQNINFTPNLTRDQEHVIMVSALQQVISNVGGDTNSNAWEADLPPLNAGPCPLCSVTGCYGCVFPRHEAIIKKEKKHKGVRKKPSGKWAAEIWDPSLKVRRWLGTFPTAEMAAKAYNDAAAEFVGRRSARRGTKNGEEASTKKTTEKN

SEQ ID NO: 1133 - DNA, 1136 bp, Arabidopsis thaliana
  G1750,family:AP2
cccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaaccaaacaccggtttggttgc

SEQ ID NO: 1134 - protein, 335 aa, Arabidopsis thaliana
  G1750,AP2 domain coordinates 115-177
MMMDEFMDLRPVKYTEHKTVIRKYTKKSSMERKTSVRDSARLVRVSMTDRDATDSSSDEEEFLFPRRRVKRLINEIRVEPSSSSTGDVSASPTKDRKRINVDSTVQKPSVSGQNQKKYRGVRQRPWGKWAAEIRDPEQRRRIWLGTFATAEEAAIVYDNAAIKLRGPDALTNFTVQPEPEPVQEQEQEPESNMSVSISESMDDSQHLSSPTSVLNYQTYVSEEPIDSLIKPVKQEFLEPEQEPISWHLGEGNTNTNDDSFPLDITFLDNYFNESLPDISIFDQPMSPIQPTENDFFNDLMLFDSNAEEYYSSEIKEIGSSFNDLDDSLISDLLLV

SEQ ID NO: 1135 - DNA, 933 bp, Arabidopsis thaliana
  G1752,family:AP2
aaaaaaaaaaaaaaaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgataattaatcttgaaatttgttttgttcattctgcaatttctttggttctcttattttttgtttgttgtatccaaatgaaattattggaagagatggtgatgttaaagtgtatatatataaaaaaaaaa

SEQ ID NO: 1136 - protein, 243 aa, Arabidopsis thaliana
  G1752,AP2 domain coordinates 83-151
MEYSQSSMYSSPSSWSSSQESLLWNESCFLDQSSEPQAFFCPNYDYSDDFFSFESPEMMIKEEIQNGDVSNSEEEEKVGIDEERSYRGVRKRPWGKFAAEIRDSTRNGIRVWLGTFDKAEEAALAYDQAAFATKGSLATLNFPVEVVRESLKKMENVNLHDGGSPVMALKRKHSLRNRPRGKKRSSSSSSSSSNSSSCSSSSSTSSTSRSSSKQSVVKQESGTLVVFEDLGAEYLEQLLMSSC

SEQ ID NO: 1137 - DNA, 1089 bp, Arabidopsis thaliana
  G1753,family:AP2
acccaaaaaaacgcgatatccaacaagaggagcaattaaaaagctgtctttacagctttagcttcatcatctctaagctgtgatcaattcctcccaaaccattttctaactggtttgcactttcttcactctcttctcttcactcttcactacgtacttcactctccaactaacttaactgcaccataaaatggcttcgatctcttcctctccttcctcaaactcatcactcttctctactcaaaaccctaatactcattatcaatatgcaaggaacctccaaagacaatggcggccgccaccctttgtacaggggagtaaggcagcgaaagaactcaaacaaatgggtttctgagatccgtgagccgagaaaacctaaccgtatctggttaggaacattctctacccccgagatggcggcaatagcctatgacgtggcagctctagccctcaaaggcagtcaagctgagctcaacttcccaaactcagtttcctctttgcctgccccaacctccatgtctccagcagacatccaagcagcagccgcttcggccgctgctgcttttggtgctgctagggatgcgattgttatggcaaataataacagccaaacaagtggtgtggcttgcatgaatagtagttatgataatacaaatatgaatggattcatggacgaggatttggtattcgacatgcctaatgtgctcatgaatatggctgaaggaatgcttcttagcccccctcgtcctactgtctttgatgctgcttacgacgctgatggttttcctggaggagacgattacttgtggaattttccatgatagttaaacaaaccaaccatataaatatgtgattttgtgtgtttctatatatgtatgtatgaaataaataaatatggtgtctagtgatgcattgtatgcatggttaggcccgttaagaccgtaatataaggtcgtactgtattaagtttttgtctttaaattattctcaatttacaatcttatctagtctgatgtaatgccaaatgtaatgaatagtcaatgccttgactgatactcatttgtttattttacagatggatacaatttt

SEQ ID NO: 1138 - protein, 184 aa, Arabidopsis thaliana
  G1753,AP2 domain coordinates 12-80
MQGTSKDNGGRHPLYRGVRQRKNSNKWVSEIREPRKPNRIWLGTFSTPEMAAIAYDVAALALKGSQAELNFPNSVSSLPAPTSMSPADIQAAAASAAAAFGAARDAIVMANNNSQTSGVACMNSSYDNTNMNGFMDEDLVFDMPNVLMNMAEGMLLSPPRPTVFDAAYDADGFPGGDDYLWNFP

SEQ ID NO: 1139 - DNA, 773 bp, Arabidopsis thaliana
  G1755,family:AP2
acctttttttttctctgctaacgaaaaaagccatcttctttgctactactaatctactattacactgaatcgtttgggttcttcttcttcttcagctgctactttgttcgagtgattgctgacatgccgtcagcgtcggagattgttgacaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagactagaggattgtattgatgaatatgttctcctagatagttctagtgtattgttaatcgtagttgactattgtgaggtcttaagttgtagattgaaaatgagatagctcatatggagctttattgaaatgcaagaaagtaaacaaaaaaaaaaaaaaaaa

SEQ ID NO: 1140 - protein, 164 aa, Arabidopsis thaliana
  G1755,AP2 domain coordinates 71-133
MPSASEIVDRKRKSRGTRDVAEILRKWREYNEQTEADSCIDGGGSKPIRKAPPKRSRKGCMKGKGGPENGICDYTGVRQRTWGKWVAEIREPGRGAKLWLGTFSSSYEAALAYDEASKAIYGQSARLNLPLLPLCQARLLHFLMNLKFVHVRIQMQDLVLVRSD

SEQ ID NO: 1141 - DNA, 1031 bp, Arabidopsis thaliana
  G1756,family:WRKY
atatgtacttgtacaccaacccaccaaaagagataaaagaggaaacaaaaactcgaaaagagagagatatatgggtgaggtggcttatatggacgaaggagacctagaagcaatagtcagaggctactccggctccggagacgcgttttccggcgaaagttccggtacgttttcaccttcgttttgcctaccgatggagacgtctagtttctacgaaccggagatggagacaagtggcttagatgagctcggtgaactttacaaacccttttaccctttctccacacaaacgatcctcacaagctcggtctctctccctgaagattcaaaacctttccgagatgacaagaaacaacgatcacatggttgtcttttatccaacggatcaagagctgatcatatccgaatttcagaatccaaatcaaagaaaagcaagaagaatcaacagaagagagttgttgagcaagtgaaagaagagaatctgttgtcggacgcatgggcgtggcgtaaatacgggcagaaacccatcaaaggatctccatacccaaggagttattacagatgcagtagctcaaaagggtgtttggcaagaaaacaagtcgaaagaaatcctcaaaacccggagaaattcaccataacatacactaatgagcacaatcatgaactaccaacccggagaaactcattagccggttcgactcgagcaaaaacttcccaacccaaaccaaccttaaccaaaaaatccgaaaaagaagttgtttcttcccctacaagtaatcctatgatcccatccgctgatgaatcttctgttgcggttcaagaaatgagcgttgcggaaacgagtacgcaccaagcggctggagcaatcgagggccgccgcttgagtaacggtttaccatcggatttgatgtccgggagcggaacttttccaagttttaccggtgacttcgatgaactattgaatagccaagagttcttcagtgggtatttatggaattactagagagcattaggtgtatgtatatatatat

SEQ ID NO: 1142 - protein, 310 aa, Arabidopsis thaliana
  G1756,WRKY domain coordinates 138-200
MGEVAYMDEGDLEAIVRGYSGSGDAFSGESSGTFSPSFCLPMETSSFYEPEMETSGLDELGELYKPFYPFSTQTILTSSVSLPEDSKPFRDDKKQRSHGCLLSNGSRADHIRISESKSKKSKKNQQKRVVEQVKEENLLSDAWAWRKYGQKPIKGSPYPRSYYRCSSSKGCLARKQVERNPQNPEKFTITYTNEHNHELPTRRNSLAGSTRAKTSQPKPTLTKKSEKEVVSSPTSNPMIPSADESSVAVQEMSVAETSTHQAAGAIEGRRLSNGLPSDLMSGSGTFPSFTGDFDELLNSQEFFSGYLWNY

SEQ ID NO: 1143 - DNA, 896 bp, Arabidopsis thaliana
  G1758,family:WRKY
gtccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgtatatagatgtatatatatatatcaccaattcaccatcgtaatcacgtctcacatgtaactacgtacatatatcttgttcggggttcgttttgtaatgtattgaattggtggaggtagaatggaagtcatcttgtatagttgtacttgtatgtaaggtttgatagtcattttttataaagtaactaatttgtacaa

SEQ ID NO: 1144 - protein, 202 aa, Arabidopsis thaliana
  G1758,WRKY domain coordinates 109-165
MNYPSNPNPSSTDFTEFFKFDDFDDTFEKIMEEIGREDHSSSPTLSWSSSEKLVAAEITSPLQTSLATSPMSFEIGDKDEIKKRKRHKEDPIIHVFKTKSSIDEKVALDDGYKWRKYGKKPITGSPFPRHYHKCSSPDCNVKKKIERDTNNPDYILTTYEGRHNHPSPSVVYCDSDDFDLNSLNNWSFQTANTYSFSHSAPY

SEQ ID NO: 1145 - DNA, 943 bp, Arabidopsis thaliana
  G1759,family:MADS
cgagaaaaggaaaaaaaaaaatagaaagagaaaacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgagaaaaaaaaaaaaaaaa

SEQ ID NO: 1146 - protein, 196 aa, Arabidopsis thaliana
  G1759,MADS domain coordinates 2-57
MGRKKLEIKRIENKSSRQVTFSKRRNGLIEKARQLSVLCDASVALLVVSASGKLYSFSSGDNLVKILDRYGKQHADDLKALDHQSKALNYGSHYELLELVDSKLVGSNVKNVSIDALVQLEEHLETALSVTRAKKTELMLKLVENLKEKEKMLKEENQVLASQMENNHHVGAEAEMEMSPAGQISDNLPVTLPLLN

SEQ ID NO: 1147 - DNA, 920 bp, Arabidopsis thaliana
  G1765,family:NAC
aagaatgacttgattggtgttctaaagagatcgatgtagtgaagatgagtggcgaaggtaacttaggtaaggatcatgaagaagaaaacgaagcaccacttcctgggttcaggtttcatccgacggatgaagagcttttaggatactatcttcgaagaaaagtagagaacaaaaccatcaaactcgaacttatcaaacagatcgatatctataagtacgatccttgggatcttccaagagtgagcagcgtcggagaaaaggagtggtacttcttctgcatgagaggtaggaaatacaggaatagcgttcgaccaaaccgagtgaccggttcaggtttctggaaagccactggtattgataaaccggtttactccaatcttgactgtgttggtctcaagaaatctctggtttactatcttggttcagccggtaaaggcaccaaaaccgattggatgatgcatgaattccgcctcccctccaccacgaaaaccgactctccagctcaacaagcagaggtatggacactttgcagaatcttcaaacgagtcacatctcaaagaaacccaaccatcttaccaccaaaccgaaaaccggttatcactttaaccgacacttgttctaagaccagcagcttagattccgaccacacgagccaccgtacagtagattccatgtcccacgagccgccgcttccacagccacagaatccttattggaaccaacatatagttggttttaatcaaccgacatatactggtaatgataataacctcctgatgagtttctggaacggcaacggtggagatttcataggagactcagcaagttgggatgaacttagatctgttatagatggcaacactaaaccctagtaataaagtttccttttttcagctttgtacaaaaagataaaacaaacg

SEQ ID NO: 1148 - protein, 275 aa, Arabidopsis thaliana
  G1765,NAC domain coordinates 20-140
MSGEGNLGKDHEEENEAPLPGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHEFRLPSTTKTDSPAQQAEVWTLCRIFKRVTSQRNPTILPPNRKPVITLTDTCSKTSSLDSDHTSHRTVDSMSHEPPLPQPQNPYWNQHIVGFNQPTYTGNDNNLLMSFWNGNGGDFIGDSASWDELRSVIDGNTKP

SEQ ID NO: 1149 - DNA, 1596 bp, Arabidopsis thaliana
  G1767,family:SCR
atggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaa

SEQ ID NO: 1150 - protein, 531 aa, Arabidopsis thaliana
  G1767,SCR domain coordinates 225-290,355-450,453-528
MDTLFRLVSLQQQQQSDSIITNQSSLSRTSTTTTGSPQTAYHYNFPQNDVVEECFNFFMDEEDLSSSSSHHNHHNHNNPNTYYSPFTTPTQYHPATSSTPSSTAAAAALASPYSSSGHHNDPSAFSIPQTPPSFDFSANAKWADSVLLEAARAFSDKDTARAQQILWTLNELSSPYGDTEQKLASYFLQALFNRMTGSGERCYRTMVTAAATEKTCSFESTRKTVLKFQEVSPWATFGHVAANGAILEAVDGEAKIHIVDISSTFCTQWPTLLEALATRSDDTPHLRLTTVVVANKFVNDQTASHRMMKEIGNRMEKFARLMGVPFKFNIIHHVGDLSEFDLNELDVKPDEVLAINCVGAMHGIASRGSPRDAVISSFRRLRPRIVTVVEEEADLVGEEEGGFDDEFLRGFGECLRWFRVCFESWEESFPRTSNERLMLERAAGRAIVDLVACEPSDSTERRETARKWSRRMRNSGFGAVGYSDEVADDVRALLRRYKEGVWSMVQCPDAAGIFLCWRDQPVVWASAWRPT

SEQ ID NO: 1151 - DNA, 2026 bp, Arabidopsis thaliana
  G1772,family:RING/C3HC4
caccggaactgtgatctcaccggaatatccctcctttatttatcctctactcatccgttttactctctccctccgtcgatcttctctttctcttgatcgcctccgtccattctttatcatttcttaattcagaattgtgatcgatggatgattattttagcgcggaggaagaggcttgctattactcctccgatcaagattctttggatggaattgataatgaagagtctgaattgcagcctctgtcctctaaaagatcaaacactcaggtcatcactcaggaatcgcttctagcagcacagagagaagatttgctaagggtgatggaattgttatcaataaaggagcaccatgcacggactcttcttattcattaccagtgggatgtggagaagttgtttgctgtgtttgttgagaaaggaaaagatagcttgttttctggagctggtgtcactgtcttcgattatcaatatggcaactcttcctttcctcagtcttcacagatgagttgtgatgtttgcatggaggatttaccaggtgatcacatgacaagaatggactgtggccattgcttttgcaataattgttggacggagcattttactgtgcagataaatgaaggtcagagcaaaaggattagatgcatggctcatcaatgtaatgctatttgtgatgaagatattgtcaggagtctagtcagtaaaaagcgtccagatctagctgcgaagtttgatcgttaccttcttgagtcgtacatcgaagataacagaatggtcaagtggtgtcctagcactccgcattgtgggaatgctatacgagctgaggatgacaagttgtgcgaagttgaatgttcttgtggtcttcagttctgtttcagttgtctgtgtcaagcccactccccttgctcttgtttgatgtgggagttatggagaaagaagtgtcgagatgagtctgagacaatcaactggataaccgttcacacaaagctgtgtcccaaatgttacaaacctgtggaaaagaatggtggatgcaatctcgtgaggtgtatttgtgggcagtgtttttgttggctatgtggtggagctactggaagtgatcacacttataggagtatcgctggtcacagttgtggtcggtaccaagatgacaaagagaagcagatggaaagagcgaagagagatttaaacaggtatacgcattatcatcaccgatacaaagctcatacagattcatcaaagctagaagataaacttagggatactatccatgagaaagtgtcgaaatcagaaaagagggagttgaagcttaaagacttcagctgggtcaccaatggactcgaccggttattcagatcaaggcgagttctttcatattcgtatgcttttgcatattatatgtttggtgaagagatgtttaaagatgagatgacccctgaggagagagagataaagaagaatttgtttgaggatcagcagcaacaacttgaaagtaatgtggagaaactttcgcagttccttgaggagccctttgatgaatttagtaatgataaagttatggcgataaggattcaaatcatcaatttgtctgtcgccgtcgatacactctgcaagaaaatgtacgagtgcattgagaatgacttactcggatctctccaacttggcatccacaacatctcaccttacagatcgaagggaatcgaacaagcagctcagttttatgcttcctggaattccaaagatgctgacaaattccaacctttggatagtggtacaagcggagtgacatcgaggcctgagcaagcttcaggatcaaggagctcggaagacaccatttgctcatcttcacagaaacgtcccaaaaaagaaggaagtttcttaaacaacaaagtcactttattggatttgaacttgccagctgatttcgtcgaccagaactgaactcaaatcctctcttgcttagtccaaatgagatatgatgacatagcaaaaggtgtttgactatatatctatcaccttcaagactcgtg

SEQ ID NO: 1152 - protein, 597 aa, Arabidopsis thaliana
  G1772,RING/C3HC4 domain coordinates 123-176
MDDYFSAEEEACYYSSDQDSLDGIDNEESELQPLSSKRSNTQVITQESLLAAQREDLLRVMELLSIKEHHARTLLIHYQWDVEKLFAVFVEKGKDSLFSGAGVTVFDYQYGNSSFPQSSQMSCDVCMEDLPGDHMTRMDCGHCFCNNCWTEHFTVQINEGQSKRIRCMAHQCNAICDEDIVRSLVSKKRPDLAAKFDRYLLESYIEDNRMVKWCPSTPHCGNAIRAEDDKLCEVECSCGLQFCFSCLCQAHSPCSCLMWELWRKKCRDESETINWITVHTKLCPKCYKPVEKNGGCNLVRCICGQCFCWLCGGATGSDHTYRSIAGHSCGRYQDDKEKQMERAKRDLNRYTHYHHRYKAHTDSSKLEDKLRDTIHEKVSKSEKRELKLKDFSWVTNGLDRLFRSRRVLSYSYAFAYYMFGEEMFKDEMTPEEREIKKNLFEDQQQQLESNVEKLSQFLEEPFDEFSNDKVMAIRIQIINLSVAVDTLCKKMYECIENDLLGSLQLGIHNISPYRSKGIEQAAQFYASWNSKDADKFQPLDSGTSGVTSRPEQASGSRSSEDTICSSSQKRPKKEGSFLNNKVTLLDLNLPADFVDQN

SEQ ID NO: 1153 - DNA, 1299 bp, Arabidopsis thaliana
  G1773,family:RING/C3HC4
atgagttcttcagatcgtgacatcatcgatatcgaatcaggagaagaagatttgtatagcgatggtggtaacgacatcatcgatatcgaatcaggagaggaggatttgtacagcgatggtggtaacgtatccgatgactacaaccctgtggacgacacaattagtcgatctgagaaaagttacgttgttgttaaggaagaagacattcttaagcttcaaagagacgatatcgaacaagtttcgacggttctctctgtaagccaagtggaatcgattgttctgcttcttcactatcattggtgtgttagtaaactcgaagatgaatggtttacggacgaagagagaatccgtaaaaccgttggtatattaaaggagcctgtcgttgatgttaatggtacagaagtggatattcaatgtggaatttgctttgaatcatacactcgaaaggaaattgctagggtttcttgtggtcatccttattgcaagacctgctggactggttacatcactacgaaaatcgaagacggtccgggatgtttaagggttaaatgtcccgaaccttcttgttacgctgttgttggtcaagacatgatcgatgaggttactgagaagaaagataaggacaagtattatagatattttcttaggtcttatgtcgaagacgggaagaagatgaaatggtgtccatcaccgggatgcgaatacgcggttgaatttggtgtaaatggaagtagtagttacgatgtttcttgtttgtgttcgtataagttttgctggaattgctgtgaagacgctcactctcctgtggattgtgaaacagtgtcaaagtggttactaaagaacaaggatgagtcggagaacatgaattggatacttgctaagacaaagccttgtcctaaatgcaagcgtcctattgagaagaacactggatgtaaccatatgtcatgctcagctccatgtagacattatttttgttgggcatgccttcaaccattgagcgatcacaaggcttgcaacgcgtttaaagcagacaatgaggatgaaactaagagaaaaagggctaaagatgcgatcgatagatacacgcatttttatgaaagatgggcattcaatcaatcctcgaggcttaaagctatgagtgatttggagaaatggcaatcggtggagcttaagcagcttagtgacattcagagcacaccagaaactcagctcagtttcaccgtagatgcatggcttcaggttagtaaaagtaacatttacaagaccattgaaaatgtttgtggaaacgacggaacataa

SEQ ID NO: 1154 - protein, 432 aa, Arabidopsis thaliana
  G1773,RING/C3HC4 domain coordinates 139-184
MSSSDRDIIDIESGEEDLYSDGGNDIIDIESGEEDLYSDGGNVSDDYNPVDDTISRSEKSYVVVKEEDILKLQRDDIEQVSTVLSVSQVESIVLLLHYHWCVSKLEDEWFTDEERIRKTVGILKEPVVDVNGTEVDIQCGICFESYTRKEIARVSCGHPYCKTCWTGYITTKIEDGPGCLRVKCPEPSCYAVVGQDMIDEVTEKKDKDKYYRYFLRSYVEDGKKMKWCPSPGCEYAVEFGVNGSSSYDVSCLCSYKFCWNCCEDAHSPVDCETVSKWLLKNKDESENMNWILAKTKPCPKCKRPIEKNTGCNHMSCSAPCRHYFCWACLQPLSDHKACNAFKADNEDETKRKRAKDAIDRYTHFYERWAFNQSSRLKAMSDLEKWQSVELKQLSDIQSTPETQLSFTVDAWLQVSKSNIYKTIENVCGNDGT

SEQ ID NO: 1155 - DNA, 2006 bp, Arabidopsis thaliana
  G1777,family:RING/C3HC4
ctcgtactttatcacctccgtcgttctataatactctcttccgtcaatcatatcatttgtcgacaatttcattctgatcagtttaaaaattgatccatggatgataatttaagcggcgaggaagaagattactattactcctccgatcaggaatctctcaacgggattgataatgatgaatccgtttcgatacctgtttcttcccgatcaaatactgtcaaggttattacgaaggaatcacttttggctgcacagagggaggatttgcggagagtgatggaattgttatcggttaaggagcaccatgctcggactcttcttatacattaccgatgggatgtggagaagttgtttgctgttcttgttgagaaagggaaagatagcttgttttctggtgctggtgttacacttcttgaaaaccaaagttgtgattcttccgtttctggttcttcttcgatgatgagttgtgatatctgcgtagaggatgtaccgggttatcagctgacaaggatggactgtggccatagcttttgcaataactgttggactgggcattttactgtaaagataaatgaaggtcagagcaaaaggattatatgcatggctcataagtgtaatgctatttgtgatgaagatgttgtcagggctctagttagtaaaagccaaccagatttagctgagaagtttgatcgttttcttcttgagtcgtatatcgaagataacaaaatggtgaagtggtgtccgagtactcctcattgtgggaatgccatacgtgttgaggatgacgagctctgtgaggttgaatgctcttgtggtttgcagttctgtttcagttgttcatctcaagctcactccccttgctcttgtgtgatgtgggaactatggagaaagaagtgctttgatgagtccgagactgttaattggataactgttcacacaaagccgtgtcccaaatgtcacaagcctgttgaaaagaatggtggatgcaatctcgtgacttgtctttgtcgacaatctttttgttggttgtgtggtgaagctactggaagggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttca

SEQ ID NO: 1156 - protein, 593 aa, Arabidopsis thaliana
  G1777,RING/C3HC4 domain coordinates 124-247
MDDNLSGEEEDYYYSSDQESLNGIDNDESVSIPVSSRSNTVKVITKESLLAAQREDLRRVMELLSVKEHHARTLLIHYRWDVEKLFAVLVEKGKDSLFSGAGVTLLENQSCDSSVSGSSSMMSCDICVEDVPGYQLTRMDCGHSFCNNCWTGHFTVKINEGQSKRIICMAHKCNAICDEDVVRALVSKSQPDLAEKFDRFLLESYIEDNKMVKWCPSTPHCGNAIRVEDDELCEVECSCGLQFCFSCSSQAHSPCSCVMWELWRKKCFDESETVNWITVHTKPCPKCHKPVEKNGGCNLVTCLCRQSFCWLCGEATGRDHTWARISGHSCGRFQEDKEKQMERAKRDLKRYMHYHNRYKAHIDSSKLEAKLSNNISKKVSISEKRELQLKDFSWATNGLHRLFRSRRVLSYSYPFAFYMFGDELFKDEMSSEEREIKQNLFEDQQQQLEANVEKLSKFLEEPFDQFADDKVMQIRIQVINLSVAVDTLCENMYECIENDLLGSLQLGIHNITPYRSNGIERASDFYSSQNSKEAVGQSSDCGWTSRLDQALESGKSEDTSCSSGKRARIDESYRNSQTTLLDLNLPAEAIERK

SEQ ID NO: 1157 - DNA, 1059 bp, Arabidopsis thaliana
  G1779,family:GATA/Zn
atgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtga

SEQ ID NO: 1158 - protein, 352 aa, Arabidopsis thaliana
  G1779,GATA/Zn domain coordinates 190-239
MGSNFHYTIDLNEDQNHQPFFASLGSSLHHHLQQQQQQQQHFHHQASSNPSSLMSPSLSYFPFLINSRQDQVYVGYNNNTFHDVLDTHISQPLETKNFVSDGGSSSSDQMVPKKETRLKLTIKKKDNHQDQTDLPQSPIKDMTGTNSLKWISSKVRLMKKKKAIITTSDSSKQHTNNDQSSNLSNSERQNGYNNDCVIRICSDCNTTKTPLWRSGPRGPKSLCNACGIRQRKARRAAMATATATAVSGVSPPVMKKKMQNKNKISNGVYKILSPLPLKVNTCKRMITLEETALAEDLETQSNSTMLSSSDNIYFDDLALLLSKSSAYQQVFPQDEKEAAILLMALSHGMVHG

SEQ ID NO: 1159 - DNA, 757 bp, Arabidopsis thaliana
  G1781,family:CAAT
cgtcgaccagattgatcacatgtggttaacatcaatcaaaaaaaaaaacaaagagatagagatatgactgaggagagcccagaagaagatcatgggtctcctggagtagctgaaacaaatccaggaagcccttcttcaaagaccaacaacaacaacaacaacaacaaagaacaagaccggtttcttcccattgcgaatgtcggaaggatcatgaaaaaagttcttcccggtaacggtaagatctcaaaagacgctaaagaaaccgttcaagaatgtgtctcggagttcattagtttcgtcactggtgaagcttctgacaagtgtcaaagagaaaagaggaagaccatcaatggagatgatatcatttgggctatcacaactctcggtttcgaagactacgtggctccattaaaggtctacctctgcaaatatagagacaccgaaggagagaaagttaacagcccaaaacaacaacaacaaagacaacaacaacagcagattcaacaacagaatcatcataattatcagtttcaagaacaagaccaaaacaataacaacatgtcatgtactagttacatctctcatcatcatccttctccattcctaccagtggatcatcaaccttttcccaatattgctttctctcctaaatcattgcagaaacagttcccgcagcagcatgataataacattgattcaattcactggtgagagagacatttgcttgcgggccgctctaggcgggaaaagcccgaat

SEQ ID NO: 1160 - protein, 215 aa, Arabidopsis thaliana
  G1781,CAAT domain coordinates 35-124
MTEESPEEDHGSPGVAETNPGSPSSKTNNNNNNNKEQDRFLPIANVGRIMKKVLPGNGKISKDAKETVQECVSEFISFVTGEASDKCQREKRKTINGDDIIWAITTLGFEDYVAPLKVYLCKYRDTEGEKVNSPKQQQQRQQQQQIQQQNHHNYQFQEQDQNNNNMSCTSYISHHHPSPFLPVDHQPFPNIAFSPKSLQKQFPQQHDNNIDSIHW

SEQ ID NO: 1161 - DNA, 927 bp, Arabidopsis thaliana
  G1782,family:CAAT
atgcaagtgtttcaaaggaaagaagattcatcttggggaaactcaatgcctacaacaaattcaaatattcaaggatctgaatctttcagcttgactaaggatatgataatgtctacaacacaattacccgcgatgaaacattcgggtttgcagctgcaaaatcaagattcaacctcatcacaatctactgaagaagaatcaggcggcggtgaagttgcaagctttggagaatataagcgttatggatgcagcattgttaataacaatctctcaggttacatcgaaaacttgggaaagcctattgaaaattatactaagtcaattactacctcgtcgatggtgtctcaagactctgtgtttcctgctcctacttctggtcaaatatcttggtctcttcaatgtgctgaaacgtcacatttcaatggtttcttggctcctgaatatgcatcaacaccaacggcgctgccacatttagagatgatgggtttggtttcttcaagagtgccattgcctcatcacattcaagagaatgaaccaatatttgtcaatgcgaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttga

SEQ ID NO: 1162 - protein, 308 aa, Arabidopsis thaliana
  G1782,CAAT domain coordinates 178-237
MQVFQRKEDSSWGNSMPTTNSNIQGSESFSLTKDMIMSTTQLPAMKHSGLQLQNQDSTSSQSTEEESGGGEVASFGEYKRYGCSIVNNNLSGYIENLGKPIENYTKSITTSSMVSQDSVFPAPTSGQISWSLQCAETSHFNGFLAPEYASTPTALPHLEMMGLVSSRVPLPHHIQENEPIFVNAKQYHAILRRRKHRAKLEAQNKLIKCRKPYLHESRHLHALKRARGSGGRFLNTKKLQESSNSLCSSQMANGQNFSMSPHGGGSGIGSSSISPSSNSNCINMFQNPQFRFSGYPSTHHASALMSGT

SEQ ID NO: 1163 - DNA, 768 bp, Arabidopsis thaliana
  G1784,family:PMR
atggctcttgagaaaagcaaaggatgcaaactcctttttgtttgtgatgattttgtagatcgtgcagaggacactctgtttttaaaaacagttgccttggagaagacgtcagtttctgagggagatgaacaagctttcgaattcgaaggatataaggggtttctcgatatttccgagagctgtgatggccttgtctgcttctacgacactacaagagcagtggaagtaatgaatccggccacaacaatgttcatagaactccctctatcgagaatccaacagctttgtatatacaagccaaacccggaggtggagctggagccagttcaagatccaaatcctgttctagacccagtcatgacatgttctcagattggagttgggaaagacagcgttagtggaagttataaactagtatggatgtataatacttctcctgctactcctcctacgtgcgaggttttggatttagatggaaaaaaatggaggttcgtgaatactacttctcttgatcatcatcagatcttgtgcgatcagaggccggtgtttgcaaacggatcactctactggctcacgggagatgaggaaggatatgcaacaacacaaaccaaactcatagttttagatttacacacagagatgtttcaagtcatccaaacaccgccttttattacccgtgatgcctctggtgacaagattggtttatgcaatcttgatggtcgtctctgtatttcagagttgaagaaagattgcaagcaagagttttga

SEQ ID NO: 1164 - protein, 255 aa, Arabidopsis thaliana
  G1784,PMR domain coordinates 60-248
MALEKSKGCKLLFVCDDFVDRAEDTLFLKTVALEKTSVSEGDEQAFEFEGYKGFLDISESCDGLVCFYDTTRAVEVMNPATTMFIELPLSRIQQLCIYKPNPEVELEPVQDPNPVLDPVMTCSQIGVGKDSVSGSYKLVWMYNTSPATPPTCEVLDLDGKKWRFVNTTSLDHHQILCDQRPVFANGSLYWLTGDEEGYATTQTKLIVLDLHTEMFQVIQTPPFITRDASGDKIGLCNLDGRLCISELKKDCKQEF

SEQ ID NO: 1165 - DNA, 705 bp, Arabidopsis thaliana
  G1785,family:MYB-(R1)R2R3
atgaaaaaaaattatcaaaagaagaatataaaggtggtgagcacaagcaaatatttgaagaaaagtgacatcgacaaagtaaactggacagaatctgaggacataaaattgaaagagataatggcgcttggacccaaaaacaaatggacaaaggtcgcaaaaaaattcgaaggaagaacaggaaaacaatgcagagagaggtggtataaccatgctcgtcctaacattaagaaaactgcttggagtgaagaagaagatcaaattttgattgaagcacacaaagtacttggtaccaaatgggtcgagatcgcacagcaacttccggggaggagcgataacaatattaagaaccattggaacaccacaaagcgtcgggtgcaaaataaaagaggtggaactgtcaaccctgtcggcaataacatccttgaaaactacataaggtgtatcacaatcaacaacgaagattttcttaagaccgatggatcttatggtgaaccgacaaacattgagagtgatgatgactctaaagatatgttatacggggagatgaatttgagtctagagactataacgacgcagaccaccaaaccattgaccaatgcttctacaacatcaccttatgttcagatgccagaagataattatactatggaggattgtgaatcactggaggacattctagagctgctgcgttggtgggaataa

SEQ ID NO: 1166 - protein, 234 aa, Arabidopsis thaliana
  G1785,MYB-(R1)R2R3 domain coordinates 25-125
MKKNYQKKNIKVVSTSKYLKKSDIDKVNWTESEDIKLKEIMALGPKNKWTKVAKKFEGRTGKQCRERWYNHARPNIKKTAWSEEEDQILIEAHKVLGTKWVEIAQQLPGRSDNNIKNHWNTTKRRVQNKRGGTVNPVGNNILENYIRCITINNEDFLKTDGSYGEPTNIESDDDSKDMLYGEMNLSLETITTQTTKPLTNASTTSPYVQMPEDNYTMEDCESLEDILELLRWWE

SEQ ID NO: 1167 - DNA, 1170 bp, Arabidopsis thaliana
  G1786,family:MYB-(R1)R2R3
atgatcgtgtacggtgggggagcatccgaggacggtgaaggtggaggggtggttctgaagaaagggccatggacggtggccgaggacgagacactggcggcttacgtacgggaatacggtgaagggaactggaattctgttcagaagaagacatggctggctaggtgtggcaagagctgccgcctccgctgggctaaccacttacgacctaatctcaggaaaggctccttcacccccgaggaagaacgtctcatcatacaactccactctcagctaggcaacaaatgggctcgcatggctgctcagttaccaggcagaacagataacgagatcaagaactactggaacacgaggttgaaacgcttccaacgccaaggcctccctctctaccctccagaatattcccaaaacaatcatcaacaacaaatgtatcctcaacagccctcctcacctctcccgtcccaaacacctgcttcttcctttacctttcctctcctccaaccgccttctctgtgtcccaaacgttgttataacactgccttctctcccaaggcctcatatatttcttctccaaccaatttccttgtctcgtctccgacctttcttcacacccattcctctctttcctcctatcagtctaccaatccggtttactccatgaaacatgagctctcttcaaaccaaattccatactctgcctctttaggagtctatcaagtaagcaagttctcagacaatggggattgtaaccaaaacctgaacaccggtttgcatacaaatacctgtcagctgttagaggatcttatggaggaggccgaggctctagctgatagctttcgtgctcctaagcggagacaaatcatggctgcgcttgaggacaacaacaacaacaacaactttttctcgggaggtttcggacatcgtgtttcttccaacagtctatgttccttgcaaggtttaacaccaaaggaagatgagtctctccagatgaacacaatgcaagatgaggacataacaaagcttcttgactggggaagtgaaagtgaagaaatctcaaacgggcaatcctctgtgataacaacagagaacaaccttgtccttgacgatcaccagttcgcttttctgtttccagttgatgatgacaccaacaacttgccagggatctgctag

SEQ ID NO: 1168 - protein, 389 aa, Arabidopsis thaliana
  G1786,MYB-(R1)R2R3 domain coordinates NA
MIVYGGGASEDGEGGGVVLKKGPWTVAEDETLAAYVREYGEGNWNSVQKKTWLARCGKSCRLRWANHLRPNLRKGSFTPEEERLIIQLHSQLGNKWARMAAQLPGRTDNEIKNYWNTRLKRFQRQGLPLYPPEYSQNNHQQQMYPQQPSSPLPSQTPASSFTFPLLQPPSLCPKRCYNTAFSPKASYISSPTNFLVSSPTFLHTHSSLSSYQSTNPVYSMKHELSSNQIPYSASLGVYQVSKFSDNGDCNQNLNTGLHTNTCQLLEDLMEEAEALADSFRAPKRRQIMAALEDNNNNNNFFSGGFGHRVSSNSLCSLQGLTPKEDESLQMNTMQDEDITKLLDWGSESEEISNGQSSVITTENNLVLDDHQFAFLFPVDDDTNNLPGIC

SEQ ID NO: 1169 - DNA, 578 bp, Arabidopsis thaliana
  G1789,family:MYB-related
caaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggatgagaagcatgaagctgcagtgagacaagaagcaacaaaacctaactacgtatgatcgtcaaaataaaagagaatcacttcagagagatgtgtttttttcaatgtctgacgaatcaatgtttttttcttgcaatttctcatgtttttccctaagaaatggtttttttttcgaggcaacaaaaaaaaaa

SEQ ID NO: 1170 - protein, 101 aa, Arabidopsis thaliana
  G1789,MYB-related domain coordinates 12-62
MASGSMSSYGSGSWTVKQNKAFERALAVYDQDTPDRWHNVARAVGGKTPEEAKRQYDLLVRDIESIENGHVPFPDYKTTTGNSNRGRLRDEEKRMRSMKLQ

SEQ ID NO: 1171 - DNA, 549 bp, Arabidopsis thaliana
  G1791,family:AP2
atgtacatgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttaggaaaaaaaaaaaaaaaaaaa

SEQ ID NO: 1172 - protein, 139 aa, Arabidopsis thaliana
  G1791,AP2 domain coordinates 10-74
MERIESYNTNEMKYRGVRKRPWGKYAAEIRDSARHGARVWLGTFNTAEDAARAYDRAAFGMRGQRAILNFPHEYQMMKDGPNGSHENAVASSSSGYRGGGGGDDGREVIEFEYLDDSLLEELLDYGERSNQDNCNDANR

SEQ ID NO: 1173 - DNA, 1818 bp, Arabidopsis thaliana
  G1793,family:AP2
agtgatttattgattaacccaaacacaaaataaacagatttgactcaaaaagaagaaaatgaattctaacaactggcttggctttcctctttcaccgaacaactcttctttgcctcctcatgaatacaaccttggcttggtcagcgaccatatggacaacccttttcaaacacaagagtggaatatgatcaatccacacggtggaggaggagatgaaggaggagaggttccaaaagtggccgattttctcggtgtgagcaaaccggacgaaaaccaatccaaccacctagtagcttacaacgactcagactactacttccataccaatagcttgatgcctagcgtccaatcaaacgatgtcgttgtagcagcttgtgactccaatactcctaacaacagtagctatcatgagcttcaagagagtgctcacaatctacagtcacttactttgtccatggggaccaccgctggtaataatgttgtagacaaagcttcaccatccgagaccaccggggataacgctagcggtggagcactagccgttgttgagacggccacgccaagacgtgcattggacactttcggacaacgaacctcgatctatcgtggtgtcacaagacatcgatggactggtcgatatgaggctcatctatgggataatagttgtagaagggaaggccagtctaggaaaggaagacaagtttacttgggtggatatgacaaagaagataaagcagcaagatcatatgatctagctgcacttaagtactggggtccttcaactactactaatttccccattacaaactacgagaaagaagtagaggaaatgaagcacatgacgagacaagagttcgtggctgccattagaaggaaaagtagtggattttcgagaggcgcttcgatgtatcgaggagttacaaggcatcaccaacatggaagatggcaagcaaggatcggccgagtcgccggaaacaaagacctctacttgggaacttttagcactgaggaagaagcagcagaagcttacgatatagctgcaataaagtttagaggacttaatgcagtgaccaacttcgagatcaaccggtacgacgtgaaagccattctagagagtagcactcttcccatcggaggaggcgcagctaaacggctcaaagaagctcaagctcttgagtcttcaaggaaacgcgaggcggagatgatagcccttggttcaagtttccagtacggtggtggctcgagcacaggctctggctccacctcatcaagacttcagcttcaaccttaccctctaagcattcaacaaccattagagccttttctatctcttcagaacaatgacatctctcattacaacaacaacaatgctcacgattcctcctcttttaatcaccatagctatatccagacacaacttcatctccaccaacagaccaacaattacttgcagcaacagtcgagccagaactctcagcagctctacaatgcgtatcttcatagcaatccggctctgcttcatggacttgtctctacctctatcgttgacaacaataataacaatggaggctctagtgggagctacaacactgcagcatttcttgggaaccacggtattggtattgggtccagctcgactgttggatcgaccgaggagtttccaaccgttaaaacagattacgatatgccttccagtgatggaaccggagggtatagtggttggaccagtgagtctgttcaggggtcaaaccctggtggtgttttcactatgtggaatgagtaaacaaggatctctttcttgcggcacaaggaatgggt

SEQ ID NO: 1174 - protein, 574 aa, Arabidopsis thaliana
  G1793,AP2 domain coordinates 179-255,281-349
MNSNNWLGFPLSPNNSSLPPHEYNLGLVSDHMDNPFQTQEWNMINPHGGGGDEGGEVPKVADFLGVSKPDENQSNHLVAYNDSDYYFHTNSLMPSVQSNDVVVAACDSNTPNNSSYHELQESAHNLQSLTLSMGTTAGNNVVDKASPSETTGDNASGGALAVVETATPRRALDTFGQRTSIYRGVTRHRWTGRYEAHLWDNSCRREGQSRKGRQVYLGGYDKEDKAARSYDLAALKYWGPSTTTNFPITNYEKEVEEMKHMTRQEFVAAIRRKSSGFSRGASMYRGVTRHHQHGRWQARIGRVAGNKDLYLGTFSTEEEAAEAYDIAAIKFRGLNAVTNFEINRYDVKAILESSTLPIGGGAAKRLKEAQALESSRKREAEMIALGSSFQYGGGSSTGSGSTSSRLQLQPYPLSIQQPLEPFLSLQNNDISHYNNNNAHDSSSFNHHSYIQTQLHLHQQTNNYLQQQSSQNSQQLYNAYLHSNPALLHGLVSTSIVDNNNNNGGSSGSYNTAAFLGNHGIGIGSSSTVGSTEEFPTVKTDYDMPSSDGTGGYSGWTSESVQGSNPGGVFTMWNE

SEQ ID NO: 1175 - DNA, 1562 bp, Arabidopsis thaliana
  G1794,family:AP2
tctttctttcttcctctttgtctctgtttcttgtttctctctctctctctctacagagttttctttccctcgaagaaaaagaatatttttaaatttaattttctctgcgtttataagctttaagtttcagaggaggaggatttagaaggagggttttgtatgtgtgtcttaaaagtggcaaatcaggaagataacgttggcaaaaaagccgagtctattagagacgatgatcatcggacgttatctgaaatcgatcaatggctttacttattcgcagccgaagacgaccaccaccgtcatagcttccctacgcagcagccgcctccatcgtcgtcgtcctcatctcttatctcaggtttcagtagagagatggagatgtctgctattgtctctgctttgactcacgttgttgctggaaatgttcctcagcatcaacaaggaggcggtgaaggtagcggagaagggacttcgaattcgtcttcttcctcggggcagaaaaggaggagagaggtggaggaaggtggcgccaaagcggttaaggcagctaatactttgacggttgatcaatatttctccggtggtagctctacttctaaagtgagagaagcttcgagtaacatgtcaggtccgggcccaacatacgagtatacaactacggcaactgctagtagcgaaacgtcgtcgtttagtggggaccaacctcggcgaagatacagaggagttagacaaagaccatggggaaagtgggcggctgagattcgagatccatttaaagcagctagagtttggctcggtacgttcgacaatgctgaatcagcagcaagagcttacgacgaagctgcacttcggtttagaggcaacaaagccaaactcaacttccctgaaaacgtcaaactcgttagacctgcttcaaccgaagcacaacctgtgcaccaaaccgctgctcaaagaccgacccagtcaaggaactcgggttcaacgactacccttttgcccataagacctgcttcgaatcaaagcgttcattcgcagccgttgatgcaatcatacaacttgagttactctgaaatggctcgtcaacaacaacagtttcagcaacatcatcaacaatctttggatttatacgatcaaatgtcgtttccgttgcgtttcggtcacactggaggttcaatgatgcaatctacgtcgtcatcatcatctcattctcgtcctctgttttccccggctgctgttcagccgccaccagaatcagctagcgaaaccggttatctccaggatatacaatggccatcagacaagactagtaataactacaataatagtccatcctcctgatgacttgcttcattttatttgtttcactatagagtaatagaaaacaggaaaatgattatatgttatagagttatttttccaaatattatagggtttaggttgtttgtattgttctgctttcatcctctcatgctttttttcttaatttattatatttttgcattataatttcgtttcattgtaacaaacattaaaaagaccacatggagaaaggaaaaaaaagagag

SEQ ID NO: 1176 - protein, 391 aa, Arabidopsis thaliana
  G1794,AP2 domain coordinates 182-249
MCVLKVANQEDNVGKKAESIRDDDHRTLSEIDQWLYLFAAEDDHHRHSFPTQQPPPSSSSSSLISGFSREMEMSAIVSALTHVVAGNVPQHQQGGGEGSGEGTSNSSSSSGQKRRREVEEGGAKAVKAANTLTVDQYFSGGSSTSKVREASSNMSGPGPTYEYTTTATASSETSSFSGDQPRRRYRGVRQRPWGKWAAEIRDPFKAARVWLGTFDNAESAARAYDEAALRFRGNKAKLNFPENVKLVRPASTEAQPVHQTAAQRPTQSRNSGSTTTLLPIRPASNQSVHSQPLMQSYNLSYSEMARQQQQFQQHHQQSLDLYDQMSFPLRFGHTGGSMMQSTSSSSSHSRPLFSPAAVQPPPESASETGYLQDIQWPSDKTSNNYNNSPSS

SEQ ID NO: 1177 - DNA, 1265 bp, Arabidopsis thaliana
  G1796,family:AP2
ggaaactatcaaccaccaaaatctttcacattacaccttccttttgtcctcaaaccaaaaccctagaaaccaaaaatggaaaaagccttgagaaacttcaccgaatctacccactcaccagaccctaatcctctcacaaaattcttcactgaacctacagcctcacctgttagccgcaaccgcaaactgtcttcaaaagataccactgtaaccatcgccggagctggcagcagcacgacgaggtaccgcggcgtacgccggaggccgtggggacgatacgcggcggagatacgtgacccaatgtcgaaggagagacgttggctcggaacatttgacacggcggaacaagccgcttgtgcttacgactctgcggctcgtgcctttcgtggagcaaaggctcgtactaattttacttatccgacagctgtcattatgcctgaaccaaggttttctttttccaacaagaaatcttcgccgtctgctcgttgtcctcttccttctctaccgttagattcctctacccaaaacttttacggtgcaccggcagcgcagaggatctataatacacagtctatcttcttacgcgacgcctcgtgttcctctcgtaaaacgactccctataataactctttcaacggctcatcatcttcttactcagcatcgaaaacggcatgcgtttcttattccgaaaacgaaaacaacgagtcgtttttcccggaagaatcttctgatactggtctattacaagaggtcgttcaagagttcttgaagaaaaatcgcggcgttcctccttctccaccaacaccaccgccggtgactagccatcatgacaactctggttatttctctgctctcactatatactctgaaaatatggttcaagagactaaggagactttgtcgtcgaaactagatcgctacgggaattttcaagctaatgacgacggcgtaagagccgtcgcagacggtggtttatctttgggatcaaacgagtgggggtatcaagaaatgttgatgtacggaactcagttaggctgtacttgccgaagatcgtggggatagctagatattcatcatgattatgttttgagttttggtactatcgacttagtttaaagttgctacctttcccaatgttggatattaactaaattatgttttaagttgaatttgctaataggatttcataattataatcaagtttataatatattttagtagctaattaaagtttatatccacgtattctgaaaaaaaaaaaaaaa

SEQ ID NO: 1178 - protein, 328 aa, Arabidopsis thaliana
  G1796,AP2 domain coordinates 54-121
MEKALRNFTESTHSPDPNPLTKFFTEPTASPVSRNRKLSSKDTTVTIAGAGSSTTRYRGVRRRPWGRYAAEIRDPMSKERRWLGTFDTAEQAACAYDSAARAFRGAKARTNFTYPTAVIMPEPRFSFSNKKSSPSARCPLPSLPLDSSTQNFYGAPAAQRIYNTQSIFLRDASCSSRKTTPYNNSFNGSSSSYSASKTACVSYSENENNESFFPEESSDTGLLQEVVQEFLKKNRGVPPSPPTPPPVTSHHDNSGYFSALTIYSENMVQETKETLSSKLDRYGNFQANDDGVRAVADGGLSLGSNEWGYQEMLMYGTQLGCTCRRSWG

SEQ ID NO: 1179 - DNA, 615 bp, Arabidopsis thaliana
  G1797,family:MADS
actgaaatggtgagaggaaagatcgaaatcaagaagattgagaacgtgacaagtagacaagtcacgttttcgaagcgaaggagtggtctctttaagaaggctcatgagctttctgttctatgtgatgctcaagtggcagctatgatcttctctcagaaaggaagattatatgaattcgctagctccgatatcaggaacacgataaagcgatacgctgagtacaagagagagtattttgttgcagaaactcatcctatagagcaatacgtgcaggggctaaagaaggaaatggtgacaatggtgaaaaagattgaagtgcttgaagtccataaccggaagatgatgggacaaagtttggattcttgttcggtaaaagaactttcagagatagccacacagatagagaaaagccttcatatggttagattaagaaaggctaagttatatgaagatgagctacagaaactaaaagccaaggagagggaactcaaggacgagagagtcaggctttctctaaaggttggagaaagaccaatggggatgccgtcgggaagcaaagagaaagaggatgttgaaactgatctatttattggatttctgaagaaccgaccataa

SEQ ID NO: 1180 - protein, 202 aa, Arabidopsis thaliana
  G1797,MADS domain coordinates 1-57
MVRGKIEIKKIENVTSRQVTFSKRRSGLFKKAHELSVLCDAQVAAMIFSQKGRLYEFASSDIRNTIKRYAEYKREYFVAETHPIEQYVQGLKKEMVTMVKKIEVLEVHNRKMMGQSLDSCSVKELSEIATQIEKSLHMVRLRKAKLYEDELQKLKAKERELKDERVRLSLKVGERPMGMPSGSKEKEDVETDLFIGFLKNRP

SEQ ID NO: 1181 - DNA, 833 bp, Arabidopsis thaliana
  G1798,family:MADS
atggtgagagggaagatcgagatcaagaagattgagaacgtgacgagcagacaagtcacgttctcgaagcgaagaagcggtctatttaagaaggctcatgagctttcggttctatgcgatgctcaagtagccgccattgtcttttctcagagcggaagattacacgaatactctagctcccagatggagaagattatagatagatatggcaagtttagtaatgccttctatgtggcagagaggcctcaagtagaacgatacttgcaggagctgaagatggaaattgatagaatggtgaaaaagattgatctccttgaagttcatcaccgtaagctgttggggcaaggtttggattcgtgttcagtgacagaacttcaagagattgacactcaaattgagaaaagccttcgtattgtcaggtcaagaaaggctgagttatatgcagatcaactgaaaaagctaaaagaaaaggagagggagctcttgaacgagagaaaaaggctgcttgaagagcaaaatagagaaaggttgatgcgaccggtggtgccagcaactttacaaatatgtgataagggtaatactgaaggtggtcacagaaccaaacattcatcagaggttgaaaccgacctatttatcggattgcccgtgactcggctataacatattactttggttccatgtttgtacactataatgcttccatacagtttatagttttctgagtgctcatgcatgaccatctcttcatatatatatgtgtataaactgaaaataatttgacatgtattatttgtcactttagtttttcttttgaatgaatgtgacattttgtt

SEQ ID NO: 1182 - protein, 219 aa, Arabidopsis thaliana
  G1798,MADS domain coordinates 1-57
MVRGKIEIKKIENVTSRQVTFSKRRSGLFKKAHELSVLCDAQVAAIVFSQSGRLHEYSSSQMEKIIDRYGKFSNAFYVAERPQVERYLQELKMEIDRMVKKIDLLEVHHRKLLGQGLDSCSVTELQEIDTQIEKSLRIVRSRKAELYADQLKKLKEKERELLNERKRLLEEQNRERLMRPVVPATLQICDKGNTEGGHRTKHSSEVETDLFIGLPVTRL

SEQ ID NO: 1183 - DNA, 1716 bp, Arabidopsis thaliana
  G1804,family:bZIP
tatctctctctttctcaaaacctttcagtcaaaattctccggcggcttttaaactatgtgaaggaggagaacctccataacaagaagcggattctctcagttttccggcggcggaggaacacaaagccaccggtttttagacacacagatttcattttcagttgttaaatggtaactagagaaacgaagttgacgtcagagcgagaagtagagtcgtccatggcgcaagcgagacataatggaggaggtggtggtgagaatcatccgtttacttctttgggaagacaatcctctatctactcattgacccttgacgagttccaacatgctttatgtgagaacggcaagaactttgggtccatgaacatggacgagtttcttgtctctatttggaacgcagaggagaataataacaatcaacaacaagcagcagcagctgcaggttcacattctgttccggctaatcacaatggtttcaacaacaacaataacaatggaggcgagggtggtgttggtgtctttagtggtggttctagaggcaacgaagatgctaacaataagagagggatagcgaacgagtctagtcttcctcgacaaggctctttgacacttccagctccgctttgtaggaagactgttgatgaggtttggtctgagatacatagaggtggtggtagcggtaatggaggagacagcaatggacgtagtagtagtagtaatggacagaacaatgctcagaacggcggtgagactgcggctagacaaccgacttttggagagatgacacttgaggatttcttggtgaaggctggtgtggttagagaacatcccactaatcctaaacctaatccaaacccgaaccaaaaccaaaacccgtctagtgtaatacccgcagctgcacagcaacagctttatggtgtgtttcaaggaaccggtgatccttcattcccgggtcaagctatgggtgtgggtgacccatcaggttatgctaaaaggacaggaggaggagggtatcagcaggcgccaccagttcaggcaggtgtttgctatggaggtggcgttgggtttggagcgggtggacagcaaatgggaatggttggaccgttaagcccggtgtcttcagatggattaggacatggacaagtggataacataggaggtcagtatggagtagatatgggagggctaaggggaaggaaaagagtagtggatggtccagtggagaaagtagtggagagaagacagaggaggatgatcaagaaccgcgagtctgctgctagatctagagcaagaaaacaagcatatacagtggaattggaagctgaacttaaccagttgaaagaagagaatgcgcagctaaaacatgcattggcggagttggagaggaagaggaagcaacagtattttgagagtttgaagtcaagggcacaaccgaaattgccgaaatcgaacgggagattgcggacattgatgaggaacccgagttgtccactctaaacaaacaataggaagatggagaagaagtcggagacagaacgagggaaaaactgatgattttctacgttgttgttttgtctttgaggaatgaggttatagaatctttatactttgatgttttctgtgttggtaggaggaacaccatctgatctgctttactagtgttccctgtgaacaaagaaagtgattctgtgtttcaacatcatcaatctttggaaa

SEQ ID NO: 1184 - protein, 442 aa, Arabidopsis thaliana
  G1804,bZIP domain coordinates 357-407
MVTRETKLTSEREVESSMAQARHNGGGGGENHPFTSLGRQSSIYSLTLDEFQHALCENGKNFGSMNMDEFLVSIWNAEENNNNQQQAAAAAGSHSVPANHNGFNNNNNNGGEGGVGVFSGGSRGNEDANNKRGIANESSLPRQGSLTLPAPLCRKTVDEVWSEIHRGGGSGNGGDSNGRSSSSNGQNNAQNGGETAARQPTFGEMTLEDFLVKAGVVREHPTNPKPNPNPNQNQNPSSVIPAAAQQQLYGVFQGTGDPSFPGQAMGVGDPSGYAKRTGGGGYQQAPPVQAGVCYGGGVGFGAGGQQMGMVGPLSPVSSDGLGHGQVDNIGGQYGVDMGGLRGRKRVVDGPVEKVVERRQRRMIKNRESAARSRARKQAYTVELEAELNQLKEENAQLKHALAELERKRKQQYFESLKSRAQPKLPKSNGRLRTLMRNPSCPL

SEQ ID NO: 1185 - DNA, 1356 bp, Arabidopsis thaliana
  G1806,family:bZIP
atgcagagcagcttcaaaaccgttcctttcactcctgatttctactctcaatcctcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggcttgagggagagacttgaaggaggagaagaggagtgtttggacacagggcaattagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcctatgttcagcaacttgagaatagtcgaatcaggcttgcacagctagaggaagagctcaaaagagctcgccaacagggatctttggttgaaagaggagtttcagcggatcacacgcatttggcagcaggaaatggtgtcttttcatttgaattggaatatacacgttggaaggaggaacatcaaagaatgatcaacgacttaagatcgggtgtgaattcgcagttaggtgacaacgatctacgcgttctagtggatgctgtgatgagtcactatgatgaaatattcaggctaaagggaattggcactaaagttgaagtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttctatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaa

SEQ ID NO: 1186 - protein, 451 aa, Arabidopsis thaliana
  G1806,bZIP domain coordinates 165-225
MQSSFKTVPFTPDFYSQSSYFFRGDSCLEEFHQPVNGFHHEEAIDLSPNVTIASANLHYTTFDTVMDCGGGGGGLRERLEGGEEECLDTGQLVYQKGTRLVGGGVGEVNSSWCDSVSAMADNSQHTDTSTDIDTDDKTQLNGGHQGMLLATNCSDQSNVKSSDQRTLRRLAQNREAARKSRLRKKAYVQQLENSRIRLAQLEEELKRARQQGSLVERGVSADHTHLAAGNGVFSFELEYTRWKEEHQRMINDLRSGVNSQLGDNDLRVLVDAVMSHYDEIFRLKGIGTKVEVFHMLSGMWKTPAERFFMWLGGFRSSELLKILGNHVDPLTDQQLIGICNLQQSSQQAEDALSQGMEALQQSLLETLSSASMGPNSSANVADYMGHMAMAMGKLGTLENFLRQADLLRQQTLQQLHRILTTRQAARAFLVIHDYISRLRALSSLWLARPRD

SEQ ID NO: 1187 - DNA, 977 bp, Arabidopsis thaliana
  G1808,family:bZIP
aattcttcccttttccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagaaaaaatatcgaaaaacttagaacaataaccaaaaaaaaaaagcaaagcaaaaaagaaactctcgctatgtctctctatctctctatgtaaatgaaatgaaggttaggaagagaaaatgatagttttctaattttcctttccacttt

SEQ ID NO: 1188 - protein, 248 aa, Arabidopsis thaliana
  G1808,bZIP domain coordinates 140-200
MLSTAPAFSFSEPGLVNQFSGFQTGFTPWEWDCSDLFFVDQMSLEPAIPSPCYGESDTGSVKINSGSHDMKTGSDESCAGFVKINPRCDDADISNDLPCSQADEPDSDDTKQLTAITNFGSGENNHNRKKMIQPEMTDERKRKRMESNRESAKRSRMRKQSHIDNLREQVNRLDLENRELGNRLRLVLHQLQRVNSDNNRLVTEQEILRLRLSEMRRILIIRQLQQQQQWELHNRRMIMTEQNHPHLQ

SEQ ID NO: 1189 - DNA, 604 bp, Arabidopsis thaliana
  G1809,family:bZIP
ctctctattctcgtctttagcaaaatctcaaaagacaaaaagatattgatgtctctccaacgacccaatgggaactcgagttcgtcttcttcccacaagaagcacaaaactgaggaaagtgatgaggagttgttgatggttcctgacatggaagcagctggatcaacatgtgttctaagcagcagcgccgacgatggagtcaacaatccggagcttgaccagactcaaaatggagtctctacagctaaacgccgccgtggaagaaaccctgttgataaagaatatagaagcctcaagagattattgaggaacagagtatcagcgcaacaagcaagagagaggaagaaagtgtatgtgagtgatttggaatcaagagctaatgagttacagaacaacaatgaccagctcgaagagaagatttctactttgacgaacgagaacacaatgcttcgtaaaatgcttattaacacaaggcctaaaactgatgacaatcactaaatatttaccctttaatccattgttcagtgttgtatgattatctttctttcttttttggttttggtttgtatacactttttgttcgaataacattcactttgagcat

SEQ ID NO: 1190 - protein, 149 aa, Arabidopsis thaliana
  G1809,bZIP domain coordinates 136-196
MSLQRPNGNSSSSSSHKKHKTEESDEELLMVPDMEAAGSTCVLSSSADDGVNNPELDQTQNGVSTAKRRRGRNPVDKEYRSLKRLLRNRVSAQQARERKKVYVSDLESRANELQNNNDQLEEKISTLTNENTMLRKMLINTRPKTDDNH

SEQ ID NO: 1191 - DNA, 702 bp, Arabidopsis thaliana
  G1815,family:MYB-(R1)R2R3
atggatttttcatgtttccaagaatacccttttgagtttcattgcagaggaacaacatttaatgggtttagagaaaacaatgcagtgtctgaaacagtagaagagttctgtaataaaagaaggatgcagaagaagagtgatgatttgaagactaagaagaagaagaaacagagtgtttctagggtttgtagtagaggacattggaggatctctgaagatactcagcttatggagcttgtttcggtttacggtcctcaaaactggaaccacattgcagagagtatgcaaggaagaacaggaaagagctgcagattgaggtggtttaaccagttagatccgaggattaacaagagagctttcagtgatgaagaagaagagagactacttgctgctcatagagcttttggtaacaaatgggctatgattgctaagcttttcaatggaagaacagataatgccttgaagaatcattggcatgttctcatggcaaggaagatgagacagcaatcaagttcttacgtccaaagattcaatggttctgctcatgaatctaacacagatcacaaaatcttcaatctttctcctggtttgtctcttcttaccttacacatatgcattgagtttaactctgttattgtaatgagatactttcgatatttatcactcaggaacaatgaacttatggtttggtctcaaaagtag

SEQ ID NO: 1192 - protein, 233 aa, Arabidopsis thaliana
  G1815,MYB-(R1)R2R3 domain coordinates 65-170
MDFSCFQEYPFEFHCRGTTFNGFRENNAVSETVEEFCNKRRMQKKSDDLKTKKKKKQSVSRVCSRGHWRISEDTQLMELVSVYGPQNWNHIAESMQGRTGKSCRLRWFNQLDPRINKRAFSDEEEERLLAAHRAFGNKWAMIAKLFNGRTDNALKNHWHVLMARKMRQQSSSYVQRFNGSAHESNTDHKIFNLSPGLSLLTLHICIEFNSVIVMRYFRYLSLRNNELMVWSQK

SEQ ID NO: 1193 - DNA, 318 bp, Arabidopsis thaliana
  G1816,family:MYB-related
atggataacactgaccgtcgtcgccgtcgtaagcaacacaaaatcgccctccatgactctgaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctag

SEQ ID NO: 1194 - protein, 105 aa, Arabidopsis thaliana
  G1816,MYB-related domain coordinates 30-74
MDNTDRRRRRKQHKIALHDSEVSSIEWEFINMTEQEEDLIFRMYRLVGDRWDLIAGRVPGRQPEEIERYWIMRNSEGFADKRRQLHSSSHKHTKPHRPRFSIYPS

SEQ ID NO: 1195 - DNA, 1740 bp, Arabidopsis thaliana
  G1818,family:CAAT
taacaaatcaaataattagagaaataaccaaaatttaacttttagagggactacaggatttgtactttgtacattcatatattattgttatatatcgtttcatacattaatttgaaccaatgtaaattaagtaaaattcaatttaacatcatgagcaaattcttattaaaattctcttaaaattttgagcaaattatgctttcacatttaacatttgaaaacatcatttttaacaagatattcaaaactaagttttgtacagcaaaattttaactttcaattttatagagaaaaaggtatttttttttttgtttcatttttataagactattatttggtatataatatacactttaagtaaaaacaaatctctttcttttttcttcttataataccaaccacaagtctgtcagtcacacacatacagttaataacattaaatattcttaacaaactactaaataggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaacttgaatttctttttgagttctgcttatgttttcaatgttatgttttttagttgttgaatgtatttctgttgttttgtccaaaaaaaaaaaagaatgtatttctgttgttgtctttcaaatgaatctaatggtttatgaatattggctttagattaatttatgcatacaaaaacacaaggattacggataaaaaagtcctcagtttacccatggaaacataatcttctagtgattccttatgagagtagaaaagaatcatatattataatctatttcataagagatagggtactgtaaacaaggatgtttattcggctatttcttttttttttaatcacttttacttgtcaagactcttttgtgtttgcagctttttgttagattacattctagaggcaacaagatccagagatctagcaaaaaaaacttattttgaaacctgaatctattttaaaaattttccaactcatttttcgttcttattctttgttttccaacggaatttggcgcacaaacgatttatttgaattttgtctttcaag

SEQ ID NO: 1196 - protein, 186 aa, Arabidopsis thaliana
  G1818,CAAT domain coordinates 24-116
MENNNNNHQQPPKDNEQLKSFWSKGMEGDLNVKNHEFPISRIKRIMKFDPDVSMIAAEAPNLLSKACEMFVMDLTMRSWLHAQESNRLTIRKSDVDAVVSQTVIFDFLRDDVPKDEGEPVVAAADPVDDVADHVAVPDLNNEELPPGTVIGTPVCYGLGIHAPHPQMPGAWTEEDATGANGGNGGN

SEQ ID NO: 1197 - DNA, 639 bp, Arabidopsis thaliana
  G1819,family:CAAT
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaattga

SEQ ID NO: 1198 - protein, 212 aa, Arabidopsis thaliana
  G1819,CAAT domain coordinates 52-148
MEENNGNNNHYLPQPSSSQLPPPPLYYQSMPLPSYSLPLPYSPQMRNYWIAQMGNATDVKHHAFPLTRIKKIMKSNPEVNMVTAEAPVLISKACEMLILDLTMRSWLHTVEGGRQTLKRSDTLTRSDISAATTRSFKFTFLGDVVPRDPSVVTDDPVLHPDGEVLPPGTVIGYPVFDCNGVYASPPQMQEWPAVPGDGEEAAGEIGGSSGGN

SEQ ID NO: 1199 - DNA, 732 bp, Arabidopsis thaliana
  G1820,family:CAAT
ctcacttccaacatccaaatccctagaaattgtaaatggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattgaagtgtagatttagggtttgtaaccgcctatgtgggaaatttgaaatttggtggtgtttattagggttcttcaattcgtcggatttgct

SEQ ID NO: 1200 - protein, 202 aa, Arabidopsis thaliana
  G1820,CAAT domain coordinates 70-133
MAENNNNNGDNMNNDNHQQPPSYSQLPPMASSNPQLRNYWIEQMETVSDFKNRQLPLARIKKIMKADPDVHMVSAEAPIIFAKACEMFIVDLTMRSWLKAEENKRHTLQKSDISNAVASSFTYDFLLDVVPKDESIATADPGFVAMPHPDGGGVPQYYYPPGVVMGTPMVGSGMYAPSQAWPAAAGDGEDDAEDNGGNGGGN

SEQ ID NO: 1201 - DNA, 734 bp, Arabidopsis thaliana
  G1821,family:CAAT
atggaacgtggaggcttccatggctaccgcaagctgtccgtgaacaacaccactccttctccaccaggattagcagcgaattttctgatggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtactgagaacaatggctaataacatagacagctga

SEQ ID NO: 1202 - protein, 234 aa, Arabidopsis thaliana
  G1821,CAAT domain coordinates 57-146
MERGGFHGYRKLSVNNTTPSPPGLAANFLMAEGSMRPPEFNQPNKTSNGGEEECTVREQDRFMPIANVIRIMRRILPAHAKISDDSKETIQECVSEYISFITGEANERCQREQRKTITAEDVLWAMSKLGFDDYIEPLTLYLHRYRELEGERGVSCSAGSVSMTNGLVVKRPNGTMTEYGAYGPVPGIHMAQYHYRHQNGFVFSGNEPNSKMSGSSSGASGARVEVFPTQQHKY

SEQ ID NO: 1203 - DNA, 1211 bp, Arabidopsis thaliana
  G1823,family:GARP
ttttcaatactcacaccaaagcttaatgccgatcaacgatcagtttcctagtgggttaagaatactcgttgtagacgatgatacttcatgcttgttcattctcgagaaaatgcttctccgtctcatgtaccaagttacaatttgctcacaagctgatgttgcgttaaccattctaagagaaagaaaagacagttttgatttggtgctaagtgatgttcatatgcctggtatgaatggttacaatcttcttcaacaagttggtcttcttgaaatggatcttcctgtcattatgatgtctgttgatggaagaacaactacagtcatgactggaatcaaccatggagcttgtgattatctaatcaaacctattcgtcctgaagagcttaagaacatttggcaacatgttgttagaaggaaatgtgtgatgaagaaagagcttcgaagttctcaagctttagaggataacaagaacagtggtagcctcgagactgttgttgtttcggttagtgaatgctcagaggaaagtttgatgaaatgtaggaataagaagaagaagaagaagagaagtgttgatagagatgataatgaagatgatcttcttcttgatcctggaaactcgaagaagtcacgcgttgtttggtctattgaattgcatcaacaattcgttaatgccgtaaacaaacttggaattgacaaagctgtaccaaagcggattctcgagttgatgaatgttcctggtttaagcagagaaaacgtggctagtcatttacagaagttccgattgtatttgaagagattaagcggtgaagcttcgcagagtaatgactctgagtctaccaaaagatatgaaaacattcaagctctggtttcctcaggacaattacatccacagacattagctgcattgtttggtcaaccaatagacaatcatcactctgctagttttggagtttggattcctaatgacaatcttggtagatctcaaaatgaacacttctcggttgatgtatcatccgcttctaaccgtcctgtttctgtggcggttcatggtctatcttcctcagcaaatttcagacagagaggtgacgttaacaacaacagaatcagacaagggtatggatcaaatgtcaatgaagaatcttggatcttggaaagatcttcaagacaaagatagtgaccaatatggatacgcttaagaagagaaggctctg

SEQ ID NO: 1204 - protein, 382 aa, Arabidopsis thaliana
  G1823,GARP domain coordinates 205-252
MPINDQFPSGLRILVVDDDTSCLFILEKMLLRLMYQVTICSQADVALTILRERKDSFDLVLSDVHMPGMNGYNLLQQVGLLEMDLPVIMMSVDGRTTTVMTGINHGACDYLIKPIRPEELKNIWQHVVRRKCVMKKELRSSQALEDNKNSGSLETVVVSVSECSEESLMKCRNKKKKKKRSVDRDDNEDDLLLDPGNSKKSRVVWSIELHQQFVNAVNKLGIDKAVPKRILELMNVPGLSRENVASHLQKFRLYLKRLSGEASQSNDSESTKRYENIQALVSSGQLHPQTLAALFGQPIDNHHSASFGVWIPNDNLGRSQNEHFSVDVSSASNRPVSVAVHGLSSSANFRQRGDVNNNRIRQGYGSNVNEESWILERSSRQR

SEQ ID NO: 1205 - DNA, 924 bp, Arabidopsis thaliana
  G1825,family:GARP
agtaattgatctcgagagctagctaaagacactctcgccggagagacatggccgggagatcttcgccgggaaaatgctccacgtggcttgacctgaacagagaagaaacagtggagaagaacaatgaagaagagtcatcagtggaagacgaagaccaaatcacgaataacgttagacagtatattcggtccaacatgcctcggcttcgttggacgcctgatcttcatctctccttcgttcgtgctgtccaacgactaggcggtccagacagagcgacgccgaaattggttcttgagatgatgaatctaaaaggattgagtattgcacatgtcaagagtcatttacagatgtatcgaagtaagaagctcgagccgtcttctcgccctggatttggagctttcatgagtggacaaagaagctatttgatggacatgatcgactctcgatgtatccctcatagcgatttaagacatgcctataactctaaaaccgttccttcgagggtactcaatcaagacgcggtcgttacaaatcttggaggtaactttcttatgcgaccttcgagctggtttagcgggttatgcagaaatgaccgagacagcacagagaacaagactctgcctctactcgagattaggaagaagaacaatgagaaaagagtccgagatgaagaagtatcatcagtcaaacgattgaaatcaatgtccggaggtgggatacagttgcctgagtttggaaattgcaggcaaaaaccaacagatgatatcaacacaatgctctcgctctctctgttgtcgacatcatcagaaccgtaaccaacatactagagagatgaagtttaactttaaaagagattcaagagtagagacttttgttttccttagccgtttcatgggatgagtacttagccaggatctggatcag

SEQ ID NO: 1206 - protein, 255 aa, Arabidopsis thaliana
  G1825,GARP domain coordinates 55-103
MAGRSSPGKCSTWLDLNREETVEKNNEEESSVEDEDQITNNVRQYIRSNMPRLRWTPDLHLSFVRAVQRLGGPDRATPKLVLEMMNLKGLSIAHVKSHLQMYRSKKLEPSSRPGFGAFMSGQRSYLMDMIDSRCIPHSDLRHAYNSKTVPSRVLNQDAVVTNLGGNFLMRPSSWFSGLCRNDRDSTENKTLPLLEIRKKNNEKRVRDEEVSSVKRLKSMSGGGIQLPEFGNCRQKPTDDINTMLSLSLLSTSSEP

SEQ ID NO: 1207 - DNA, 837 bp, Arabidopsis thaliana
  G1832,family:Z-C2H2
agtaagagactcaataataatgtcgaacacttcaaactccgatcccaattccgatatcccatttgcttcctccaatgtaactcttcctagttacaatcaaaacccaagaagaaaacgtactaaactcaccaacaacgaagtcggttcttcttcgtcttctccaaggcctaaaccggtcacgcaaccggaccctgatgcttcacaaatcgcacgaccatgtactgaatgtggtaaacaattcgggtcactgaaggcactctttggacacatgagatgtcaccctgaacgtcagtggcgtggcatcaaccctccttctaacttcaaacgtaggatcaactcaaacgctgcgtcatcatcctcgagttgggatccatctgaggaagagcataacatagcctcctgtttactaatgatggctaatggtgatgtcccaacccgttcaagtgaagttgaggaacggtttgagtgtgatggttgtaagaaagtgtttgggtcacatcaagcgttaggcggacatagagcaacacataaagacgtcaaaggatgtttcgccaataaaaacataaccgaagatcctcctcctccacctcctcaagagatcgttgatcaagataagggcaagagtgtgaagttggtctcggggatgaatcatcgatgtaacatctgttctagagtgttctccagtggtcaagcgttaggaggtcacatgagatgtcattgggagaaagatcaggaagagaaccaagtcaggggcattgatcttaatgttcctgcggcgacatcttcagacacaacgttaggttgttccttggatcttaggttaggactttgatatat

SEQ ID NO: 1208 - protein, 270 aa, Arabidopsis thaliana
  G1832,Z-C2H2 domain coordinates 67-87,150-166,213-233
MSNTSNSDPNSDIPFASSNVTLPSYNQNPRRKRTKLTNNEVGSSSSSPRPKPVTQPDPDASQIARPCTECGKQFGSLKALFGHMRCHPERQWRGINPPSNFKRRINSNAASSSSSWDPSEEEHNIASCLLMMANGDVPTRSSEVEERFECDGCKKVFGSHQALGGHRATHKDVKGCFANKNITEDPPPPPPQEIVDQDKGKSVKLVSGMNHRCNICSRVFSSGQALGGHMRCHWEKDQEENQVRGIDLNVPAATSSDTTLGCSLDLRLGL

SEQ ID NO: 1209 - DNA, 969 bp, Arabidopsis thaliana
  G1835,family:GATA/Zn
atgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcctgccgcttctgatcctctcttctcttccaacaccaactctgattcatcacctgagctctatgttccgtttgaggacattgttaaggtggaaagacctccaagctttgtagaggaaacattggttgagaagaaggaagattcgttttcgacaaacactgattcatcatcttctcatagccaattcaggagctcaagtccagtgtcggttctcgagagcagctcctcctcgtctcaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaagggctgattccgaacaatgcctacattggcgtagactaa

SEQ ID NO: 1210 - protein, 322 aa, Arabidopsis thaliana
  G1835,GATA/Zn domain coordinates 224-296
MIGTSFPEDLDCGNFFDNMDDLMDFPGGDIDVGFGIGDSDSFPTIWTTHHDTWPAASDPLFSSNTNSDSSPELYVPFEDIVKVERPPSFVEETLVEKKEDSFSTNTDSSSSHSQFRSSSPVSVLESSSSSSQTTNTTSLVLPGKHGRPRTKRPRPPVQDKDRVKDNVCGGDSRLIIRIPKQFLSDHNKMINKKKKKKAKITSSSSSSGIDLEVNGNNVDSYSSEQYPLRKCMHCEVTKTPQWRLGPMGPKTLCNACGVRYKSGRLFPEYRPAASPTFTPALHSNSHKKVAEMRNKRCSDGSYITEENDLQGLIPNNAYIGVD

SEQ ID NO: 1211 - DNA, 668 bp, Arabidopsis thaliana
  G1836,family:CAAT
ataacaagcctagaacactagaaacttcaaaaaagaaaaaaatcttatggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaactaataagtggaatacgttttagggtattttcaagggaatatgtagtaaatagtcatggatc

SEQ ID NO: 1212 - protein, 187 aa, Arabidopsis thaliana
  G1836,CAAT domain coordinates 24-110
MENNNGNNQLPPKGNEQLKSFWSKEMEGNLDFKNHDLPITRIKKIMKYDPDVTMIASEAPILLSKACEMFIMDLTMRSWLHAQESKRVTLQKSNVDAAVAQTVIFDFLLDDDIEVKRESVAAAADPVAMPPIDDGELPPGMVIGTPVCCSLGIHQPQPQMQAWPGAWTSVSGEEEEARGKKGGDDGN

SEQ ID NO: 1213 - DNA, 2414 bp, Arabidopsis thaliana
  G1837,family:BZIPT2
aatttgtttctaattagggttcatcatcaagtcgtacttctgccaaacaaggtttttactttttagtgatgtcgtcaaaaggtacaacaactcaatcaatccacgaaatatcaattgttaaagcgaggaaatcaaattagggtttaaccgatttcgagagatcattcaagagggtttaatgggtatcgttgcttccaagggagatagtaatactccattgttgaatctatgtaaggagaggaaggaattgatcaaagcagctagagatgctcgttatcacttagcgagatctcatcttctttactttaaatctcttttagatttcagcaaagctcttaaacagtttcttcataaggatttggttgtgattccgtattccgatgatgattcgtctagtagtgatataatttgttctggatcagattcagactcggatacggattctgattcagattctgattctgattgtatagtctgtgatcaacctcaaacagctccgttgagcaataatgacgatcagagtcagcgaaaacccgtggttggtgatggaacttgcggtgcaagtaacaatggtcaagagggtatggagaagtcaagagaaggtttagggtttgaggggacacagttcgttagtgatccaagtgaagacgagatgaaaagttcgcaacacccttatgatatactcggtttctacaaatccgtgtataacatgcagcagtgcgaaattatcgaactggatcatagagatgatgaggttgagagtgatggatttagagaaattagggagagagaagggattcctgatttggaacctgaaagtgattataatagtctgataaggaagaataaaaagaagaataaaaagaagaagaagaagaagaatgttagagaaagctcttctgttgcaagtgaaattgataagcgagatgttgaagcgaatacttgtaatggtcaagttgcagatgagactgataattctaatgaagcttgtgcgcaagagacagaaaacactccagagattgttacggaagaagtgacgagatcagatgaggaagttgaagtagtggcaagatcagatgaggaagtttctgatgaagcgtatgagtcttcttcttcttgtttttcggaatcttctggttcgggtttgacggatctaaggaaggtagtggaaaggatcaatagtatatgcgggaaagctgcgggtaatagtgaagtctctgagttgcttgaagtaagcagagttgtttatcatcaacctttaggatctcaattcaagggatttgcttcaagagtaattggtagttccgggactacgactcgtgatttggttttaaagcgccgttttcgcttagatgatctcgctgtttcactctctatgacattagagaagctttatatgtgggaaaagaagcttcacgcagaagttacagctgaagaaaagcttagggttgcttatgaaaaagcgtacaagattctgaacaatcttgatcaaaacggagcagaatctagtgagctttacgaggcggaaactttggttaaactccatttatctaaggttaatgtttcggttcgagcggttgaatcgatttcgatgagaattcataagataagagacgaagagctttcgtttcaagtgattgagatcattaacggattcaaaacaatgtggagattcttggcgaaatgtcaccataagcagtttcgagtgattgcgagaagcaagtcttgtgttcacattgttgaaaacggatcgagctccaggaaagccacgcagcaagtcgaaaaacagattagaagatacagagaatctttgaaaggttacattgatgcacacagaggtttcgttaagcttttaaacgaatggcttaaccgaatcatcatggaggacgatgaaaccgagactgaagctcctgagatatttagggtttgcagcgagtggttaagagagattgagaatgtggatacgattaaagtgttgagtgttgttgaagaaatgagattaagatttcaagggttagggtttaagcaagtagaggaagagaaacagaggatgagaacagagagattgtctaaggagttagagaagaagacgaaggagttggaggagattcggggaacgagaggttctagtccgacgtcgaatatggttgaaccggagttgttgtttttgagagagagtgtgacgcaagaaacagaaaaacatgagagattgataagagagttaaacgacgccgtatcgatgagtttgcaagagtgtatggttcctgtctttgaggctttgggagatttttgttttgctaattttaaagcatatcagaacattgtaatcgttaccacataaactctatgattgcgtcaatcataaaaataaatatgtataggaaattaaataaagaatttcatcagatttcgta

SEQ ID NO: 1214 - protein, 720 aa, Arabidopsis thaliana
  G1837,BZIPT2 domain coordinates 1-53,398-507
MGIVASKGDSNTPLLNLCKERKELIKAARDARYHLARSHLLYFKSLLDFSKALKQFLHKDLVVIPYSDDDSSSSDIICSGSDSDSDTDSDSDSDSDCIVCDQPQTAPLSNNDDQSQRKPVVGDGTCGASNNGQEGMEKSREGLGFEGTQFVSDPSEDEMKSSQHPYDILGFYKSVYNMQQCEIIELDHRDDEVESDGFREIREREGIPDLEPESDYNSLIRKNKKKNKKKKKKKNVRESSSVASEIDKRDVEANTCNGQVADETDNSNEACAQETENTPEIVTEEVTRSDEEVEVVARSDEEVSDEAYESSSSCFSESSGSGLTDLRKVVERINSICGKAAGNSEVSELLEVSRVVYHQPLGSQFKGFASRVIGSSGTTTRDLVLKRRFRLDDLAVSLSMTLEKLYMWEKKLHAEVTAEEKLRVAYEKAYKILNNLDQNGAESSELYEAETLVKLHLSKVNVSVRAVESISMRIHKIRDEELSFQVIEIINGFKTMWRFLAKCHHKQFRVIARSKSCVHIVENGSSSRKATQQVEKQIRRYRESLKGYIDAHRGFVKLLNEWLNRIIMEDDETETEAPEIFRVCSEWLREIENVDTIKVLSVVEEMRLRFQGLGFKQVEEEKQRMRTERLSKELEKKTKELEEIRGTRGSSPTSNMVEPELLFLRESVTQETEKHERLIRELNDAVSMSLQECMVPVFEALGDFCFANFKAYQNIVIVTT

SEQ ID NO: 1215 - DNA, 1941 bp, Arabidopsis thaliana
  G1838,family:AP2
ttccttggcattctctttagaactttcgtacaaaatgcaaaacctgaacctctaaagctaaaaaaaaagattagagactgtaactgcttttatcagattttcaactaggaaaaaagttacaatcttttttgatggctcctccaatgacgaattgcttaacgttttctctgtcaccaatggagatgttgaaatcaactgatcagtctcacttctcttcttcttacgacgattcttctactccttatctcatcgataacttctatgctttcaaagaagaagctgagatagaagctgctgctgcttcaatggcggattcaacaaccttatctacttttttcgatcattctcagactcagattccaaagctggaagatttcctcggtgattcctttgtccgttactctgataaccaaacagagacccaagactcttcttctctcactccattctacgatccacgtcaccgcaccgttgccgaaggagttacagggttcttctctgatcatcatcagccagatttcaagacgataaactcgggaccagaaatcttcgatgactcaacaacttccaacatcggtggtactcatctctccagtcacgtggtggagtcatcaacgacggcgaagttagggtttaacggtgattgcaccaccaccggaggagttttgtctctaggggttaacaacacatcagatcaacctttgagctgtaacaatggcgagagaggtggaaacagtaacaagaagaaaacagtttctaagaaggaaacatcagatgattcaaagaagaagattgtcgaaacattgggacaaagaacttcaatttatcgtggagtcacccgacatagatggactggaagatacgaagcgcatctatgggataacagctgtaggagggaaggtcaagccagaaaaggacgtcaagtgtacttaggtggatatgacaaggaagatagagcagctagagcctatgacttggcagctttaaaatactggggttctactgctactacaaattttccggtctcgagttattcaaaagaacttgaggaaatgaatcacatgaccaagcaagagtttattgcatctcttaggaggaaaagtagcggtttttcgagaggagcttcaatatatagaggtgtcacaaggcatcatcaacaaggtcgctggcaagcaagaatcggccgtgtcgcaggaaacaaagatctttacctcggaacctttgcaaccgaagaggaagcagcagaggcttatgacattgcagccataaagttcagaggaatcaacgcagtaactaactttgagatgaacaggtatgacattgaagctgtcatgaatagttctttacctgtaggaggagcagctgcgaaacgccacaaactcaaactcgctcttgaatctccttcttcatcatcctctgaccataacctccaacaacaacagttgcttccgtcctcttctccctcggatcaaaaccctaactcaatcccatgtggcattccatttgagccttcagttctctattaccaccagaacttctttcagcattatcctttggtctctgactctacaattcaagctcctatgaaccaagctgagtttttcttgtggcctaaccagtcttactaaatcatttggttcgttcttgcttagacttctattcaccgcactaaccgatgacccgaggcttatcttcttgattctggctataaggatgaatctttcaagttccttttttaactgtaggctaagacagaagtagaggggagaaaagttgaagaatctgaaacttttggggtcaattttgtattaatgtttttcttttgtcaagggtggattatcggttttattacttattttttgaatgtaatcggcctataacggtataactctgtttccatttatgaatatttttctcaaattgaaaaaaaaaaaaaaaaaa

SEQ ID NO: 1216 - protein, 498 aa, Arabidopsis thaliana
  G1838,AP2 domain coordinates 230-304,330-400
MAPPMTNCLTFSLSPMEMLKSTDQSHFSSSYDDSSTPYLIDNFYAFKEEAEIEAAAASMADSTTLSTFFDHSQTQIPKLEDFLGDSFVRYSDNQTETQDSSSLTPFYDPRHRTVAEGVTGFFSDHHQPDFKTINSGPEIFDDSTTSNIGGTHLSSHVVESSTTAKLGFNGDCTTTGGVLSLGVNNTSDQPLSCNNGERGGNSNKKKTVSKKETSDDSKKKIVETLGQRTSIYRGVTRHRWTGRYEAHLWDNSCRREGQARKGRQVYLGGYDKEDRAARAYDLAALKYWGSTATTNFPVSSYSKELEEMNHMTKQEFIASLRRKSSGFSRGASIYRGVTRHHQQGRWQARIGRVAGNKDLYLGTFATEEEAAEAYDIAAIKFRGINAVTNFEMNRYDIEAVMNSSLPVGGAAAKRHKLKLALESPSSSSSDHNLQQQQLLPSSSPSDQNPNSIPCGIPFEPSVLYYHQNFFQHYPLVSDSTIQAPMNQAEFFLWPNQSY

SEQ ID NO: 1217 - DNA, 765 bp, Arabidopsis thaliana
  G1839,family:AP2
atcacagttatgtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaatgttatatttactattgaaaactaaattatttattatagagggagatattactctttacgctttcattaagatttatttttataagttttaaagtattttattgttataaaaaaaaaaaaaaaaaaaaaa

SEQ ID NO: 1218 - protein, 184 aa, Arabidopsis thaliana
  G1839,AP2 domain coordinates 118-182
MLTPFCSSHHLQEKMNSCQSNPTKMDNSENVLFNDQNENFTLVAPHPSSSYLTRDQEHEIMVSALRQVISNSGADDASSSNLIITSVPPPDAGPCPLCGVAGCYGCTLQRPHREVKKEKKYKGVRKKPSGKWAAEIWDPRSKSRRWLGTFLTAEMAAQSYNDAAAEYRARRGKTNGEGIKRRWR

SEQ ID NO: 1219 - DNA, 683 bp, Arabidopsis thaliana
  G1840,family:AP2
acttttgatccttcgcattcactaaataagtacatattatcagtttgacaccaaaaaaatggattattcagaaaatgttcaaaacaaaaatttcacccctatttcacaacctcctaacttgacaagagaccaagaacatgctatcatggtttctactttgcgacaagtgatatccaacactggaggtgatacgtcatcatctcactacattgctgcaagtgaggctcttccaccttcggacgctggcccttgtcctctttgcggcgtcaccagttgctacgggtgcgcattcccacagcatgaagagattaagcaggagaagaagcataaaggagtgaggaagaagccatcaggaaaatggtcggcggaaatatgggatccgagtacaagaacaaggaggtggcttggaacgtttccgacggcagagatggcagcggatgcttacgatgaggcagcggctgcgcttgtcgaaaaaagatcagcgagacgtggctcaaagaagggagaaggaagcattcaccaagaagtcggcggcggagatgactgagaaattaagctatataactatatatcgttttatagggggaaaaatagatgttttgggagaaattaatacattacctagatgggttatatgttttacgagaaaccacttgcgtgtgttttttttttaataagaggtt

SEQ ID NO: 1220 - protein, 162 aa, Arabidopsis thaliana
  G1840,AP2 domain coordinates 87-154
MDYSENVQNKNFTPISQPPNLTRDQEHAIMVSTLRQVISNTGGDTSSSHYIAASEALPPSDAGPCPLCGVTSCYGCAFPQHEEIKQEKKHKGVRKKPSGKWSAEIWDPSTRTRRWLGTFPTAEMAADAYDEAAAALVEKRSARRGSKKGEGSIHQEVGGGDD

SEQ ID NO: 1221 - DNA, 1009 bp, Arabidopsis thaliana
  G1841,family:AP2
cattccgaaaagtacttgtttattggtgttattcatcgctgctcaaggtggcaaaccaaggagaacaagaagagtccagggccaatgagcctgagggtatcaaatcagtgattgatgacatctacatttttgaagacgaccctgtggttgataggttcaataggtttggcacggagatgtctgccatggtctcggccttgacacaggtggtttctgctcgctctcagactgaggctgaaggtgctcactctcagactgaggctgaaggtgctcactcttcttcctcttcggctggacataaaagaggatggcttggaatcgattctgctcctattccctcatcatttgctcgtgtagactcttcacataatccgatcgaagaatccatgagcaaggcatttccagaggaagcaagggagaaaaaaaggaggtacagaggagtaaggcagagaccatggggcaaatgggcagctgagatacgtgatccacatagagccgctagggtttggctcgggacgtttgatacagcggaggccgcggctagagcctacgacgaggctgcactccggttccgtggaaataaagcaaagctaaatttcccagaggatgtaaggattcttcctcctccccctcctcttcttcgttcaccagctgacacggtggcgaataaagcagaagaggatctgataaattattggagttatacaaagttgttgcaaagttcaggccaacggtcatttctcgagcgaggacaagaagagagtagtaacatatttgaacattcaccaatggaacaacctctgcctccttcaagttctggtccaagttcctctaattttcctgcaccttctctacctaatacatagtttcacttttattaaagctctacaaatacaattaaatacatagctaaatgaaaatgattttcttgtctgtataccttcttaagtgctaaacaatatattgtactctttgttttccttaactaaaaaaaaaaaaaaaaaaaaaa

SEQ ID NO: 1222 - protein, 229 aa, Arabidopsis thaliana
  G1841,AP2 domain coordinates 83-150
MSAMVSALTQVVSARSQTEAEGAHSQTEAEGAHSSSSSAGHKRGWLGIDSAPIPSSFARVDSSHNPIEESMSKAFPEEAREKKRRYRGVRQRPWGKWAAEIRDPHRAARVWLGTFDTAEAAARAYDEAALRFRGNKAKLNFPEDVRILPPPPPLLRSPADTVANKAEEDLINYWSYTKLLQSSGQRSFLERGQEESSNIFEHSPMEQPLPPSSSGPSSSNFPAPSLPNT

SEQ ID NO: 1223 - DNA, 1059 bp, Arabidopsis thaliana
  G1842,family:MADS
actattacatgcctcttcctcgcttcaaaacggcaccgtttccacttgttattatttttctctctatcgtctaacaaaaaaaaaaactgacttgggattttttttcatttgtctagcccaaaagaagaagatagaaacgaagaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgcttgt

SEQ ID NO: 1224 - protein, 196 aa, Arabidopsis thaliana
  G1842,MADS domain coordinates 2-57
MGRRKVEIKRIENKSSRQVTFSKRRKGLIEKARQLSILCESSIAVVAVSGSGKLYDSASGDNMSKIIDRYEIHHADELKALDLAEKIRNYLPHKELLEIVQSKLEESNVDNVSVDSLISMEEQLETALSVIRAKKTELMMEDMKSLQEREKLLIEENQILASQVGKKTFLVIEGDRGMSRENGSGNKVPETLSLLK

SEQ ID NO: 1225 - DNA, 818 bp, Arabidopsis thaliana
  G1843,family:MADS
cagacatcacaatcaaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggagatgcatcaaataaagtaattgatttttattgtta

SEQ ID NO: 1226 - protein, 200 aa, Arabidopsis thaliana
  G1843,MADS domain coordinates 2-57
MGRRKVEIKRIENKSSRQVTFCKRRNGLMEKARQLSILCESSVALIIISATGRLYSFSSGDSMAKILSRYELEQADDLKTLDLEEKTLNYLSHKELLETIQCKIEEAKSDNVSIDCLKSLEEQLKTALSVTRARKTELMMELVKTHQEKEKLLREENQSLTNQLIKMGKMKKSVEAEDARAMSPESSSDNKPPETLLLLK

SEQ ID NO: 1227 - DNA, 834 bp, Arabidopsis thaliana
  G1844,family:MADS
agaaattaggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatca

SEQ ID NO: 1228 - protein, 198 aa, Arabidopsis thaliana
  G1844,MADS domain coordinates 2-57
MGRRRVEIKRIENKSSRQVTFCKRRNGLMEKARQLSILCGSSVALFIVSSTGKLYNSSSGDSMAKIISRFKIQQADDPETLDLEDKTQDYLSHKELLEIVQRKIEEAKGDNVSIESLISMEEQLKSALSVIRARKTELLMELVKNLQDKEKLLKEKNKVLASEVGKLKKILETGDERAVMSPENSSGHSPPETLPLLK

SEQ ID NO: 1229 - DNA, 1160 bp, Arabidopsis thaliana
  G1846,family:AP2
aatttcataaatcatagagagagagagagagagagagagagagtttggaaacattccaaaaccagaactcgatattatttcaccaaagaatgatagaaacaagaactatctttttataaaactctttacaccccaaaagaaaatgtctcactcgttttgccttataatatttctttcaacaacaacccaaatctacaaaaaatcccaataaaaaaaaacttcagtctgtttgacattttgtcgaacacttggacggcatcacaaaaagctctaaactttctgactaccaatggcggattcgtcttccgacaaggagaagaaggaaaataataagcagcccgtgtatcgtggagtccgtatgaggagctggggaaaatgggtatcggagattcgcgaaccgaggaagaaatcgagaatctggctcgggacttttccgacggcggagatggctatgcgtgctcacgacgtggcggctatgagtatcaaaggaacttcagccattctcaatttccctgagctctctaaacttcttccccgacccgtttcgctcagccctcgtgacgtcagagctgcggcgaccaaagctgctctcatggacttcgatacgacggcgtttcgttcggatactgagactagcgaaacgacgacgtcgaataaaatgtcagagagtagtgagagtaacgaaacggtgtcgttctcatcgtcgtcttggtcctctgttacgagcattgaggaaagtacagtctccgacgatcttgacgagatcgtaaagttaccgagtctaggaacgagcctaaacgagtcgaacgagttcgtgatatttgactcgttggaggatttggtgtacatgcctcggtggttaagcggtacggaagaagaagtttttacgtataataacaatgattcttcgttgaattactcatcagttttcgaatcttggaaacattttccctgagaaaagaaagaagccatattttctctctctttttcgccatttttggttttaagttttttgatgggattctctctgtttttgctatgcgtgagatatctctctttgtggaatagataacttttctgttgaaaatctcctaagtctgtgaaatgaacgacgatggaaatgtaagtgtgtatattagcccgaaataatgactgtatac

SEQ ID NO: 1230 - protein, 221 aa, Arabidopsis thaliana
  G1846,AP2 domain coordinates 16-83
MADSSSDKEKKENNKQPVYRGVRMRSWGKWVSEIREPRKKSRIWLGTFPTAEMAMRAHDVAAMSIKGTSAILNFPELSKLLPRPVSLSPRDVRAAATKAALMDFDTTAFRSDTETSETTTSNKMSESSESNETVSFSSSSWSSVTSIEESTVSDDLDEIVKLPSLGTSLNESNEFVIFDSLEDLVYMPRWLSGTEEEVFTYNNNDSSLNYSSVFESWKHFP

SEQ ID NO: 1231 - DNA, 1134 bp, Arabidopsis thaliana
  G1850,family:HS
atgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatga

SEQ ID NO: 1232 - protein, 377 aa, Arabidopsis thaliana
  G1850,HS domain coordinates 59-150
MPGEQTGETPTVAGVGGGGAGCSAGNSGGSSGCGAGGGGGGSGGGGGGGGDSQRSIPTPFLTKTYQLVEDPVYDELISWNEDGTTFIVWRPAEFARDLLPKYFKHNNFSSFVRQLNTYGFRKVVPDRWEFSNDCFKRGEKILLRDIQRRKISQPAMAAAAAAAAAAVAASAVTVAAVPVVAHIVSPSNSGEEQVISSNSSPAAAAAAIGGVVGGGSLQRTTSCTTAPELVEENERLRKDNERLRKEMTKLKGLYANIYTLMANFTPGQEDCAHLLPEGKPLDLLPERQEMSEAIMASEIETGIGLKLGEDLTPRLFGVSIGVKRARREEELGAAEEEDDDRREAAAQEGEQSSDVKAEPMEENNSGNHNGSWLELGK

SEQ ID NO: 1233 - DNA, 1927 bp, Arabidopsis thaliana
  G1852,family:AKR
catctgatctgctctcgaagacgaaagcttcgagtactggttgaagctaaagctatgggacacgtgaatctacctgcatcaaagcgtggtaaccctcgtcaatggcgtctcctcgacatcgtaaccgctgctttcttcggtatcgtacttctcttcttcatccttttattcactcctcttggtgattccatggcggcttctggtcggcaaacgctgcttctctctacggcgtcagatccgaggcaacggcagcgattagtgactttggttgaagctggtcagcatttgcaaccgatcgagtattgtcctgcggaagctgttgctcatatgccttgtgaggatccgagaaggaatagtcagcttagtagagagatgaatttctatagggagagacattgtcctttgcctgaggagactccgctctgtttgattcctccgccttctggttataaaattcctgttccgtggcctgagagtcttcacaagatttggcatgcaaacatgccatataacaaaattgctgaccggaaaggtcatcaaggatggatgaaaagggaaggggaatactttactttcccaggcggtggcacgatgtttcctggcggagctggccaatacattgaaaagcttgcacagtatattccgcttaatggtggaactttgagaactgctcttgacatgggatgcggggtagctagttttggaggtactctactatctcaaggcattctagccctctcatttgctccaagagattcacataaatctcaaattcagttcgctttggaaagaggagtgcctgcatttgttgccatgcttggcactcgtagactcccctttcctgcatactcctttgacctgatgcactgttcccgatgtttgattccttttacggcttacaatgcaacttacttcatcgaagtagataggttactgcgccctggaggatatcttgtaatctctggcccacctgtacaatggcctaaacaagacaaagaatgggctgatcttcaggcggtggctagagctttgtgctatgagctaattgcggttgatggaaacactgtcatctggaagaagcctgttggagattcatgtctacctagccagaatgagtttgggcttgagttgtgtgatgagtctgttccgccaagtgatgcatggtattttaaattgaagaggtgtgttaccaggccatcatccgtcaaaggagaacacgctttgggaactatatccaagtggccggagaggcttactaaagttccttctagggccattgtcatgaaaaacggattggatgtgtttgaagcagatgcaaggcggtgggcaagacgcgttgcttattacagggattctcttaacttgaagctgaaatctccaactgtccgcaatgtcatggacatgaacgcattcttcggaggctttgcagcaacccttgcatctgatcctgtgtgggttatgaatgtcattccagctcggaagccattaactcttgacgtgatttatgacagaggtctcatcggtgtttaccatgattggtgtgaaccattttcaacatatccccgcacgtatgatttcatccatgtatcaggaattgaatcactgataaaacgacaagactcaagcaaatcgaggtgtagcctagtagatctaatggtagagatggacagaatattacgtccagaaggaaaggttgtgatccgagactctcctgaggtgctagataaagtcgcacgaatggctcatgctgtaagatggtcttcttccatacacgagaaagaacctgaatcccatggaagagagaagattcttatcgcaaccaaatctctctggaaattgccatcaaactcccactgaagacacaaaagaagaagaaaagaagaagctcttctcaatcttgtaggtactgtcacttgctctccagccc

SEQ ID NO: 1234 - protein, 600 aa, Arabidopsis thaliana
  G1852,AKR domain coordinates 90-590
MGHVNLPASKRGNPRQWRLLDIVTAAFFGIVLLFFILLFTPLGDSMAASGRQTLLLSTASDPRQRQRLVTLVEAGQHLQPIEYCPAEAVAHMPCEDPRRNSQLSREMNFYRERHCPLPEETPLCLIPPPSGYKIPVPWPESLHKIWHANMPYNKIADRKGHQGWMKREGEYFTFPGGGTMFPGGAGQYIEKLAQYIPLNGGTLRTALDMGCGVASFGGTLLSQGILALSFAPRDSHKSQIQFALERGVPAFVAMLGTRRLPFPAYSFDLMHCSRCLIPFTAYNATYFIEVDRLLRPGGYLVISGPPVQWPKQDKEWADLQAVARALCYELIAVDGNTVIWKKPVGDSCLPSQNEFGLELCDESVPPSDAWYFKLKRCVTRPSSVKGEHALGTISKWPERLTKVPSRAIVMKNGLDVFEADARRWARRVAYYRDSLNLKLKSPTVRNVMDMNAFFGGFAATLASDPVWVMNVIPARKPLTLDVIYDRGLIGVYHDWCEPFSTYPRTYDFIHVSGIESLIKRQDSSKSRCSLVDLMVEMDRILRPEGKVVIRDSPEVLDKVARMAHAVRWSSSIHEKEPESHGREKILIATKSLWKLPSNSH

SEQ ID NO: 1235 - DNA, 1902 bp, Arabidopsis thaliana
  G1855,family:AKR
atggcgaaagagaacagtggtcatcatcaccaaacagaagcaagaagaaagaaactaactttgattcttggtgtaagtggactctgcattttgttctatgttttaggtgcatggcaagccaataccgtcccatcttctatctcgaagctcggatgcgagacgcaatcaaacccttcttcgtcctcttcctcttcctcatcttcagagtcagctgaactagatttcaaaagccataatcagattgagttaaaggaaacaaaccaaaccattaagtactttgaaccatgtgaattatctctcagtgagtacactccttgtgaagaccgacaaagaggaagaagattcgataggaacatgatgaaatatagagaaagacattgtcctgtaaaagatgagcttctttattgtttgattcctcctccaccaaactacaagattccatttaaatggccacaaagtagagactatgcttggtatgacaatatccctcacaaggaacttagtgttgagaaagcagttcaaaactggattcaagttgaaggtgaccgctttagattccctggtggtggtactatgtttcctcgtggagctgatgcttatatcgatgatattgctaggcttattcctcttactgatggtggaatcagaacagctattgacactggatgtggtgttgcaagttttggtgcttacctcttgaagagagacattatggctgtgtcttttgctccaagagacactcatgaagctcaggtacagtttgctttagaacgcggagttcctgcgataatcgggattatgggatcaagaagacttccttatccagctagagcttttgatcttgctcattgttctcgttgtttgatcccttggtttaaaaatgatggtttgtaccttatggaggtcgaccgggttttaagaccgggcggttactggatcctctcgggaccaccgattaactggaaacagtactggagagggtgggagagaacagaggaggatttgaagaaagagcaagattcaatagaagatgtagcaaagagtctttgctggaagaaagtaactgaaaaaggtgacttatcaatttggcaaaagcctctcaatcacattgagtgtaaaaagctcaaacaaaacaataagtcacctccgatatgcagctcagataacgcggattccgcttggtacaaagacttggaaacttgtataacaccattaccagaaacaaacaatccagatgattcagcaggcggtgcactcgaggattggccagaccgagcattcgcggtacctccaagaatcatcagaggaactataccagaaatgaacgcggagaaatttagagaagacaacgaggtttggaaagagagaatagcacattacaagaagatagtccctgagctttcacatggaagattcaggaacattatggacatgaacgcttttctcggcggattcgctgcttccatgctgaaatatccctcatgggtcatgaacgttgtcccggtcgatgcagagaaacaaacgttaggtgtgatctacgaacgtggattgatagggacgtatcaagattggtgtgaaggattctcaacgtatccaagaacttatgatatgattcatgcaggaggattgttcagcttatacgaacataggtgtgatttgacgttgatattgttggagatggatcgaattttgagaccagaaggaacagttgtgttgagagataatgtggagacgttgaataaggtagagaagatagtgaagggaatgaagtggaagagtcaaattgttgatcatgagaaaggtccttttaatcctgagaagattcttgttgctgttaaaacttattggactggtcaaccttctgacaagaacaacaacaacaacaacaacaacaacaactag

SEQ ID NO: 1236 - protein, 633 aa, Arabidopsis thaliana
  G1855,AKR domain coordinates 102-613
MAKENSGHHHQTEARRKKLTLILGVSGLCILFYVLGAWQANTVPSSISKLGCETQSNPSSSSSSSSSSESAELDFKSHNQIELKETNQTIKYFEPCELSLSEYTPCEDRQRGRRFDRNMMKYRERHCPVKDELLYCLIPPPPNYKIPFKWPQSRDYAWYDNIPHKELSVEKAVQNWIQVEGDRFRFPGGGTMFPRGADAYIDDIARLIPLTDGGIRTAIDTGCGVASFGAYLLKRDIMAVSFAPRDTHEAQVQFALERGVPAIIGIMGSRRLPYPARAFDLAHCSRCLIPWFKNDGLYLMEVDRVLRPGGYWILSGPPINWKQYWRGWERTEEDLKKEQDSIEDVAKSLCWKKVTEKGDLSIWQKPLNHIECKKLKQNNKSPPICSSDNADSAWYKDLETCITPLPETNNPDDSAGGALEDWPDRAFAVPPRIIRGTIPEMNAEKFREDNEVWKERIAHYKKIVPELSHGRFRNIMDMNAFLGGFAASMLKYPSWVMNVVPVDAEKQTLGVIYERGLIGTYQDWCEGFSTYPRTYDMIHAGGLFSLYEHRCDLTLILLEMDRILRPEGTVVLRDNVETLNKVEKIVKGMKWKSQIVDHEKGPFNPEKILVAVKTYWTGQPSDKNNNNNNNNNN

SEQ ID NO: 1237 - DNA, 1316 bp, Arabidopsis thaliana
  G1863,family:GRF-like
ccattatccttaaagtaaccaacacttctctctctctttcttcaatggatttgcaactgaaacaatggagaagccagcagcagcaacaacatcagacagagtcagaagaacaaccttctgcagctaagataccaaaacatgtctttgaccagattcattctcacactgcaacttctactgctcttcctctctttacccctgagcctacttcttctaaactctcctctttgtctcctgattcttcctccaggttccccaagatggggagcttctttagctgggcacagtggcaagaacttgaactacaagctctgatctacaggtacatgttggctggtgctgctgttcctcaggagctccttttaccaatcaagaaaagccttctccatctatctccttcctactttcttcaccatcctcttcaacacctacctcattaccaacctgcttggtatttgggaagggcagcgatggatcctgagccaggcagatgcaggagaacggatggtaagaagtggagatgttcaagagacgtcttcgctggccacaagtattgcgagcgccacatgcaccgtggccgcaaccgttcaagaaagcctgtggaaactccaaccaccgtcaatgcaactgccacgtccatggcttcatcagtagcagccgcagccaccactacaacagcaacaacaacatctacgtttgcttttggtggtggtggtggtagtgaggaagtggttggtcaaggaggatctttcttcttctctggctcttctaactcttcatctgaacttctccaccttagtcaaagttgttcggagatgaagcaagaaagcaacaacatgaacaacaagaggccatacgagtcccacatcggattcagtaacaacagatcagatggaggacacatcctgaggcccttctttgacgattggcctcgttcttcgctccaagaagctgacaatagttcaagccccatgagctcagccacttgtctctccatctccatgcccgggaactcttcctcagacgtctctctgaagctgtccacaggcaacgaagagggagcccggagcaacaacaatgggagagatcagcaaaacatgagctggtggagcggtggaggttccaaccaccatcatcacaacatgggcggaccattggccgaagccctgagatcttcttcctcatcttccccaaccagtgttctccatcagcttggtgtctcgacacaagcctttcattgaccagtgtaaaaccaacacaacaatgcggtttttactgtgtttttggtttttatccaaatttcctgtataaagagg

SEQ ID NO: 1238 - protein, 398 aa, Arabidopsis thaliana
  G1863,GRF-like domain coordinates 76-187
MDLQLKQWRSQQQQQHQTESEEQPSAAKIPKHVFDQIHSHTATSTALPLFTPEPTSSKLSSLSPDSSSRFPKMGSFFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVETPTTVNATATSMASSVAAAATTTTATTTSTFAFGGGGGSEEVVGQGGSFFFSGSSNSSSELLHLSQSCSEMKQESNNMNNKRPYESHIGFSNNRSDGGHILRPFFDDWPRSSLQEADNSSSPMSSATCLSISMPGNSSSDVSLKLSTGNEEGARSNNNGRDQQNMSWWSGGGSNHHHHNMGGPLAEALRSSSSSSPTSVLHQLGVSTQAFH

SEQ ID NO: 1239 - DNA, 952 bp, Arabidopsis thaliana
  G1865,family:GRF-like
aagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttgatcatcttttgttcttataaccttgtatttcttgttaagatggtaatgcaaatt

SEQ ID NO: 1240 - protein, 283 aa, Arabidopsis thaliana
  G1865,GRF-like domain coordinates 45-162
MDTLSIKTYLLLSYTFNFPIQIPIFNLSFFFISLSLSLFMATRIPFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKPPPTQFTPNLFLDSSSRRRRSGYMDDFFSIEPSGSIKSCSGSAMEDNDDGSCRGINNEEKQPDRHCFILGTDLRTRERPLMLEEKLKQRDHDNEEEQGSKRFYRFLDEWPSSKSSVSTSLFI

SEQ ID NO: 1241 - DNA, 1774 bp, Arabidopsis thaliana
  G1868,family:GRF-like
tcccatggcaactatctctcaagtcattatctaactttttttccttctttttctttttatattacttacttcttatggatattggtgttcatgttcttgggtcggttactagtaatgaaaatgagtcacttggtctaaaagagcttataggaactaaacaagatagatccggattcatcggtgaggattgcttgcaacgaagcttgaagctagcaagaacgacaactagagcggaagaagaagaaaacttgtcttcttctgttgcagctgcttattgcaaaacgatgtcgtttcaccaaggcattcctctcatgagatctgcttctcctctttcctctgattctcgccgtcaagaacaaatgcttagcttctcagataaaccagacgctcttgatttcagtaaatatgtcggtttggataatagcagtaataacaagaactctctctcgccgtttcttcaccagattcctccaccttcttactttagaagctcaggaggatatggttctggtggaatgatgatgaacatgagcatgcaagggaacttcacaggtgttaaaggaccttttacattgactcaatgggctgagttagagcaacaggcgttgatctataagtacatcacagccaatgtccctgttccttctagtttgctcatctctatcaagaagtctttttatccttacggatctttgcctcctagttccttcggatggggaactttccatctcggtttcgcaggcggtaacatggaccctgagccagggagatgccgcagaacagatgggaagaaatggcggtgctcaagagacgccgttcctgatcagaaatactgtgaaagacacatcaacagaggccgtcatcgttcaagaaagcctgtggaagtccaatctggccaaaaccaaaccgccgctgctgcatccaaagcggttactacaccacaacagcctgttgtcgctggtaatactaacagaagcaatgcccgtgcatcaagcaaccgcagcctcgccattggaagtcaatatatcaatccttctacagaatctttacctaacaacagaggagtttcgatatatccttccaccgtcaacttacaacccaaggaatctccggttattcatcagaaacacagaaacaacaacaacccttttgagtttggacacaaatcctctgattcgttactcaacccgaataccgcaaagacctatggatcatcgttcttggatttcagcagcaaccaagagaagcattcagggaatcacaatcacaattcttggcctgaagagctgacatcagattggacacagctctcaatgtcaattccaatagcatcatcatccccttcctccacacacaacaacaacaatgctcaagaaaaaacaacactctcgcctctcaggctatcccgcgagcttgacctatcgatccaaaccgatgaaacaacaatcgagcctactgtgaaaaaggtgaatacttggataccaatctcatggggaaactccttaggaggtcctctaggtgaagtactaaacagtacaacgaatagtccaacatttggatcttctcctacaggggttttgcaaaagtccacattttgttcactctctaacaacagctccgtgagcagccccattgcagagaacaacagacacaatggcgattactttcattacacaacctgaaaactgaaaccaagtcctgcggcaggaaacaaaaaaagaaaagctctgttttttctctttcattatgttctgtttcgtctttctaaagctgc

SEQ ID NO: 1242 - protein, 535 aa, Arabidopsis thaliana
  G1868,GRF-like domain coordinates 164-270
MDIGVHVLGSVTSNENESLGLKELIGTKQDRSGFIGEDCLQRSLKLARTTTRAEEEENLSSSVAAAYCKTMSFHQGIPLMRSASPLSSDSRRQEQMLSFSDKPDALDFSKYVGLDNSSNNKNSLSPFLHQIPPPSYFRSSGGYGSGGMMMNMSMQGNFTGVKGPFTLTQWAELEQQALIYKYITANVPVPSSLLISIKKSFYPYGSLPPSSFGWGTFHLGFAGGNMDPEPGRCRRTDGKKWRCSRDAVPDQKYCERHINRGRHRSRKPVEVQSGQNQTAAAASKAVTTPQQPVVAGNTNRSNARASSNRSLAIGSQYINPSTESLPNNRGVSIYPSTVNLQPKESPVIHQKHRNNNNPFEFGHKSSDSLLNPNTAKTYGSSFLDFSSNQEKHSGNHNHNSWPEELTSDWTQLSMSIPIASSSPSSTHNNNNAQEKTTLSPLRLSRELDLSIQTDETTIEPTVKKVNTWIPISWGNSLGGPLGEVLNSTTNSPTFGSSPTGVLQKSTFCSLSNNSSVSSPIAENNRHNGDYFHYTT

SEQ ID NO: 1243 - DNA, 1320 bp, Arabidopsis thaliana
  G1880,family:Z-C2H2
atgttgtccaacaagaacacaaacacatgttgtgtggtttcttcttcttcttctgatcctttcctctcctcttcagaaaatggggtcaccaccacaaacacatccactcagaagaggaaaagaagacctgcaggtaccccagatccagatgcagaagttgtgtctttatcaccaagaactcttcttgaatcagacagatacatatgtgagatctgtaaccaagggtttcaaagagaccagaatctccagatgcatagaagacgtcacaaagttccatggaagcttcttaaaagagacaacaacatagaggtgaagaaacgagtctatgtttgccctgaacccacttgccttcaccataatccttgtcatgctctgggagatcttgtcggcatcaaaaaacatttcagaagaaaacatagtaaccataagcaatgggtttgtgagagatgctctaaaggttatgctgttcaatctgattacaaagctcatctcaaaacttgtggtactagaggacattcttgtgactgtggtcgtgtcttctccagggtggagagttttattgaacatcaagataattgttccgcacggagagttcaccgtgaaccgcctcgaccaccacaaaccgcggtaacagtcccggcatgctcttctagaaccgcctcaaccgtcagcactccgtctagtgaaaccaattacggcggtacagttgcggttacgactcctcaacctctagaaggccgtccaattcatcagagaatctcatcttcaattctcaccaactcatcaaacaatctcaacctcgaactccaacttcttccattatcgtcgaatcaaaaccctaatcaagaaaaccaacaacaaaaagttaaagaaccatctcatcatcataatcataatcatgataccacaaacttaaacctctccattgcaccatcatcatcatatcaacattacaacaactttgatcgtataaaagagattatggcgagcgagcaaattatgaagatagcgatgaaggagaaagcttacgctgaggaagctaaaagagaagccaagaggcaacgagagatagcggaaaacgagtttgcaaatgccaaaaagattaggcaaaaagcacaagctgaactcgagagagctaagtttttaaaggaacaatctatgaagaagataagttcaacgatcatgcaggtcacttgtcaaacatgtaaaggacagtttcaagcagttgcggttccggcggctacggctgatgagacgtctcttgtcgtgagttacatgtcgtcagcgaatactgacggagagttggaaaatggtttttaa

SEQ ID NO: 1244 - protein, 439 aa, Arabidopsis thaliana
  G1880,Z-C2H2 domain coordinates 69-89,111-139
MLSNKNTNTCCVVSSSSSDPFLSSSENGVTTTNTSTQKRKRRPAGTPDPDAEVVSLSPRTLLESDRYICEICNQGFQRDQNLQMHRRRHKVPWKLLKRDNNIEVKKRVYVCPEPTCLHHNPCHALGDLVGIKKHFRRKHSNHKQWVCERCSKGYAVQSDYKAHLKTCGTRGHSCDCGRVFSRVESFIEHQDNCSARRVHREPPRPPQTAVTVPACSSRTASTVSTPSSETNYGGTVAVTTPQPLEGRPIHQRISSSILTNSSNNLNLELQLLPLSSNQNPNQENQQQKVKEPSHHHNHNHDTTNLNLSIAPSSSYQHYNNFDRIKEIMASEQIMKIAMKEKAYAEEAKREAKRQREIAENEFANAKKIRQKAQAELERAKFLKEQSMKKISSTIMQVTCQTCKGQFQAVAVPAATADETSLVVSYMSSANTDGELENGF

SEQ ID NO: 1245 - DNA, 741 bp, Arabidopsis thaliana
  G1884,family:Z-Dof
atgatgacgtcatcccatcagagcaacaccaccggctttaaaccgcggcggatcaagacgacggcgaagccaccacgtcagatcaataacaaagaaccatctccggcgacgcagccggtgctcaagtgtccgagatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaa

SEQ ID NO: 1246 - protein, 246 aa, Arabidopsis thaliana
  G1884,Z-Dof domain coordinates 43-71
MMTSSHQSNTTGFKPRRIKTTAKPPRQINNKEPSPATQPVLKCPRCDSVNTKFCYYNNYSLSQPRHYCKNCRRYWTRGGALRNVPIGGSTRNKNKPCSLQVISSPPLFSNGTSSASRELVRNHPSTAMMMMSSGGFSGYMFPLDPNFNLASSSIESLSSFNQDLHQKLQQQRLVTSMFLQDSLPVNEKTVMFQNVELIPPSTVTTDWVFDRFATGGGATSGNHEDNDDGEGNLGNWFHNANNNALL

SEQ ID NO: 1247 - DNA, 729 bp, Arabidopsis thaliana
  G1888,family:Z-CO-like
atgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttga

SEQ ID NO: 1248 - protein, 242 aa, Arabidopsis thaliana
  G1888,Z-CO-like domain coordinates 5-50
MKIWCAVCDKEEASVFCCADEAALCNGCDRHVHFANKLAGKHLRFSLTSPTFKDAPLCDICGERRALLFCQEDRAILCRECDIPIHQANEHTKKHNRFLLTGVKISASPSAYPRASNSNSAAAFGRAKTRPKSVSSEVPSSASNEVFTSSSSTTTSNCYYGIEENYHHVSDSGSGSGCTGSISEYLMETLPGWRVEDLLEHPSCVSYEDNIITNNNNSESYRVYDGSSQFHHQGFWDHKPFS

SEQ ID NO: 1249 - DNA, 1047 bp, Arabidopsis thaliana
  G1893,family:Z-C2H2
atggctgatccagattgtatcttcagaaatggatatgtagactactataactatagcttcaactatgccacttccctctcacgcatctacaactctcatgacagcttttattatcctcaccagacgacaaacccaaacatcaacgaaaaccctaatttgacttcacctgactctcctccacttagagaagccctccctctccttagcttaagccccattcataagcatcaagaacctactgctaaccaccatgagtactatttcatggagacgacagaaacttcctctaattcaaactttcttgatcaatgccaagacagttatcgtcatgatgtaaccgtggatcttcatctagggttaccaaacctcggtgatggtggaagcagcagcagcgatgtggtccttgattccaccgaccaccaagagggtcaccatgatcatcatcaagatcaaggacttgaagttactatggcttctgaccatgatgatgaacatggtggcttacaaaggggtaatcatcttcatcacttttggatcccgactccttctcagattctgatgggtccaacacagttctcttgtcctctatgcttcaagactttcaacagatacaacaacatgcaaatgcacatgtggggacatggttcacaatacagaaaaggaccggagtcgctgagagggacacaaccaacggcgatgctgaagctgccttgctactgctgtgcaccgggctgcaagaacaacatagaccacccaagggctaggccgctcaaggacttccgtacgcttcagacacattacaagcggaagcacggtgtgaggccctttgcttgtcgtaggtgtgggaaggcatttgcggtcaaaggagattggaggactcacgagaagaactgtgggaagctatggtattgctcatgtgggtcggattttaagcacaagaggtcacttaaagaccacgttaaggcctttgggaatggtcatgtcccttgttgtggaattgatcatgaggaagaggaggctgcttctgatgtcgagcagcaagaatga

SEQ ID NO: 1250 - protein, 348 aa, Arabidopsis thaliana
  G1893,Z-C2H2 domain coordinates 73-185
MADPDCIFRNGYVDYYNYSFNYATSLSRIYNSHDSFYYPHQTTNPNINENPNLTSPDSPPLREALPLLSLSPIHKHQEPTANHHEYYFMETTETSSNSNFLDQCQDSYRHDVTVDLHLGLPNLGDGGSSSSDVVLDSTDHQEGHHDHHQDQGLEVTMASDHDDEHGGLQRGNHLHHFWIPTPSQILMGPTQFSCPLCFKTFNRYNNMQMHMWGHGSQYRKGPESLRGTQPTAMLKLPCYCCAPGCKNNIDHPRARPLKDFRTLQTHYKRKHGVRPFACRRCGKAFAVKGDWRTHEKNCGKLWYCSCGSDFKHKRSLKDHVKAFGNGHVPCCGIDHEEEEAASDVEQQE

SEQ ID NO: 1251 - DNA, 1503 bp, Arabidopsis thaliana
  G1895,family:Z-Dof
cgtcgaccacataacacaaatctaatctcatactccatcttcttttctgtcttatgtcttcaaagattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatggtatgtttcatggtcttacctttatttgttaagaaatgctaaagatttaatattttctctagtccttgtatcagtttgaaactagttcatgatgttaatcctaatccaagttccttcaatttttttcagatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcatgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataacgttaaaggagaaaagaaactttgtagatacctttttttgtgtgatgaattaacttttaatatctatcttatttatataccacaatccccattttgtagattatccaaacagatggaaatgctgaagtgtaatgtcttttttggtaaatgtggttcgaaaatattgtttactccattatttgtattctgtagtactagtgtc

SEQ ID NO: 1252 - protein, 317 aa, Arabidopsis thaliana
  G1895,Z-Dof domain coordinates 58-100
MNNQSVTDNTSLKLSSNLNNESKETSENSDDQHSEITTITSEEEKTTELKKPDKILPCPRCNSADTKFCYYNNYNVNQPRHFCRKCQRYWTAGGSMRIVPVGSGRRKNKGWVSSDQYLHITSEDTDNYNSSSTKILSFESSDSLVTERPKHQSNEVKINAEPVSQEPNNFQGLLPPQASPVSPPWPYQYPPNPSFYHMPVYWGCAIPVWSTLDTSTCLGKRTRDETSHETVKESKNAFERTSMLLESQSIKNETSMATNNHVWYPVPMTREKTQEFSFFSNGAETKSSNNRFVPETYLNLQANPAAMARSMNFRESI

SEQ ID NO: 1253 - DNA, 678 bp, Arabidopsis thaliana
  G1897,family:Z-Dof
atgccttctgaattcagtgaatctcgtcgggttcctaagattccccacggccaaggaggatctgttgcgattccgacggatcaacaagagcagctttcttgtcctcgctgtgaatcaaccaacaccaagttctgttactacaacaactacaacttctcacaacctcgtcatttctgcaagtcttgtcgccgttactggactcatggaggtactctccgtgacattcccgtcggtggtgtttcccgtaaaagctcaaaacgttcccggacttattcctctgccgctaccacctccgttgtcggaagccggaactttcccttacaagctacgcctgttcttttccctcagtcgtcttccaacggcggtatcacgacggcgaagggaagtgcttcgtcgttctatggcggtttcagctctttgatcaactacaacgccgccgtgagcagaaatgggcctggtggcgggtttaatgggccagatgcttttggtcttgggcttggtcacgggtcgtattatgaggacgtcagatatgggcaaggaataacggtctggccgttttcaagtggcgctactgatgctgcaactactacaagccacattgctcaaatacccgccacgtggcagtttgaaggtcaagagagcaaagtcgggttcgtgtctggagactacgtagcgtga

SEQ ID NO: 1254 - protein, 225 aa, Arabidopsis thaliana
  G1897,Z-Dof domain coordinates 34-62
MPSEFSESRRVPKIPHGQGGSVAIPTDQQEQLSCPRCESTNTKFCYYNNYNFSQPRHFCKSCRRYWTHGGTLRDIPVGGVSRKSSKRSRTYSSAATTSVVGSRNFPLQATPVLFPQSSSNGGITTAKGSASSFYGGFSSLINYNAAVSRNGPGGGFNGPDAFGLGLGHGSYYEDVRYGQGITVWPFSSGATDAATTTSHIAQIPATWQFEGQESKVGFVSGDYVA

SEQ ID NO: 1255 - DNA, 897 bp, Arabidopsis thaliana
  G1900,family:Z-Dof
atgctggaaactaaagatcctgcgataaagctctttggtatgaaaattcctttcccgacggttttagaggttgctgatgaagaagaagaaaagaaccaaaacaagacattaactgatcaatcggagaaagacaaaaccctaaagaaaccaaccaagattcttccatgtccaagatgcaacagcatggagactaagttctgttactacaacaactacaacgtaaaccaacctcgccatttttgtaaagcttgtcagagatattggacctcaggtgggaccatgagaagtgttccaatcggagcaggacggcgcaagaacaagaacaactcaccaacttcacattaccaccatgtgactatctccgaaacaaatggtccggtccttagtttcagcctcggagatgatcaaaaggtctcgagtaataggtttggtaatcaaaagctagttgctaggatagagaacaatgacgagcgctctaataacaacacttcgaacggtttgaattgttttccgggagtttcgtggccgtacacgtggaatcctgcgttttacccggtttacccttattggagcatgccagtgttgtcttctccggtaagttcaagtcctacttctactcttggtaagcattcgagagacgaagacgagacggtgaagcaaaaacagaggaatggatctgtattggttccaaagactttgagaattgatgatcctaatgaagctgcaaagagttcgatatggacaacacttgggatcaagaacgaagttatgttcaatgggtttggttcgaagaaagaggttaagctcagtaacaaagaagaaacagagacctcacttgttctttgtgcaaaccctgctgcgttatcaagatcaatcaatttccatgagcagatgtga

SEQ ID NO: 1256 - protein, 298 aa, Arabidopsis thaliana
  G1900,Z-Dof domain coordinates 54-106
MLETKDPAIKLFGMKIPFPTVLEVADEEEEKNQNKTLTDQSEKDKTLKKPTKILPCPRCNSMETKFCYYNNYNVNQPRHFCKACQRYWTSGGTMRSVPIGAGRRKNKNNSPTSHYHHVTISETNGPVLSFSLGDDQKVSSNRFGNQKLVARIENNDERSNNNTSNGLNCFPGVSWPYTWNPAFYPVYPYWSMPVLSSPVSSSPTSTLGKHSRDEDETVKQKQRNGSVLVPKTLRIDDPNEAAKSSIWTTLGIKNEVMFNGFGSKKEVKLSNKEETETSLVLCANPAALSRSINFHEQM

SEQ ID NO: 1257 - DNA, 615 bp, Arabidopsis thaliana
  G1902,family:Z-Dof
atgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactga

SEQ ID NO: 1258 - protein, 204 aa, Arabidopsis thaliana
  G1902,Z-Dof domain coordinates 31-59
MQDPAAYYQTMMAKQQQQQQPQFAEQEQLKCPRCDSPNTKFCYYNNYNLSQPRHFCKSCRRYWTKGGALRNVPVGGGSRKNATKRSTSSSSSASSPSNSSQNKKTKNPDPDPDPRNSQKPDLDPTRMLYGFPIGDQDVKGMEIGGSFSSLLANNMQLGLGGGGIMLDGSGWDHPGMGLGLRRTEPGNNNNNPWTDLAMNRAEKN

SEQ ID NO: 1259 - DNA, 1200 bp, Arabidopsis thaliana
  G1903,family:Z-Dof
atgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataa

SEQ ID NO: 1260 - protein, 399 aa, Arabidopsis thaliana
  G1903,Z-Dof domain coordinates 134-180
MSKSRDTEIKLFGRTITSLLDVNCYDPSSLSPVHDVSSDPSKEDSSSSSSSCSPTIGPIRVPVKKSEQESNKFKDPYILSDLNEPPKAVSEISSPRSSKNNCDQQSEITTTTTTSTTSGEKSTALKKPDKLIPCPRCESANTKFCYYNNYNVNQPRYFCRNCQRYWTAGGSMRNVPVGSGRRKNKGWPSSNHYLQVTSEDCDNNNSGTILSFGSSESSVTETGKHQSGDTAKISADSVSQENKSYQGFLPPQVMLPNNSSPWPYQWSPTGPNASFYPVPFYWGCTVPIYPTSETSSCLGKRSRDQTEGRINDTNTTITTTRARLVSESLRMNIEASKSAVWSKLPTKPEKKTQGFSLFNGFDTKGNSNRSSLVSETSHSLQANPAAMSRAMNFRESMQQ

SEQ ID NO: 1261 - DNA, 828 bp, Arabidopsis thaliana
  G1909,family:Z-Dof
atgggtggatcgatggcggagagagcaaggcaggccaacattcctccactagcgggacccctaaagtgtcctcgatgcgactccagcaacactaagttctgttactacaacaactataacctcactcagcctcgtcacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctccggtgaagatggaagaacaacctaatttggctaacttgtctagaccggtctccggtttgacgtctcctgggaatcaaacaaatcagtacttttggcctggttcggatttctcgggtccttctaatgatctcttgtga

SEQ ID NO: 1262 - protein, 275 aa, Arabidopsis thaliana
  G1909,Z-Dof domain coordinates 23-51
MGGSMAERARQANIPPLAGPLKCPRCDSSNTKFCYYNNYNLTQPRHFCKGCRRYWTQGGALRNVPVGGGCRRNNKKGKNGNLKSSSSSSKQSSSVNAQSPSSGQLRTNHQFPFSPTLYNLTQLGGIGLNLAATNGNNQAHQIGSSLMMSDLGFLHGRNTSTPMTGNIHENNNNNNNENNLMASVGSLSPFALFDPTTGLYAFQNDGNIGNNVGISGSSTSMVDSRVYQTPPVKMEEQPNLANLSRPVSGLTSPGNQTNQYFWPGSDFSGPSNDLL

SEQ ID NO: 1263 - DNA, 294 bp, Arabidopsis thaliana
  G1911,family:MYB-related
atggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaa

SEQ ID NO: 1264 - protein, 97 aa, Arabidopsis thaliana
  G1911,MYB-related domain coordinates 12-62
MASSSMSSQSSGSWTAKQNKAFEQALATYDQDTPNRWQNVAKVVGGKTTEEVKRHYELLVQDINSIENGHVPFPNYRTSGGCTNGRLSQEEKRYVLS

SEQ ID NO: 1265 - DNA, 885 bp, Arabidopsis thaliana
  G1917,family:GATA/Zn
atgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcggaggtgactctcttctcgctagacgctgtgccaactgtgacactacttctactccactatggaggaatggtcctagaggccctaagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatga

SEQ ID NO: 1266 - protein, 294 aa, Arabidopsis thaliana
  G1917,GATA/Zn domain coordinates 153-179
MQTPYTTSTQGQYCHSCGMFHHHSQSCCYNNNNNSNAGSYSMVFSMQNGGVFEQNGEDYHHSSSLVDCTLSLGTPSTRLCEEDEKRRRSTSSGASSCISNFWDLIHTKNNNSKTAPYNNVPSFSANKPSRGCSGGGGGGGGGGGGDSLLARRCANCDTTSTPLWRNGPRGPKSLCNACGIRFKKEERRTTAATGNTVVGAAPVQTDQYGHHNSGYNNYHAATNNNNNNGTPWAHHHSTQRVPCNYPANEIRFMDDYGSGVANNVESDGAHGGVPFLSWRLNVADRASLVHDFTR

SEQ ID NO: 1267 - DNA, 1521 bp, Arabidopsis thaliana
  G1919,family:RING/C3HC4
atggagtacgatggacggagaccctactctgttctaacgagaaatgaaattaccgtaaagatgaagaaacagatcaatgaaatctctgacatcttcttcatatcaaactccgatgcgaccgtacttcttatgtatctccgatgggactcgcttcgtgtttcagagcgtttaggtgaaaacaaggagaaattattgatggattcaggtttgaaatcagtcatgatcgatcccagtccagattcatctagcgagattagcttggagactgatgtttatgagtttgatggtgataatgatttaatctccatgcccttttgttctcacaagttcgactcaaaatattggagagagtatcttgagaagaatttctactatgtggagaaaatccaaaccacaatctcttgtcctgatcaagattgtcgatctgcggttggaccagacacgattgagaaactaacagtacgtgatcaagagatgtacgagaggtacatttggagatcttacattgaaggaaacaaggtattgatgatcaaacagtgtcctgcacggaattgcgattatgttattgagtttcatcaagagaatgatgatgatgatgagtatagtttaaacgtggtgtgtatctgtggtcatatcttctgttggagatgcagacttgagtcacacagaccagtgagttgtaacaaggcctctgattggttgtgtagtgccacaatgaaaatatcagatgaatcatttagcctttatccgaccaaaaccaagacagtgacttgccctcattgcctctgttctctggagtctgatacaaaaatgccccagttcttgacttgtgtctgcaggcttcgtttctgttcgaggtgtttgcggtcagaggaagcccacaaaattgaagcagtagactctggattctgtattaaaacagaagtggggattttatgtgaggatcgctggaacgtgtgtcagaagttactggagcaagccaaatccgatctagaagctttcgaggaaaccaacatcaagaaaccgagtgacttattaagggagcaagacattatgattataagagaagggttgatgttgattgttcaatgcagacgagtccttaaatggtgttgtgtgtatgactatttccacacagagtatgagaactcgaaggagtatctacgatacctccaaggaaatgcaatcgccacgctccagagttactcaaacactttacaagagcaaaaagatatcgtcctcgctgcagctacttatgaagagtgtactttcttcagacatacgatacctactgcgacaagcaacattggtaactacttttatgattttatgaaaactttacaagatggtttggtcgatgtaaaggtgaagtcatacaacggcgggactggtcctttctggtactgtgatcgctgcacgtatgcaaacacttgggaggataatgagtgtgagatgtgctatgatgatagtgcctctcttgtgggagagataagtgatttgtttcttaacaaagtttcttaa

SEQ ID NO: 1268 - protein, 506 aa, Arabidopsis thaliana
  G1919,RING/C3HC4 domain coordinates 214-287
MEYDGRRPYSVLTRNEITVKMKKQINEISDIFFISNSDATVLLMYLRWDSLRVSERLGENKEKLLMDSGLKSVMIDPSPDSSSEISLETDVYEFDGDNDLISMPFCSHKFDSKYWREYLEKNFYYVEKIQTTISCPDQDCRSAVGPDTIEKLTVRDQEMYERYIWRSYIEGNKVLMIKQCPARNCDYVIEFHQENDDDDEYSLNVVCICGHIFCWRCRLESHRPVSCNKASDWLCSATMKISDESFSLYPTKTKTVTCPHCLCSLESDTKMPQFLTCVCRLRFCSRCLRSEEAHKIEAVDSGFCIKTEVGILCEDRWNVCQKLLEQAKSDLEAFEETNIKKPSDLLREQDIMIIREGLMLIVQCRRVLKWCCVYDYFHTEYENSKEYLRYLQGNAIATLQSYSNTLQEQKDIVLAAATYEECTFFRHTIPTATSNIGNYFYDFMKTLQDGLVDVKVKSYNGGTGPFWYCDRCTYANTWEDNECEMCYDDSASLVGEISDLFLNKVS

SEQ ID NO: 1269 - DNA, 1695 bp, Arabidopsis thaliana
  G1927,family:NAC
atggttgattcttctcgtgattcgtgtttcaaagctggtaagtttagtgctccaggttttcgatttcaccctactgatgaagagcttgtggtttattatcttaagaggaagatctgttgtaaaaaacttcgagtcaatgccattggtgtcgttgatgtttacaaagtcgatccttctgaattgcctggtctatcgatgttgaagacgggagatagacagtggttctttttcactccaaggaataggaagtatcctaacgcagctaggtcaagtagaggtactgcaactggttattggaaggcgacaggaaaggatcgagtcattgagtacaattcaagatctgttggactcaagaagactcttgttttctatagaggtcgtgctcctaatggtgagagaactgactgggtgatgcatgagtacactatggatgaagaagagctagggagatgtaagaacgctaaggagtattatgctctttataagctttataagaagagtggggctggtcctaagaatggtgaacagtatggtgctccgttccaagaagaagaatgggttgatagtgatagtgaagatgcagatagtgtcgctgtaccggattatcccgtggtccgttatgagaatggtccttgtgtggatgatactaaattttgcaatcctgtcaaacttcagttagaggatattgagaagcttctcaatgaaatcccagatgcacccggggttaaccaaagacagtttgatgagtttgttggtgttccacagggtaatagtgcagaagtgatacagagcacattgctgaataattcttctggagagtatattgaccctcggacgaatggaatgttcttgccaaatggccagctatacaacagggactcgagttttcagtcccatttgaattcatttgaggctacctctggtatggcacctcttctagataatgagaaggaggagtacattgaaatgaatgatcttctgatccctgagctcggtgcttcttcaacagagaaatccacagagttcttgaaccatggtgaatttggtgatgttaatgaatacgaccaattgttcaatgacatatctgtttttcagggaacttctacagatctgtcttgtctgagtaattttactaataacacatcaggccaaagacagcaattactttatgaacagttccagtaccagacacctgagaaccagcttaataactacatgcatcctagtaccactcttaatcagttcactgacaatatgtggtttaaagatgatcaggctgctctctatgttcaaccaccacaatcttcttctggagcattcacttcacagtcaacaggtgtgatgcctgagtctatgaatcccactatgagtgtaaatccccaatacaaggaaggacaaaatggtggtggaacaaggagccagttctcatcagctctgtgggaattattggaatcaataccatcaacaccagcctctgcctgtgagggtcctcttaaccagacctttgtgcgtatgtctagcttcagccgcatcaggttcaatggaacgtcagtgactagtagaaaagtcactgtagcaaagaagcgtatcagtaacagaggttttcttctgttatcaattatgggtgctttgtgtgctatcttctgggtgttcaaagccaccgttggagttatgggaagacctctcttgtcgtga

SEQ ID NO: 1270 - protein, 564 aa, Arabidopsis thaliana
  G1927,NAC domain coordinates 17-188
MVDSSRDSCFKAGKFSAPGFRFHPTDEELVVYYLKRKICCKKLRVNAIGVVDVYKVDPSELPGLSMLKTGDRQWFFFTPRNRKYPNAARSSRGTATGYWKATGKDRVIEYNSRSVGLKKTLVFYRGRAPNGERTDWVMHEYTMDEEELGRCKNAKEYYALYKLYKKSGAGPKNGEQYGAPFQEEEWVDSDSEDADSVAVPDYPVVRYENGPCVDDTKFCNPVKLQLEDIEKLLNEIPDAPGVNQRQFDEFVGVPQGNSAEVIQSTLLNNSSGEYIDPRTNGMFLPNGQLYNRDSSFQSHLNSFEATSGMAPLLDNEKEEYIEMNDLLIPELGASSTEKSTEFLNHGEFGDVNEYDQLFNDISVFQGTSTDLSCLSNFTNNTSGQRQQLLYEQFQYQTPENQLNNYMHPSTTLNQFTDNMWFKDDQAALYVQPPQSSSGAFTSQSTGVMPESMNPTMSVNPQYKEGQNGGGTRSQFSSALWELLESIPSTPASACEGPLNQTFVRMSSFSRIRFNGTSVTSRKVTVAKKRISNRGFLLLSIMGALCAIFWVFKATVGVMGRPLLS

SEQ ID NO: 1271 - DNA, 1743 bp, Arabidopsis thaliana
  G1928,family:Z-C2H2
tcgttcgtacccacgcgtccggcgtatatgatgaacaaagacatgttacttcaccagcatcagcaaccacaacaagacgagaatatgtcgaatctaacatcagcttccggggatcaagcaagtgtctcttcaggaaatataactgaagcaagtggttctaattacttccctcatcatcagcaacagcaagaacaacaacaacaacagttagttgttccagattcgcagactcaaaagaagaggagaaaccaaccagggaatccagacccagaatcagaagtgatagctctatcaccaaaaacactaatggcaacaaacagattcgtgtgtgaaatctgcaacaaaggttttcaaagagaccagaatctacagcttcatagaagaggtcacaatctgccatggaagctgaaacaaagatccaacaaagaagtgataaggaagaaagtgtatgtatgtccagaagcaagctgtgtccaccatgatccatctagagctctcggtgacttaaccggaatcaagaagcatttctgtagaaaacatggtgagaagaagtggaaatgtgataagtgttcaaagaaatatgctgttcaatcagattgcaaggctcattctaagacttgtggcaccaaagaatacagatgtgactgtggcactctcttttctaggagggatagtttcataactcatagagcattttgtgaagcattggctgaagagactgcaagagaagtagtaataccacaaaaccagaataataatcaaccaaaccctcttttgattcatcaatctgcttctcatcctcatcaccatcatcaaacacaaccaaccataaacgtctcttcttcttcatcttcctcccacaaccacaacatcatcaatagccttcacttcgacaccaacaatggtaatactaataatagtaacaacagcaacaaccatctccatacatttcccatgaagaaagagcaacaaagcaatgaccatatcatgaattaccaccatagtatcatccctccttggcttgctcctcagcctcacgcactcacatcttcaaaccctaaccctagtaatggtggaggaggaggaggaagtttgttctctcttgcttctccggctatgtcagccaccgcattgctccagaaagcagcccaaatgggctctacaaagacacctcctttaccaccaaccacggcctacgagaggtcaactcataataacaacctcacaacgacaatggcggcgatgatgacgtcaccatctggattcatcagctccaacaacaacaatcatgttttgtttcaagactacaacgcatccgggtttgataatcacggcagagaagaagcattcgacgatacatttggcgggttcttgagaacaaacgaagttacagccgccgcaggatcagagaagagtactaaaagcggtggaggagaaggtttgacgagagatttcttggggctaagaccgttaatgtctcataacgagattctaagttttgctggtcttggaagttgcataaatagctctgcttctgatcagcttcatccaaagccttggcagggttagttaggttttttgctcataatatataatatgtgtatatatatttatatatctagttttgcatctttctcttgttttgttcttcgttttataaatttatatgttgaatgctcatcaaaggaaaaaccccgaaaaaaaaaaaaaaaagggcggccgctctagagtatccctcggggg

SEQ ID NO: 1272 - protein, 513 aa, Arabidopsis thaliana
  G1928,Z-C2H2 domain coordinates 101-121,178-198
MMNKDMLLHQHQQPQQDENMSNLTSASGDQASVSSGNITEASGSNYFPHHQQQQEQQQQQLVVPDSQTQKKRRNQPGNPDPESEVIALSPKTLMATNRFVCEICNKGFQRDQNLQLHRRGHNLPWKLKQRSNKEVIRKKVYVCPEASCVHHDPSRALGDLTGIKKHFCRKHGEKKWKCDKCSKKYAVQSDCKAHSKTCGTKEYRCDCGTLFSRRDSFITHRAFCEALAEETAREVVIPQNQNNNQPNPLLIHQSASHPHHHHQTQPTINVSSSSSSSHNHNIINSLHFDTNNGNTNNSNNSNNHLHTFPMKKEQQSNDHIMNYHHSIIPPWLAPQPHALTSSNPNPSNGGGGGGSLFSLASPAMSATALLQKAAQMGSTKTPPLPPTTAYERSTHNNNLTTTMAAMMTSPSGFISSNNNNHVLFQDYNASGFDNHGREEAFDDTFGGFLRTNEVTAAAGSEKSTKSGGGEGLTRDFLGLRPLMSHNEILSFAGLGSCINSSASDQLHPKPWQG

SEQ ID NO: 1273 - DNA, 366 bp, Arabidopsis thaliana
  G1929,family:Z-CO-like
atgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctga

SEQ ID NO: 1274 - protein, 121 aa, Arabidopsis thaliana
  G1929,Z-CO-like domain coordinates 31-53
MCRGLNNEESRRSDGGGCRSLCTRPSVPVRCELCDGDASVFCEADSAFLCRKCDRWVHGANFLAWRHVRRVLCTSCQKLTRRCLVGDHDFHVVLPSVTTVGETTVENRSEQDNHEVPFVFL

SEQ ID NO: 1275 - DNA, 1155 bp, Arabidopsis thaliana
  G1930,family:AP2
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagatta

SEQ ID NO: 1276 - protein, 333 aa, Arabidopsis thaliana
  G1930,AP2 domain coordinates 59-124,179-273
MDAMSSVDESSTTTDSIPARKSSSPASLLYRMGSGTSVVLDSENGVEVEVEAESRKLPSSRFKGVVPQPNGRWGAQIYEKHQRVWLGTFNEEDEAARAYDVAAHRFRGRDAVTNFKDTTFEEEVEFLNAHSKSEIVDMLRKHTYKEELDQRKRNRDGNGKETTAFALASMVVMTGFKTAELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKRSNDQDQKFFIGWKSKSGLDLETGRVMRLFGVDISLNAVVVVKETTEVLMSSLRCKKQRVL

SEQ ID NO: 1277 - DNA, 894 bp, Arabidopsis thaliana
  G1932,family:AP2
aacgagccaacaaagcaaaacctctttcttctcttctccactttctctctagattctctcatatttcccctcttgagagtctaacaatggcgtcaacgacgtgtgcaagagaggtgcattacagaggagtcagaaagagaccttggggtcgctacgctgctgagatacgagatccttggaagaaaactagggtttggttaggcactttcgacactcccgaagaagctgctcttgcttacgacggcgctgctcgtttcctccgtggtatcaaagccaaaactaacttcccttctcctctctctctcgacctcaaccacctcccttccgctccctcagccgcaaccgccgccgcaaataaccaaccccaccaacaccaacagctctggttcgctgcgcctcctcctgttcctccaagctccgaccatcatcaccaacaccaccgcatttttctccgaaccggtgtgctaaacgacaaaacttcagattactcttctacagaagcgccgctttacttcacctcctcgcctaacacagccacgtcatcgcctggttatcaagtggttgggtttccgatgatgaattcttctccttcccctgttacggtgagacgtggcttagccattgacctcaacgagcctccgccgctttggctttgaaaacaaacgataaagatggatatagcggcgccgttttgcctacttttctatacggcgccgtttgagaccactttcggtggaactactttagtttcttttttttagcaaatagtatctttttgttagagttagtagacttgtttttataatttaatccttcttttgttcgttatgtaagagtcggagatcgattgttgttgtgagatccatatgttgcggaaaaaacaagaaacttcgt

SEQ ID NO: 1278 - protein, 189 aa, Arabidopsis thaliana
  G1932,AP2 domain coordinates 9-71
MASTTCAREVHYRGVRKRPWGRYAAEIRDPWKKTRVWLGTFDTPEEAALAYDGAARFLRGIKAKTNFPSPLSLDLNHLPSAPSAATAAANNQPHQHQQLWFAAPPPVPPSSDHHHQHHRIFLRTGVLNDKTSDYSSTEAPLYFTSSPNTATSSPGYQVVGFPMMNSSPSPVTVRRGLAIDLNEPPPLWL

SEQ ID NO: 1279 - DNA, 997 bp, Arabidopsis thaliana
  G1935,family:MADS
cttaaatatacaattttgcattcgatcaatttctctcgtgccaactaataatagattgtgttttgattattttgcagtgaccatcggatatgggtcgggttaaattggagttaaagcgtatagagaagagcacgaaccgacaaattacgttctcaaaacgtaaaaaaggtttaataaaaaaggcttatgaattgtcaacactttgtgacatcgatcttgccctcctcatgttctctccctctgatcgactatgtctcttttccggtcaaacaaggatcgaggacgttttggcgaggtacatcaatcttcctgatcaagaaagagaaaacgccatagttttccctgatcagagcaagcgccaaggtatccaaaacaaagagtatttgttaaggactttggaaaaactcaaaattgaggatgacatggctctccaaatcaacgaacctcgtccagaagccaccaactccaatgtcgaggaacttgagcaagaagtttgtagattacaacaacagcttcagatatcagaggaagaactcaggaaattcgaaccagatccaatgaggctaacatcaatggaggagattgaagcatgtgaagctaacctcatcaatacgttgacacgtgtcgtccagagaagggaacatttgttgagaaagtcctgcgaagcacaaagtaaccaacaaagcatggacgggatccttctaaatgacatcgtcgaggattggggacctgagcccgagcccaaacaagcccatatgatagctaattcggcccatcattcaaatcagccaagctatgatttactcttacgcaggagtaattcgagttcgaaccaaaatccaaaatgatattaggtgaatcgcaaggcgtcgtcgagccctgatggcaagagaatgcatgttataagacaaaaataaacgagatatctcacaaatgggtatgtacctaagcttctacgacttctctttcaaattatggtttttgtgtacaatgtttt

SEQ ID NO: 1280 - protein, 252 aa, Arabidopsis thaliana
  G1935,MADS domain coordinates 1-57
MGRVKLELKRIEKSTNRQITFSKRKKGLIKKAYELSTLCDIDLALLMFSPSDRLCLFSGQTRIEDVLARYINLPDQERENAIVFPDQSKRQGIQNKEYLLRTLEKLKIEDDMALQINEPRPEATNSNVEELEQEVCRLQQQLQISEEELRKFEPDPMRLTSMEEIEACEANLINTLTRVVQRREHLLRKSCEAQSNQQSMDGILLNDIVEDWGPEPEPKQAHMIANSAHHSNQPSYDLLLRRSNSSSNQNPK

SEQ ID NO: 1281 - DNA, 955 bp, Arabidopsis thaliana
  G1936,family:PCF
tcgacccaccttgaatctgagagagagagagaagtacgtccccacaccttgacatggtcatggagcccaagaagaaccaaaatctaccaagtttcttaaacccatcacgacagaatcaggacaacgacaagaagaggaaacaaacagaggttaaaggtttcgacattgtggtcggcgaaaagaggaagaagaaggagaatgaagaggaagaccaagaaattcagattctttatgagaaggagaagaagaaaccaaacaaagatcgtcaccttaaagttgaaggaagaggtcgtagagttaggttacctccactctgtgcagcaaggatttatcaattgactaaagaattaggtcacaaatcagatggtgagactcttgaatggttgcttcaacatgctgagccatcgatactctctgctactgtaaatggtatcaaacccactgagtctgttgtttctcaacctcctctcacggctgatttgatgatttgtcatagcgttgaagaagcttcaaggactcaaatggaggcaaatgggttgtggagaaatgaaacaggacagaccattggagggtttgatctgaattacggaattgggtttgatttcaatggtgttccagagattggttttggagataatcaaacgcctggacttgaattaaggctgtctcaagttggggttttgaatccacaggtttttcaacaaatgggtaaagaacagttcagggttcttcatcatcattcacatgaagatcagcagcagagtgcagaggaaaatggttcataaagctcaaacctttaaatggcttttaattagatatatttagcgagaatgtgattgctagtgaaatctcaaacttgatagcttattcatagcttattttacttcgatcagcaagagaacaatggttcctaaagctcaaaccttttttggcgtttgctttagattgtgcatac

SEQ ID NO: 1282 - protein, 243 aa, Arabidopsis thaliana
  G1936,PCF domain coordinates 64-129
MVMEPKKNQNLPSFLNPSRQNQDNDKKRKQTEVKGFDIVVGEKRKKKENEEEDQEIQILYEKEKKKPNKDRHLKVEGRGRRVRLPPLCAARIYQLTKELGHKSDGETLEWLLQHAEPSILSATVNGIKPTESVVSQPPLTADLMICHSVEEASRTQMEANGLWRNETGQTIGGFDLNYGIGFDFNGVPEIGFGDNQTPGLELRLSQVGVLNPQVFQQMGKEQFRVLHHHSHEDQQQSAEENGS

SEQ ID NO: 1283 - DNA, 1243 bp, Arabidopsis thaliana
  G1938,family:PCF
tcgagtcaaattctacatcgggatcttactgggttttttttttaaacattaaattcgtaaattcccaaagaaaaaaaaaaaaactcgataccttttgttttacaaagtcgtcacaattctgaaacccttaattgaatccaagagaatttttgattaaattaagtctctggaccctgaagtccccacacaagcaagcttcgatggatcccaagaacctaaatcgtcaccaagtaccaaatttcttgaacccaccaccaccaccgcgaaatcagggtttggtagatgatgatgctgcttctgctgttgtttccgacgagaatcgcaaaccaacaactgagattaaagatttccagatcgtggtctctgcttccgacaaagaaccaaacaagaagagtcagaatcagaaccagcttggtcctaagagaagctctaacaaagacagacacactaaagtcgaaggtagaggtcgacgaattcggatgcctgctctttgtgctgctaggatttttcaattgactagagaattgggtcataaatctgatggtgaaactatccagtggctgcttcaacaagctgagccatcgattattgcagctactggttcaggaactataccggcctctgctttagcttcttcagctgcaacctctaaccatcatcaaggtgggtctcttactgctggtttaatgatcagtcatgacttagatggtgggtctagtagtagtggtagaccattaaattgggggattggtggcggtgaaggagtttctaggtcaagtttaccaactgggttatggccaaatgtagctgggtttggttctggtgtgccaaccactggtttaatgagtgaaggagctggttatagaattgggtttcctggttttgattttcctggtgttggtcatatgagttttgcatctattttgggtgggaatcataatcagatgcctggacttgagttaggcttgtctcaagaagggaatgttggtgttttgaatcctcagtcttttactcagatttatcaacagatgggtcaggctcaggctcaagctcaaggtagggttcttcaccatatgcatcataaccatgaagaacatcagcaagagagtggtgagaaagatgattctcaaggctcaggtcgttaaaaggattgggtttttttttgtatcttctggatttgaaaaagcttttggcttttgttttgtgataatattgttgtaatttgtaccaccatggagaagaa

SEQ ID NO: 1284 - protein, 314 aa, Arabidopsis thaliana
  G1938,PCF domain coordinates 74-143
MDPKNLNRHQVPNFLNPPPPPRNQGLVDDDAASAVVSDENRKPTTEIKDFQIVVSASDKEPNKKSQNQNQLGPKRSSNKDRHTKVEGRGRRIRMPALCAARIFQLTRELGHKSDGETIQWLLQQAEPSIIAATGSGTIPASALASSAATSNHHQGGSLTAGLMISHDLDGGSSSSGRPLNWGIGGGEGVSRSSLPTGLWPNVAGFGSGVPTTGLMSEGAGYRIGFPGFDFPGVGHMSFASILGGNHNQMPGLELGLSQEGNVGVLNPQSFTQIYQQMGQAQAQAQGRVLHHMHHNHEEHQQESGEKDDSQGSGR

SEQ ID NO: 1285 - DNA, 1445 bp, Arabidopsis thaliana
  G1944,family:AT-hook
tcgaccttcctaatttccaacctctgttcttagcaatatattttttctccaaaaataattctcagtttgattttcttcttctagctcttaagtatatttctttgttgttatttatcttttaatcctttaatctcatctttgtttatctttaatcaaaacccaaaatttacatgggttcttgaaaatctagaagaaataaaggaaacataacaaaaatagaaagaaaaagaagctaatggtcttaaatatggagtctaccggagaagctgttagatcaaccaccggtaacgacggtggtattacggtggttagatccgacgcgccgtcagatttccacgtagctcaaagatcagaaagctcaaaccaatctcccacctctgtcactcctcctccaccacagccatcgtctcatcacacagctcctccgccgctgcaaatttcgacggtgacgactacgactacgacggccgcgatggaaggtatctccggtggactgatgaagaagaagcgtggacggccaaggaagtatggaccggacgggactgttgtagcgttatctcctaaaccgatttcatcagcgccggcgccgtcgcatcttccgccgccgagttcacacgtcatcgatttctccgcttctgagaaacgtagcaaagtgaaaccaacgaactcgtttaacagaacaaagtatcatcaccaagttgagaatttgggtgaatgggctccttgctccgtcggtggtaatttcacacctcatataatcacagtcaacaccggcgaggatgtaacaatgaagataatctcgttttcgcaacaaggacctcgctctatttgtgttctgtcagcaaacggtgttatttcaagcgttacacttcgtcagccagattcctctggcggcacattgacatacgaaggtcggtttgagatattatcattatccgggtcattcatgcctaatgattcaggcggaacacgaagtagaacgggaggaatgagtgtatcgttagcaagtcccgatggacgtgtagtaggcggtggcctcgccggtttactagtagccgcgagtccggttcaggtggttgtaggaagttttttagcgggcactgaccatcaagatcagaaaccgaaaaagaacaaacatgatttcatgttgtcgagtcctaccgctgcaattcctatctctagtgcagctgatcaccggacaatccattcggtctcgtctcttccggtcaataataatacatggcagacttctttagcttccgatccaagaaacaagcataccgatattaatgtcaatgtaacttgaaatccaatctttctctgtattttctgttaacaagtttgatttggttgtttatctacattaggattttactaaaatggtagtattatttatagggttttagggtctttattttggttccactgttgtcacttgtaggata

SEQ ID NO: 1286 - protein, 356 aa, Arabidopsis thaliana
  G1944, AT-hook domain amino acids 89-97, DUF296 170-285
MVLNMESTGEAVRSTTGNDGGITVVRSDAPSDFHVAQRSESSNQSPTSVTPPPPQPSSHHTAPPPLQISTVTTTTTTAAMEGISGGLMKKKRGRPRKYGPDGTVVALSPKPISSAPAPSHLPPPSSHVIDFSASEKRSKVKPTNSFNRTKYHHQVENLGEWAPCSVGGNFTPHIITVNTGEDVTMKIISFSQQGPRSICVLSANGVISSVTLRQPDSSGGTLTYEGRFEILSLSGSFMPNDSGGTRSRTGGMSVSLASPDGRVVGGGLAGLLVAASPVQVVVGSFLAGTDHQDQKPKKNKHDFMLSSPTAAIPISSAADHRTIHSVSSLPVNNNTWQTSLASDPRNKHTDINVNVT

SEQ ID NO: 1287 - DNA, 1605 bp, Arabidopsis thaliana
  G1946,family:HS
tctcacctattgtaaaaatcaccagtttcgtatataaaaccctaattttctcaaaattcccaaatattgacttggaatcaaaaatccgaatggatgtgagcaaagtaaccacaagcgacggcggaggagattcaatggagactaagccatctcctcaacctcagcctgcggcgattctaagttcaaacgcgcctcctccgtttctgagcaagacctatgatatggttgatgatcacaatacagattcgattgtctcttggagtgctaataacaacagttttatcgtttggaaaccaccggagttcgctcgcgatcttcttcctaagaactttaagcataataatttctccagcttcgttagacagcttaatacctatggtttcaggaaggttgacccagatagatgggaatttgcgaatgaaggttttttaagaggtcagaagcacttgctacaatcaataactaggcgaaaacctgcccatggacagggacagggacatcagcgatctcagcactcgaatggacagaactcatctgttagcgcatgtgttgaagttggcaaatttggtctcgaagaagaagttgaaaggcttaaaagagataagaacgtccttatgcaagaactcgtcagattaagacagcagcaacagtccactgataaccaacttcaaacgatggttcagcgtctccagggcatggagaatcggcaacaacaattaatgtcattccttgcaaaggcagtacaaagccctcattttctatctcaattcttacagcagcagaatcagcaaaacgagagtaataggcgcatcagtgataccagtaagaagcggagattcaagcgagacggcattgtccgtaataatgattctgctactcctgatggacagatagtgaagtatcaacctccaatgcacgagcaagccaaagcaatgtttaaacagcttatgaagatggaaccttacaaaaccggcgatgatggtttccttctaggtaatggtacgtctactaccgagggaacagagatggagacttcatcaaaccaagtatcgggtataactcttaaggaaatgcctacagcttctgagatacagtcatcatcaccaattgaaacaactcctgaaaatgtttcggcagcatcagaagcaaccgagaactgtattccttcacctgatgatctaactcttcccgacttcactcatatgctaccggaaaataattcagagaagcctccagagagtttcatggaaccaaacctgggaggttctagtccattactagatccagatctgttgatcgatgattctttgtccttcgacattgacgactttccaatggattctgatatagaccctgttgattacggtttactcgaacgcttactcatgtcaagcccggttccagataatatggattcaacaccagtggacaatgaaacagagcaggaacaaaatggatgggacaaaactaagcatatggataatctgactcaacagatgggtctcctctctcctgaaaccttagatctctcaaggcaaaatccttgattttgggagtttttaaagtcttttgaggtaacacagtccctgagagcagcatattcat

SEQ ID NO: 1288 - protein, 485 aa, Arabidopsis thaliana
  G1946,HS domain coordinates 37-128
MDVSKVTTSDGGGDSMETKPSPQPQPAAILSSNAPPPFLSKTYDMVDDHNTDSIVSWSANNNSFIVWKPPEFARDLLPKNFKHNNFSSFVRQLNTYGFRKVDPDRWEFANEGFLRGQKHLLQSITRRKPAHGQGQGHQRSQHSNGQNSSVSACVEVGKFGLEEEVERLKRDKNVLMQELVRLRQQQQSTDNQLQTMVQRLQGMENRQQQLMSFLAKAVQSPHFLSQFLQQQNQQNESNRRISDTSKKRRFKRDGIVRNNDSATPDGQIVKYQPPMHEQAKAMFKQLMKMEPYKTGDDGFLLGNGTSTTEGTEMETSSNQVSGITLKEMPTASEIQSSSPIETTPENVSAASEATENCIPSPDDLTLPDFTHMLPENNSEKPPESFMEPNLGGSSPLLDPDLLIDDSLSFDIDDFPMDSDIDPVDYGLLERLLMSSPVPDNMDSTPVDNETEQEQNGWDKTKHMDNLTQQMGLLSPETLDLSRQNP

SEQ ID NO: 1289 - DNA, 1076 bp, Arabidopsis thaliana
  G1947,family:HS
acaactattctctcctctctctttttttattaaaaaagctcaaatttatataggttttttgttcacaaaatggattataaccttccaattccattagagggtctcaaagaaacgccaccaacggctttcttgacgaaaacatacaacatagtggaggattcaagcacaaacaacatagtttcatggagcagagacaacaacagcttcattgtttgggaaccagagacttttgccctaatttgcctccctagatgctttaagcacaataatttctccagctttgttagacagctcaatacttatgggtttaagaagattgatacagagagatgggaatttgcaaatgagcattttctgaagggagagaggcatcttcttaagaacatcaagagaagaaagacatcatctcaaacgcaaacgcagtcgctagaaggagagatccatgagctgcgaagagacagaatggctttagaagtagaactggttagactgcgacgaaaacaagaaagcgtgaagacatatctgcatttgatggaagagaaactgaaagtcacagaagtaaagcaagaaatgatgatgaatttcttgctaaagaagattaagaaaccgagttttttacagagcttaaggaaacgtaatctgcaaggaatcaagaatcgagagcaaaagcaagaggtgatctcaagccatggtgttgaggataatggaaagtttgttaaagctgagccagaagagtatggtgatgacatcgatgatcaatgtggaggtgtgtttgattatggtgatgagcttcacatagcttcaatggagcatcaaggacaaggggaggatgaaattgaaatggatagtgaaggaatttggaagggtttcgtgttgagtgaggaggagatgtgtgatttagtggaacattttatataataaactaatgtattatgagaggtttttttttgtttttttgctttttttttccgagtttgtcatcaagcattgtatacaatttgggccaaactaaaagcccaacaaaatatttggccttggcatttgttaacaaattgactaattcggccacaccttcc

SEQ ID NO: 1290 - protein, 282 aa, Arabidopsis thaliana
  G1947,HS domain coordinates 19-110
MDYNLPIPLEGLKETPPTAFLTKTYNIVEDSSTNNIVSWSRDNNSFIVWEPETFALICLPRCFKHNNFSSFVRQLNTYGFKKIDTERWEFANEHFLKGERHLLKNIKRRKTSSQTQTQSLEGEIHELRRDRMALEVELVRLRRKQESVKTYLHLMEEKLKVTEVKQEMMMNFLLKKIKKPSFLQSLRKRNLQGIKNREQKQEVISSHGVEDNGKFVKAEPEEYGDDIDDQCGGVFDYGDELHIASMEHQGQGEDEIEMDSEGIWKGFVLSEEEMCDLVEHFI

SEQ ID NO: 1291 - DNA, 1320 bp, Arabidopsis thaliana
  G1948,family:AKR
aaaaggtcttcttggccatggatacttgtgctctagtaatccatcagtctctgtctcgcatcaaactttctcctcccaaatcttcttcttcttcttcttctgctttctcccctgaatccttaccgatcagacggatcgagctgtgtttccgaggagctatatgtgccgccgtacaaagaaactacgaagaaacgacctcctccgtggaagaggcagaggaagatgatgagtcatcatcatcgtacggagaagtgaacaagatcattggaagccgaacggcgggggaaggagccatggagtaccttatcgagtggaaggacggccattctccgtcgtgggttccatcgagctacatcgcagcagacgtagtgtcggagtacgagacaccctggtggacggcagctagaaaagccgacgagcaggccctgtcacagctcctggaggaccgagacgtcgatgccgtggacgaaaacggccggacggctctgcttttcgtggcaggtctggggtcggacaagtgcgtaaggcttctggcggaggctggagccgatctcgaccaccgagacatgaggggaggcttgacggcgctgcacatggcggctggttacgtgaggccggaggtggtggaggcgctggtggagctgggagctgatattgaagtggaagacgagagagggttaacggcgttggaactagcgagggagattctgaagacgacgccgaaggggaatccgatgcagttcgggaggagaattgggttagagaaagtgatcaatgtcctggaaggacaagtgttcgagtacgccgaggtggatgagatcgtagagaaacgagggaaaggcaaagacgttgaatatctggtcagatggaaggacggtggagattgcgagtgggtgaaaggtgtacacgtggcggaagatgtggctaaggactacgaggatgggctggagtacgctgtagcggagagtgtgatcgggaagagggtgggagacgatgggaagaccatcgagtatcttgtcaaatggactgatatgtctgatgccacttgggagcctcaggacaatgtcgactctactcttgttctactctaccaacaacaacaaccaatgaatgaatgattgattttgatgattacattcttctcaatttgcttctttctcatatgtgttggttcatctgaccggttcggttggtacgtaccggtacattttcattttcttttaagatgtgatcttgatggtttttggccttttggggacactatttgattttatatccatgctttgaattttgcttccctttttggggagattcatgaaa

SEQ ID NO: 1292 - protein, 366 aa, Arabidopsis thaliana
  G1948,AKR domain coordinates 1-367
MDTCALVIHQSLSRIKLSPPKSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAARKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 1293 - DNA, 883 bp, Arabidopsis thaliana
  G1950,family:AKR
ctgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgt

SEQ ID NO: 1294 - protein, 240 aa, Arabidopsis thaliana
  G1950,AKR domain coordinates 65-228
MEIATDTAKQMRDEELFKAAEWGDSSLFMSLSEEQLSKSLNFRNEDGRSLLHVAASFGHSQIVKLLSSSDEAKTVINSKDDEGWAPLHSAASIGNAELVEVLLTRGADVNAKNNGGRTALHYAASKGRLEIAQLLLTHGAKINITDKVGCTPLHRAASVGKLEVCEFLIEEGAEIDATDKMGQTALMHSVICDDKQVAFLLIRHGADVDVEDKEGYTVLGRATNEFRPALIDAAKAMLEG

SEQ ID NO: 1295 - DNA, 1750 bp, Arabidopsis thaliana
  G1954,family:HLH/MYC
atttatgacttctcaatacaaaaagctcccctcacttttttaagttttgtcttctctaatccgtcttcttctactatcttgcatgtcttgcgtcttttatatacatctctcgtaaaccctagcaaatcatacaaggtcaagaagcttgaccttcattagacttaagcagtttataatcaactaccacgaatagcaatggataaagattactcggcaccaaacttcttaggtgaatcctcaggcggtaacgatgataacagctctggtatgatagactatatgttcaatagaaaccttcaacaacaacaaaagcaatcgatgccacaacagcagcaacatcaactctctccttccggatttggagcaacaccctttgataaaatgaacttctctgatgtgatgcagtttgcggacttcggttcgaaacttgcgttgaaccagaccagaaaccaagacgatcaagaaaccgggattgaccccgtttatttcttgaagttccctgtcttgaacgacaaaatagaggaccataaccaaacccaacatctcatgccttctcatcagacgtctcaagaaggaggtgagtgtggaggaaacataggcaatgtgtttcttgaagaaaaagaagatcaagacgatgacaacgacaacaactccgtgcaactacgttttattggaggagaagaagaagatagggagaacaagaatgttacgaaaaaggaggtgaagagcaagaggaagagagctagaacgagcaagaccagcgaagaagtggaaagccaacggatgactcatatcgcggtcgaaagaaaccgtaggaagcaaatgaatgagcatcttcgtgtccttagatctctcatgcctggctcctacgttcaaaggggagaccaagcgtcaatcataggaggagcaatagagtttgtgagagagctcgagcaactcctacaatgtcttgaatcacagaagcgtcgaagaatcttaggagaaaccggtagggacatgacaacgacaacgacttcttcttcttctcccataactacggtagcgaaccaagcacaaccgctcattattacgggaaatgtaaccgagctagagggcggaggagggcttcgggaggagactgcggagaacaagtcgtgcttggctgacgtggaggtgaagctgctagggtttgacgccatgatcaagatactttcaagaagaaggccgggacagctgattaagactatagctgctttggaggatcttcatctctctattcttcacactaacatcactaccatggaacaaaccgtcctctactcctttaatgtcaagataacaagtgaaacgaggtttacggcagaagacatagcaagttccatccaacagatatttagtttcattcatgcaaataccaacatatctggaagctctaacctgggaaatattgtgtttacttgaaaatcatcacacggcgacaactttgtacactggtgaagattacagtacgtaataatctctacatattgggttttattctccaagcatttggaagagtgtttaagttaaagggagtgcttactttatttttttggggcttttttcatgcaatttaaattttagtgatgattgtgtcgcttgtaatgttagaactcgttgttgtgatttctgctgctttgatttgtaggttttgaacaagcggtttagaatgctaaaccacttatttacttgaaataacttttttcacaaaaaaaaaaaaaaaagaaaaaaa

SEQ ID NO: 1296 - protein, 414 aa, Arabidopsis thaliana
  G1954,HLH/MYC domain coordinates 191-250
MDKDYSAPNFLGESSGGNDDNSSGMIDYMFNRNLQQQQKQSMPQQQQHQLSPSGFGATPFDKMNFSDVMQFADFGSKLALNQTRNQDDQETGIDPVYFLKFPVLNDKIEDHNQTQHLMPSHQTSQEGGECGGNIGNVFLEEKEDQDDDNDNNSVQLRFIGGEEEDRENKNVTKKEVKSKRKRARTSKTSEEVESQRMTHIAVERNRRKQMNEHLRVLRSLMPGSYVQRGDQASIIGGAIEFVRELEQLLQCLESQKRRRILGETGRDMTTTTTSSSSPITTVANQAQPLIITGNVTELEGGGGLREETAENKSCLADVEVKLLGFDAMIKILSRRRPGQLIKTIAALEDLHLSILHTNITTMEQTVLYSFNVKITSETRFTAEDIASSIQQIFSFIHANTNISGSSNLGNIVFT

SEQ ID NO: 1297 - DNA, 1216 bp, Arabidopsis thaliana
  G1957,family:ABI3/VP-1
caagaaccatctcgtaaatcaagatttctccaaggaaaatcagataagtcataatggatctatccctggctccgacaacaacaacaagttccgaccaagaacaagacagagaccaagaattaacctccaacatcggagcaagcagcagctccggtcccagcggaaacaacaacaaccttccgatgatgatgattccacctccggagaaagaacacatgttcgacaaagtggtaacaccaagcgacgtcggaaaactcaacagactcgtgatccctaaacaacacgctgagaggtatttccctctagactcctcaaacaaccaaaacggcacgcttttgaacttccaagacagaaacggcaagatgtggagattccgttactcgtattggaactctagccagagctacgttatgaccaaaggatggagccgtttcgtcaaagagaaaaagctcgatgcaggagacattgtctctttccaacgaggcatcggagatgagtcagaaagatccaaactttacatagattggaggcatagacccgacatgagcctcgttcaagcacatcagtttggtaattttggtttcaatttcaatttcccgaccacttctcaatattccaacagatttcatccattgccagaatataactccgtcccgattcaccggggcttaaacatcggaaatcaccaacgttcctattataacacccagcgtcaagagttcgtagggtatggttatgggaatttagctggaaggtgttactacacgggatcaccgttggatcataggaacattgttggatcagagccgttggttatagactcagtccctgtggttcccgggagattaactccggtgatgttaccgccgcttcctccgcctccttctacggcgggaaagagactaaggctctttggggtgaatatggaatgtggcaatgactataatcaacaagaagagtcatggttggtgccacgtggcgaaattggtgcatcttcttcttcttcttcagctctacgactaaatttatcgactgatcatgatgatgataatgatgatggtgatgatggcgatgatgatcaatttgctaagaaagggaagtcttcactttctctcaatttcaatccatgagaagtttcatcatcttcttgttttgaatctctctttatattgtttccattagtaatttttactaagggtattagattctagctagt

SEQ ID NO: 1298 - protein, 358 aa, Arabidopsis thaliana
  G1957,ABI3/VP-1 domain coordinates 52-143
MDLSLAPTTTTSSDQEQDRDQELTSNIGASSSSGPSGNNNNLPMMMIPPPEKEHMFDKVVTPSDVGKLNRLVIPKQHAERYFPLDSSNNQNGTLLNFQDRNGKMWRFRYSYWNSSQSYVMTKGWSRFVKEKKLDAGDIVSFQRGIGDESERSKLYIDWRHRPDMSLVQAHQFGNFGFNFNFPTTSQYSNRFHPLPEYNSVPIHRGLNIGNHQRSYYNTQRQEFVGYGYGNLAGRCYYTGSPLDHRNIVGSEPLVIDSVPVVPGRLTPVMLPPLPPPPSTAGKRLRLFGVNMECGNDYNQQEESWLVPRGEIGASSSSSSALRLNLSTDHDDDNDDGDDGDDDQFAKKGKSSLSLNFNP

SEQ ID NO: 1299 - DNA, 1444 bp, Arabidopsis thaliana
  G1958,family:GARP
gtaccgtcgaccgattatccccaagaggagaatcctcataatcattttctccgattcgattcgtcttccttggtcctggattgcttcatgaatttctaggacaacaatggaggctcgtccagttcatagatcaggttcgagagacctcacacgcacttcttcaatcccatctacacaaaaaccttcaccagtagaagatagtttcatgagatcagataacaacagtcagttaatgtctagaccattaggacaaacctaccatttactttcatctagtaacggtggagctgttggacatatatgttcttcttcatcatctggttttgcaaccaatctccattactcaactatggtatctcatgagaaacaacaacactacacaggaagcagcagtaataatgctgtgcagacaccaagcaacaacgatagtgcttggtgtcatgattcattgccaggagggtttcttgacttccatgaaaccaacccggcgattcaaaacaactgtcagattgaggatggtggcattgcggctgcttttgatgacattcaaaaacgaagtgattggcatgaatgggctgaccatttgatcactgatgatgatcctttgatgtctactaactggaatgatctcttgcttgaaacaaattccaattcagattcaaaggaccagaagacactgcaaattccgcaacctcagattgttcagcagcaaccttctccgtctgtggaattgcgacctgttagcacaacatcttcaaacagcaataacggaacgggcaaggcacgaatgcgttggacgccagagcttcacgaggcttttgttgaggctgtcaacagtcttggcggtagtgaaagagctactcctaaaggggtactgaagattatgaaagttgaaggcttgactatatatcatgttaaaagccatttacagaaatataggacagctagatatcggccagaaccatcagaaactggttcgccagaaaggaagttgacaccgcttgaacatataacatctcttgatttgaaaggtgggataggtattacagaggctctacgacttcagatggaagtacagaagcaactccatgagcagctcgagattcaaagaaacctgcaactccgaatagaagaacaaggcaagtacctgcaaatgatgttcgagaagcaaaactctggtcttaccaaagggacagcctcaacatcagattccgcagccaaatctgaacaagaagacaagaagactgctgattcgaaggaggttccagaagaagaaaccaggaaatgtgaggaactagaatctccacagccaaagcgtcccaaaatcgataattgaaagtattggtcttttgctggataatctcggagtttcagagttaacagtgatagagagaacgagctcttatcttgaggttcttcaggacttctctcgcggccgctctag

SEQ ID NO: 1300 - protein, 409 aa, Arabidopsis thaliana
  G1958,GARP domain coordinates 230-278
MEARPVHRSGSRDLTRTSSIPSTQKPSPVEDSFMRSDNNSQLMSRPLGQTYHLLSSSNGGAVGHICSSSSSGFATNLHYSTMVSHEKQQHYTGSSSNNAVQTPSNNDSAWCHDSLPGGFLDFHETNPAIQNNCQIEDGGIAAAFDDIQKRSDWHEWADHLITDDDPLMSTNWNDLLLETNSNSDSKDQKTLQIPQPQIVQQQPSPSVELRPVSTTSSNSNNGTGKARMRWTPELHEAFVEAVNSLGGSERATPKGVLKIMKVEGLTIYHVKSHLQKYRTARYRPEPSETGSPERKLTPLEHITSLDLKGGIGITEALRLQMEVQKQLHEQLEIQRNLQLRIEEQGKYLQMMFEKQNSGLTKGTASTSDSAAKSEQEDKKTADSKEVPEEETRKCEELESPQPKRPKIDN

SEQ ID NO: 1301 - DNA, 609 bp, Arabidopsis thaliana
  G1965,family:Z-Dof
atggataacttcaatgttgttgccaatgaagacaatcaagtgaatgatgtgaagcctccaccacccccaccgcgagtgtgtgcaagatgtgattctgataacacaaaattttgttactacaacaattatagtgagtttcaaccgcgctacttctgcaagaactgtcgaagatactggactcatggtggggctttaagaaacgtaccaattggtgggagtagtcgtgccaagcggacaaggataaatcaaccttcagttgctcagatggtttctgttggaatccaaccagggaaccgttttagttctttgtctcatattcatggtggtatggtaacaaatgtgcatccaactcaaacttttcgaccaaatcatcgcctagctttccataatggatcatttgagcaagattattatgatgttgggtctgataatcttttggtaaaccaacaagttggtggatatgttgataatcacaacggttatcacatgaatcaagtggatcaatacaactggaaccagagcttcaataacgctatgaacatgaattataataacgctagcactagcggaaggatgcatcctagtcatttagagaagggtggtccttga

SEQ ID NO: 1302 - protein, 202 aa, Arabidopsis thaliana
  G1965,Z-Dof domain coordinates 27-55
MDNFNVVANEDNQVNDVKPPPPPPRVCARCDSDNTKFCYYNNYSEFQPRYFCKNCRRYWTHGGALRNVPIGGSSRAKRTRINQPSVAQMVSVGIQPGNRFSSLSHIHGGMVTNVHPTQTFRPNHRLAFHNGSFEQDYYDVGSDNLLVNQQVGGYVDNHNGYHMNQVDQYNWNQSFNNAMNMNYNNASTSGRMHPSHLEKGGP

SEQ ID NO: 1303 - DNA, 1368 bp, Arabidopsis thaliana
  G1968,family:Z-C2H2
atggagcagttcaaagagaggaagtttgtttgtaagttctgtagcaagaggtttccttgtgggaaatcacttggaggtcacatcagaactcacatgaatgagaattcagctgattcagatgaagatgaggctgataagctcaagatgattgatgaaaatggtggtcaatctagttatggtctgagagagaatcctaaaaagaacaagaggtttgtggatcacagacagattatggctctgaaacagcagcagcagcagcaacaacttcaagagctgcgtcgttgcagagaatgtggtaaaggttttgtttcttctaaagctctttgtggtcacatggcttgtcactctgagagagagaagattgttatggatagtcaatctgatactgaggcttcttcctctcctatcagaagaagatccaagagagttgttgtgaaacctcaccacaaagctgcttttgtagttggtggtaatggtattatgaatcaatctatttcagcttcttctgatgcttctgagattgagcctgaacaggaggaaatggcaaggtctttgatgatgctttcgagggattctagttttaagaaaggacataactctttggctgagtcatctgacaacaactctgtgattcttgagactaagtcatcttcaggtgagcaggttaagatgttcaatgtgaagaatgttgaagagttatgtaagaagaacaaacttgtagttgataaccagatgaggtctggtgaagaaaatggtgatgttcattatgattcagataattctgactctggctacttcaggaatggaccaaagaagttggactcagatgtttctgttgatgggttctttaggaacaaaacaataatgggatctggatccggattcaacagctccccaacaaaacaagatagggacatgaacagattcaggaaggaatggtataaggaaggagggtcagggtcaggatcaggatcaggtcgttcttctacaaagtatgatctgaggaaaagcaaaagaggttttccttctcatggtcgtaagaaaatcaagtatgagttcactgaatctgtctatgacagtggtgagcatagcttggaaactgactcttgtgcggacacaaacagaactatcaagattcatagtaagtctccaatggttaagaaagcaaacggtgcaaagaagaaaagcaaaggtcacgagtgtccgatttgcttcagggtgttcaaatcaggacaagctttaggaggtcacaagagatcacatttcattgggaatcaagaacacaggactttggtgattcaacatcaagtagctcatgagatgcatacactcatcgatctcaatcttcctgctcctattgatgaatga

SEQ ID NO: 1304 - protein, 455 aa, Arabidopsis thaliana
  G1968,Z-C2H2 domain coordinates 64-84,368-390
MEQFKERKFVCKFCSKRFPCGKSLGGHIRTHMNENSADSDEDEADKLKMIDENGGQSSYGLRENPKKNKRFVDHRQIMALKQQQQQQQLQELRRCRECGKGFVSSKALCGHMACHSEREKIVMDSQSDTEASSSPIRRRSKRVVVKPHHKAAFVVGGNGIMNQSISASSDASEIEPEQEEMARSLMMLSRDSSFKKGHNSLAESSDNNSVILETKSSSGEQVKMFNVKNVEELCKKNKLVVDNQMRSGEENGDVHYDSDNSDSGYFRNGPKKLDSDVSVDGFFRNKTIMGSGSGFNSSPTKQDRDMNRFRKEWYKEGGSGSGSGSGRSSTKYDLRKSKRGFPSHGRKKIKYEFTESVYDSGEHSLETDSCADTNRTIKIHSKSPMVKKANGAKKKSKGHECPICFRVFKSGQALGGHKRSHFIGNQEHRTLVIQHQVAHEMHTLIDLNLPAPIDE

SEQ ID NO: 1305 - DNA, 1182 bp, Arabidopsis thaliana
  G1983,family:Z-C3H
atggatgtcgtttgtacggaacatcaaatgaggaagccaacggtggagattcctccgagaaagcttcttttatcttccaagagttttccttctgattcttcttcccctcgctcgccgcgtaaacataactggaacaaaagcaacaagattacatctgaacatgaagaagacaacgaagacaacaacagagagaataaagagtactgttatgattctgactctgatgatccttacgcaagtgatcatttccggatgttcgaattcaagatccgtcgttgcactcgtagccgaagccacgattggactgattgtccttttgctcatcccggtgagaaagctcgccgtcgtgaccctcgtcgctttcaatactccggtgaggtttgtcccgagtttcgtcgtggtggtgattgtagccgtggagatgattgtgagtttgctcatggagtcttcgagtgttggctccatcctattcgttaccgtactgaagcttgtaaagacggtaaacactgtaaaaggaaagtctgtttctttgctcattcgccacgtcagcttagggttcttcctccggagaacgtttccggtgtctcagcgtcgccttctcctgcggcgaagaatccatgttgcttgttttgtagcagctctcccacgagcactcttttgggtaatttgtctcatctttctcgatctccgtctctgtctccacctatgtctccggctaataaagccgctgctttttcacggttgaggaaccgcgccgcttctgccgtttccgccgctgcagccgctggttcaatgaactataaagacgttttgagcgagcttgtgaattctttggattccatgagcttagcggaagcgctgcaggcgagttcctcgtcgcccgttacaactccggtttccgctgcggctgccgcgtttgcgtcgtcctgcggtctgagcaatcagcgtctccatctccagcaacaacaaccaagtagccctttgcaatttgctctttcgccttccactccaagttacctaactaactcacctcaggcgaacttcttcagtgatgatttcactcctcgccggagacagatgaacgatttcacggcgatgacggccgttagggagaatactaacattgaggatggttcttgtggtgaccctgatctaggatgggtcaatgatctcttgacttga

SEQ ID NO: 1306 - protein, 393 aa, Arabidopsis thaliana
  G1983,Z-C3H domain coordinates 71-147
MDVVCTEHQMRKPTVEIPPRKLLLSSKSFPSDSSSPRSPRKHNWNKSNKITSEHEEDNEDNNRENKEYCYDSDSDDPYASDHFRMFEFKIRRCTRSRSHDWTDCPFAHPGEKARRRDPRRFQYSGEVCPEFRRGGDCSRGDDCEFAHGVFECWLHPIRYRTEACKDGKHCKRKVCFFAHSPRQLRVLPPENVSGVSASPSPAAKNPCCLFCSSSPTSTLLGNLSHLSRSPSLSPPMSPANKAAAFSRLRNRAASAVSAAAAAGSMNYKDVLSELVNSLDSMSLAEALQASSSSPVTTPVSAAAAAFASSCGLSNQRLHLQQQQPSSPLQFALSPSTPSYLTNSPQANFFSDDFTPRRRQMNDFTAMTAVRENTNIEDGSCGDPDLGWVNDLLT

SEQ ID NO: 1307 - DNA, 609 bp, Arabidopsis thaliana
  G1985,family:Z-C2H2
ctcctttattctacggaagaaatctatatattctatatatggaaaacatcaaaaaccctaaaaacgcagatgattgttccgatagcatatcaaaaaacagtcatcaaggcgttgatgattccctgaaccagtcaagatcttacgtatgcagtttctgcataaggggcttctcgaatgctcaagcactaggagggcatatgaacatccacagaagagacagggctaaactcagacaaaagcttatggaagataataaggatgatgtcgtcgccgagagtgatgcatccgaagttgtgtctctagaccttaatgaacaacaacaacaacaaggagaagctttgacatgtgatgatcacgatcaatatgttgataacgatataagtcctaaacagaaattagagttttgggttcaagaaagcaagcttgatactaatgatcatggaaaggtcacggaggctagcatagatggttcgagttcgagtcatcatcgtgatattgaagtattggatctcgagcttcggttaggccaaagcgtcgtaaagaagaagacaacatagtctctgaacgatgaatcatatattgattgcattgtatcaatgggaaaatccc

SEQ ID NO: 1308 - protein, 172 aa, Arabidopsis thaliana
  G1985,Z-C2H2 domain coordinates 37-57
MENIKNPKNADDCSDSISKNSHQGVDDSLNQSRSYVCSFCIRGFSNAQALGGHMNIHRRDRAKLRQKLMEDNKDDVVAESDASEVVSLDLNEQQQQQGEALTCDDHDQYVDNDISPKQKLEFWVQESKLDTNDHGKVTEASIDGSSSSHHRDIEVLDLELRLGQSVVKKKTT

SEQ ID NO: 1309 - DNA, 1301 bp, Arabidopsis thaliana
  G1990,family:Z-C2H2
cagatctggtaccgtcgacccgattgatcaattccaatattacgtcctttttttcttgaatctctctatatactcaatggaagcagctgcggaggctgtatcagccgctagggagcaatcattgatccttaaagggaaacggactaagcggcaacgtcctcagtccccaatccctttctctatcattcctcctatgtcttcgcatgaaccggatgctgaagaagagtctactagtcttgtttccaaggagaagagtctcaatgatgaaatcaacaacaataacatcaagaataataacaatactttgatcaatggtgttacatcttcatcttctgcctcttcatcttccaacaacaatgccacattaaaggccacggctgacgaagaagatcaagatatggctaattgtttgatcctcctcgcccaaggtcactctcttccccacctccaaccgcaaccgcacccccaacaacaaacaagacagcttatgatgagttaccaagattccggtaacaacaacaacaatgcgtatagatctagcagcaggaggtttctagagacatcttcatctaacgggaccacaacgaacggtggtggaggcagagccggttactatgtttaccagtgcaaaacatgtgaccggacttttccgtctttccaagctcttggtgggcatagagccagccacaagaagcctaaagccgctatgggtcttcactctaaccatgaccacaagaagtctaactacgatgacgccgtttctctccatctcaacaacgttctcaccacaactcctaacaacaatagtaaccatagatcgcttgtggtatacggcaaaggtagtaataataaggtccatgaatgtgggatatgtggagccgaattcacatccgggcaagcattaggtggtcacatgagacgccatagaggtgcagtggtagccgcagcagccgcctctaccgccaccgtatcggttgcggccattccggctactgcaaacacggctttgtcattgtcgccaatgtcgtttgatcagatgtcggagggtccaattcaggctcccgttaagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaa

SEQ ID NO: 1310 - protein, 398 aa, Arabidopsis thaliana
  G1990,Z-C2H2 domain coordinates 184-204,261-283
MEAAAEAVSAAREQSLILKGKRTKRQRPQSPIPFSIIPPMSSHEPDAEEESTSLVSKEKSLNDEINNNNIKNNNNTLINGVTSSSSASSSSNNNATLKATADEEDQDMANCLILLAQGHSLPHLQPQPHPQQQTRQLMMSYQDSGNNNNNAYRSSSRRFLETSSSNGTTTNGGGGRAGYYVYQCKTCDRTFPSFQALGGHRASHKKPKAAMGLHSNHDHKKSNYDDAVSLHLNNVLTTTPNNNSNHRSLVVYGKGSNNKVHECGICGAEFTSGQALGGHMRRHRGAVVAAAAASTATVSVAAIPATANTALSLSPMSFDQMSEGPIQAPVKRARSAVVSLDLDLNLPAPEDENRVNGLSFASKQEHEQEHEQTQQKKQREEQKSLVLSSAPTLVDCHY

SEQ ID NO: 1311 - DNA, 485 bp, Arabidopsis thaliana
  G1993,family:Z-C2H2
ctccctcgcgcgatatcatatacaaatgaatagaaaatacttggatcgtcgatcatattcatggtccggatcacaagcaagaccatacatatgcgaattttgcgagagaggtttttccaacgcacaagctttaggagggcacatgaacatccacagaaaagacagggcaaaacttcgacaagcgaacctaaaagaagaagacagtgaagatgccatttgcaccacttcgagaaatcggtttgggcaagagcttattgagttacctttcttcgttgatacggtcggtccaagaagaaaaggagaagatgataaaagcgaaaaaggtttaggagatgaagaaaagaaaaatatgaggatacttcaaaaggctttatctcaaagtgcagacgtgatagatcttgagctccgtctaggattagatccttataaaaaaacaacaagtacaagtacgtaactaataactatatatgtgaatactttaatcc

SEQ ID NO: 1312 - protein, 142 aa, Arabidopsis thaliana
  G1993,Z-C2H2 domain coordinates 23-43
MNRKYLDRRSYSWSGSQARPYICEFCERGFSNAQALGGHMNIHRKDRAKLRQANLKEEDSEDAICTTSRNRFGQELIELPFFVDTVGPRRKGEDDKSEKGLGDEEKKNMRILQKALSQSADVIDLELRLGLDPYKKTTSTST

SEQ ID NO: 1313 - DNA, 762 bp, Arabidopsis thaliana
  G1995,family:Z-C2H2
atggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacgcgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattattcacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaa

SEQ ID NO: 1314 - protein, 253 aa, Arabidopsis thaliana
  G1995,Z-C2H2 domain coordinates 93-113
MDEATGETETQDFMNVESFSQLPFIRRPKDKNPKPIRVFGKDFTGRDFSITTGQEDYTDPYQTKNKEEEEEEDQTGDNSTDNNSISHNRRFECHYCFRNFPTSQALGGHQNAHKRERQLAKRGVSSYFYHPDNNPYSYRHYPSWTNGPLTAARSYGGFSSGPKPSGYYSRPSYGSQLGLWRLPPRVQGVYNSNAAFTSNGSSSSSNSTLPLLTRSQTQLSSQVGGSAAQNRMSSYGYGLSPNVQDHVSLDLHL

SEQ ID NO: 1315 - DNA, 1014 bp, Arabidopsis thaliana
  G1998,family:Z-CO-like
atggagccaaagtgtgaccattgtgcaacctcgcaagcattgatttactgcaaatccgatttggctaaactatgcctaaactgcgacgtccatgtacactctgcgaatcctctgtctcacaggcacatacgctctttgatctgcgagaaatgcttctcacagccagccgcaatccgctgtctcgacgagaaggtttcatactgccaaggatgtcattggcacgaaagcaactgttcggagttaggacacagagttcagagcttgaatcctttctctggttgtccttctcctacagattttaacagaatgtggtcttcaattcttgaacctcctgtctccggcttgcttagtccgttcgttggttcttttcccttgaatgatctcaacaataccatgttcgataccgcttattccatggtaccacacaacatcagttacactcagaatttcagtgataatttgtctttcttttccacggaatctaagggatatcctgatatggttcttaaacttgaagaaggagaagaagatctatgtgaagggcttaacttggatgatgcaccattaaactttgacgtaggagatgatattatcggatgttcatcagaagtacacatagaaccggaccatacggcatcgccaccaggtcagcaaatgaacatcaacactggacttcagcttcctctatcacctgtcttgttcggacaaatccatccatctcttaacatcactggtgaaaacaatgcagctgattaccaggattgtgggatgtctccagggtttataatgagtgaagcgccatgggaaacgaattttgaagttagttgtccacaagcaagaaacgaggctaagttgagatacaaggagaagaaattaaagcgctcttttgggaaacagattcgatatgcatctcgcaaagcaagagctgacacgaggaaaagagtgaaaggaagatttgtgaaagctggtgacagttatgattatgatccatcatcaccgacgacgaacaattga

SEQ ID NO: 1316 - protein, 337 aa, Arabidopsis thaliana
  G1998,Z-CO-like domain coordinates 5-71
MEPKCDHCATSQALIYCKSDLAKLCLNCDVHVHSANPLSHRHIRSLICEKCFSQPAAIRCLDEKVSYCQGCHWHESNCSELGHRVQSLNPFSGCPSPTDFNRMWSSILEPPVSGLLSPFVGSFPLNDLNNTMFDTAYSMVPHNISYTQNFSDNLSFFSTESKGYPDMVLKLEEGEEDLCEGLNLDDAPLNFDVGDDIIGCSSEVHIEPDHTASPPGQQMNINTGLQLPLSPVLFGQIHPSLNITGENNAADYQDCGMSPGFIMSEAPWETNFEVSCPQARNEAKLRYKEKKLKRSFGKQIRYASRKARADTRKRVKGRFVKAGDSYDYDPSSPTTNN

SEQ ID NO: 1317 - DNA, 942 bp, Arabidopsis thaliana
  G1999,family:Z-CO-like
atgatttcaaagtaccaagaagatgtcaagcagccacgagcttgcgaactttgtctgaacaaacacgcagtttggtactgtgcctccgatgatgctttcttgtgccatgtttgtgatgaatcagtgcattctgcaaaccatgtagcgacaaaacacgagagagtttgtcttagaacaaacgagatatcgaatgatgtgcgtgggggaacaacattaacctcggtttggcacagcgggtttcgaagaaaagcaagaactcctagatctcggtatgagaaaaagccacaacaaaagatagatgatgagagaagaagggaagatcctcgtgttcccgagattggaggcgaagtgatgtttttcataccagaagcaaatgatgatgatatgacttctcttgtgccagagtttgagggattcacagagatgggattcttcttgagcaaccacaatggtactgaagaaacaacgaaacaattcaactttgaagaagaagctgacacaatggaggatctatattacaatggagaagaagaagataaaactgatggagctgaagcatgtcctggacaatatttgatgagctgcaagaaagattacgacaatgtcataacggtttcagaaaagacagaagaaattgaagattgttatgagaataatgcaaggcatagactgaattacgaaaatgttatagcagcttgggataaacaagaatctcctagagatgtaaaaaacaacacaagtagcttccagctagttcctccagggatagaggagaagagagtaagaagtgagagagaagctagagtttggagatacagagataaaaggaagaatcgtttgttcgagaagaagataaggtacgaggttagaaaggttaacgccgacaaaaggccgagaatgaaaggtcgatttgtccgacgatctttagccatcgactcttag

SEQ ID NO: 1318 - protein, 313 aa, Arabidopsis thaliana
  G1999,Z-CO-like domain coordinates 15-55
MISKYQEDVKQPRACELCLNKHAVWYCASDDAFLCHVCDESVHSANHVATKHERVCLRTNEISNDVRGGTTLTSVWHSGFRRKARTPRSRYEKKPQQKIDDERRREDPRVPEIGGEVMFFIPEANDDDMTSLVPEFEGFTEMGFFLSNHNGTEETTKQFNFEEEADTMEDLYYNGEEEDKTDGAEACPGQYLMSCKKDYDNVITVSEKTEEIEDCYENNARHRLNYENVIAAWDKQESPRDVKNNTSSFQLVPPGIEEKRVRSEREARVWRYRDKRKNRLFEKKIRYEVRKVNADKRPRMKGRFVRRSLAIDS

SEQ ID NO: 1319 - DNA, 861 bp, Arabidopsis thaliana
  G2007,family:MYB-(R1)R2R3
atgggaaggcagccatgttgtgacaagctcatggtgaagaaggggccgtggacggcggaggaagacaagaaactgataaactttatcttgaccaacggccactgttgctggagggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactag

SEQ ID NO: 1320 - protein, 286 aa, Arabidopsis thaliana
  G2007,MYB-(R1)R2R3 domain coordinates 14-118
MGRQPCCDKLMVKKGPWTAEEDKKLINFILTNGHCCWRALPKLAGLRRCGKSCRLRWTNYLRPDLKRGLLSDAEEQLVIDLHALLGNRWSKIAARLPGRTDNEIKNHWNTHIKKKLLKMEIDPSTHQPLNKVFTDTNLVDKSETSSKADNVNDNKIVEIDGTTTNTIDDSIITHQNSSNDDYELLGDIIHNYGDLFNILWTNDEPPLVDDASWSNHNVGIGGTAAVAASDKNNTAAEEDFPERSFEKQNGESWMFLDYCQEFGVEDFGFECYHGFGQSSMKTGHKD

SEQ ID NO: 1321 - DNA, 525 bp, Arabidopsis thaliana
  G2010,family:SBP
atggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatag

SEQ ID NO: 1322 - protein, 174 aa, Arabidopsis thaliana
  G2010,SBP domain coordinates 53-127
MEGKRSQGQGYMKKKSYLVEEDMETDTDEEEEVGRDRVRGSRGSINRGGSLRLCQVDRCTADMKEAKLYHRRHKVCEVHAKASSVFLSGLNQRFCQQCSRFHDLQEFDEAKRSCRRRLAGHNERRRKSSGESTYGEGSGRRGINGQVVMQNQERSRVEMTLPMPNSSFKRPQIR

SEQ ID NO: 1323 - DNA, 1677 bp, Arabidopsis thaliana
  G2011,family:HS
aatgtcggttgtacaattatttgtcactaaagtttccaaatttcttctaaactgatgaatcaatggaacatgatgacgaaaaagataaatccacggtggcgggaactgacccacccatttccaccgcctctctattccccagatttttttcaattatctgactacagtttgtcggttacttccttccctaaacctttataaaccattaaacctctcatccttcttctcttaaaccccctaattatcacacacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcattattcattttgaatgcactctttatacatatatataatattgatgagtttgattgttccaaaaaaaaa

SEQ ID NO: 1324 - protein, 412 aa, Arabidopsis thaliana
  G2011,HS domain coordinates 55-146
MSPKKDAVSKPTPISVPVSRRSDIPGSLYVDTDMGFSGSPLPMPLDILQGNPIPPFLSKTFDLVDDPTLDPVISWGLTGASFVVWDPLEFARIILPRNFKHNNFSSFVRQLNTYGFRKIDTDKWEFANEAFLRGKKHLLKNIHRRRSPQSNQTCCSSTSQSQGSPTEVGGEIEKLRKERRALMEEMVELQQQSRGTARHVDTVNQRLKAAEQRQKQLLSFLAKLFQNRGFLERLKNFKGKEKGGALGLEKARKKFIKHHQQPQDSPTGGEVVKYEADDWERLLMYDEETENTKGLGGMTSSDPKGKNLMYPSEEEMSKPDYLMSFPSPEGLIKQEETTWSMGFDTTIPSFSNTDAWGNTMDYNDVSEFGFAAETTSDGLPDVCWEQFAAGITETGFNWPTGDDDDNTPMNDP

SEQ ID NO: 1325 - DNA, 1410 bp, Arabidopsis thaliana
  G2030,family:AKR
tcgacctctagctaggaacacgatctaaagaccaaactttcctcattccactggaaagatgactccaccaattttcaatgccatccgcaaaaatgacgaggccactttcaatcagttgatacaagagaaaccgtctgtgatagaggaaagagacaaggagaacaatggagaatcggtgttgcacctagtcacaaagatagggcaccaggaattcgccaagacgataattgggatctgcccttccctagtatgttccactgacgataatggcaacactcctatccatttggctgctacttggggacgcaaatgttagagtttggagagaagtcaacgccattagatgatatctcagaagtagaaaatgacctcaaacttgcagaactggtgaacaatgatggcttgacgcctttgcactgtgcggcagtcagtaactcgatcaaaatcctcaaggtctttagccacaagactccttcatctttcgatatactcacacaaccacataacgaaacagtcttccatctagctgtgagacacaaaaatctcaaagcattcaagttcatggcacagaaagtccacctagaaaaacttctctacaagccggataaatatggaaacacagtacttcacactgccgcctctttaggctctacttccctagcggagtacatcatcaatgaaacaaaaatacataccaaagccaagaacatacagggtcttgcagcggttgatcttctcgataaagatgatgcaaatttcccatctatcgcattaaagtttggtggcgagagtcacaaagaggaaagtgtgatgcattcagaggctttgcaaaatgcgaggaatacaatcacggttgtcgccatcttgattgcatcggttactttcgcagtggggatgaaccctcctggtggcatctatcaagagagtacttcctcgaaagggaaatcagttgcggcaaaaacagtagctttcaagatcttctatgtaagcaatagcatcgcgttgtttacatcattatggatcgtcattcttctggtcagcattattcctttcaagccaaaatcactcaagaatgtcttggttataacacataaaatgatgtcagtctctgtggctgccctggcaacttcctatgtcgcagtgggatggatcattttacctcattttgaaggaaccaaatggttactctataccactcttggtatttctatcgtcatgcgaggaggtatgtatgtttttctatggtttaagctggccaaacacatcttaaggaagatagatacggaaagagaccctgatgaggaggccgcaacgggaaaaggctatgtcatgtattggaaatcataaatccgagcacctatatcttaagtttattttgttagatatctattattgactaatgtatacagc

SEQ ID NO: 1326 - protein, 345 aa, Arabidopsis thaliana
  G2030,AKR domain coordinates 30-130
MLEFGEKSTPLDDISEVENDLKLAELVNNDGLTPLHCAAVSNSIKILKVFSHKTPSSFDILTQPHNETVFHLAVRHKNLKAFKFMAQKVHLEKLLYKPDKYGNTVLHTAASLGSTSLAEYIINETKIHTKAKNIQGLAAVDLLDKDDANFPSIALKFGGESHKEESVMHSEALQNARNTITVVAILIASVTFAVGMNPPGGIYQESTSSKGKSVAAKTVAFKIFYVSNSIALFTSLWIVILLVSIIPFKPKSLKNVLVITHKMMSVSVAALATSYVAVGWIILPHFEGTKWLLYTTLGISIVMRGGMYVFLWFKLAKHILRKIDTERDPDEEAATGKGYVMYWKS

SEQ ID NO: 1327 - DNA, 1700 bp, Arabidopsis thaliana
  G2035,family:AKR
actgggtctgtgtaaagttgataactttttttggtttagagagagaaaggacagagctttacagagatggagatgaagcagatgaagtttcttactcaccaagctttcttttcctctgttcgatcaggagatcttagtcaacttcaacagttagttgacaatttaaccggagatgagctaatcgatgagtcatcgccgtgttctgctgtggctgagcttatgtctgtgcaaaacgacgccggagagaccgccgtctatatctccgccgcagagaatcttgaagacatttttcgttacttgattaggttttctagtttggaaacagttaagatcagatccaaatccgacatgaacgcttttcatgtcgctgccaagcgaggtcacttgggaattgtgaaggagttactgagactatggccagagctttgcagaatctgcgacgcttccaacacgagtccgctttacgcagctgcggttcaagatcacttagaaatagtaaatgcaatgcttgatgttgatcctagctgtgcaatgattgtgagaaagaacgggaaaacatctttgcacactgcgggaaggtacgggcttcttcggatagtgaaagctctcatagagaaagacgcagcgattgttggtgttaaagataagaaaggtcagactgctcttcacatggctgttaaaggacgaagtttggaagtagtcgaagagattttgcaggctgattacacaatattgaatgagagagatcgaaaagggaacactgctttgcatattgctactcgaaaggcgcggccacagataacgagcttattgctgacctttacggcgattgaagtgaatgcgattaacaaccagaaagaaactgctatggatttggcggataagctgcaatatagcgaatctgctttggagatcaatgaggctttggtagaagctggggctaagcatgggaggttcattggtcgagaagatgaggcgagagcattgaagcgagcagtgagtgatatcaaacacgaggtgcaatcgcagcttttgcagaatgagaaaaccaaccgtcgtgtctctgggatcgcgaaagagctgaggaaactccacagagaagcggttcagaacacgactaactccataacggtagtggcggttctgtttgcttccatagcgttcttggccatattcaacttgccgggtcagtatttcacggaggggtcgcatgtgggacaagccaatattgcagggagaaccggattccgcgtgttctgtcttttaaacgcgacatctctgtttatatcgttagcggttgtggtagttcaaataactttggtggcgtgggacacacgggcgcagaagaaagttgtgtctgtagtgaataagctaatgtgggcagcttgtgcttgcacattcggagcatttttggcgattgcatttgcggttgttggaaaggggaactcgtggatggcgattaccataacgttgcttggagcaccgatcttggtagggacattggcaagtatgtgttatttcgtgtttcggcagcggtttaggagcggcaacgattcacagagaaggattaggagagggagtagtaagtcgttttcatggtcttactctcatcatgtatccgattttgaagatgaatcagatttcgagaagattattgctctttgaattaagtttcttaagcgtctttgtatagatcgtct

SEQ ID NO: 1328 - protein, 532 aa, Arabidopsis thaliana
  G2035,AKR domain coordinates 58-259
MEMKQMKFLTHQAFFSSVRSGDLSQLQQLVDNLTGDELIDESSPCSAVAELMSVQNDAGETAVYISAAENLEDIFRYLIRFSSLETVKIRSKSDMNAFHVAAKRGHLGIVKELLRLWPELCRICDASNTSPLYAAAVQDHLEIVNAMLDVDPSCAMIVRKNGKTSLHTAGRYGLLRIVKALIEKDAAIVGVKDKKGQTALHMAVKGRSLEVVEEILQADYTILNERDRKGNTALHIATRKARPQITSLLLTFTAIEVNAINNQKETAMDLADKLQYSESALEINEALVEAGAKHGRFIGREDEARALKRAVSDIKHEVQSQLLQNEKTNRRVSGIAKELRKLHREAVQNTTNSITVVAVLFASIAFLAIFNLPGQYFTEGSHVGQANIAGRTGFRVFCLLNATSLFISLAVVVVQITLVAWDTRAQKKVVSVVNKLMWAACACTFGAFLAIAFAVVGKGNSWMAITITLLGAPILVGTLASMCYFVFRQRFRSGNDSQRRIRRGSSKSFSWSYSHHVSDFEDESDFEKIIAL

SEQ ID NO: 1329 - DNA, 3771 bp, Arabidopsis thaliana
  G2041,family:SWI/SNF
atgaagagaaagcattactttgagtttaaccatccatttaatccatgtcctttcgaggtgttctgctgggggacatggaaggccgtggagtacttaaggatcgagaatggaacgatgacaatgcgtctcttagaaaatggacaagttttggatgatataaaaccatttcagaggcttcgaattagatcaagaaaggcgactttgatcgactgtacttcttttttaagacccggtatcgatgtttgcgttctttatcagagagatgaagagactccagaaccagtttgggtggatgcaagggttttatctatagagaggaagcctcatgaatctgaatgcttgtgtacgttccatgtcagtgtttatatagaccaaggctgcattggtttggagaagcatagaatgaataaagttccggtactcgtgggactcaacgaaatcgccatccttcaaaagttttgcaaggaacaaagcttggaccgttactatagatggagatactctgaggactgttcttcgttggtgaaaacaagactaaacttagggaagttcttgcctgatcttacatggttgcttgttacatcagttttgaaaaacattgtgtttcagattagaaccgttcacgagaagatggtttatcagattgtgacggatgaagattgcgaaggctctagtagctctttgagtgcaatgaacattacggttgaagacggtgttgtcatgtctaaggttgttttgttcaatccagctgaggatacttgtcaagatagtgatgtaaaggaggagattgaagaggaggtaatggagctgcgtcggtccaagagaagaagcgggcggcctgagagatacggagactctgagattcagccggattcgaaggatggatgggtaaggatgatgccatataggtacaacatatggaatgtttcaagtgatgatgatgatgaagaagaagattgcgaggatgataaagatactgatgatgatttatacttaccgttatcgcatttacttagaaagaaaggaagcaaaaagggatttagtaaggataagcagagagagatagttttggtagacaaaactgagaggaagaagagaaagaaaacagagggatttagtcgaagttgtgagctttcggttattcctttcactcctgtctttgaacctataccgttggaacagtttggtctcaatgcaaatagtttgtgtggtggtgtctctggaaatttgatggatgagatcgataagtatcgtagtaaagcagcgaaatacgggaagaagaagaagaagaagattgaaatggaagagatggaatctgatctaggttggaatggacctattgggaatgtggttcataaaagaaatggaccgcattctcgaataaggtccgtttctagggaaaccggagtttctgaggaaccgcagatttataagaagagaacgttgagcgcaggtgcgtataacaagttgatagactcgtacatgagtagaattgattctacaattgcagccaaggacaaagcaaccaatgttgttgagcagtggcaagggttaaagaaccccgcaagcttttcgatcgaagccgaagaaaggttgagtgaggaggaggaggatgatggcgagacttcagagaatgagattctatggagggaaatggaactatgcttggcttcttcttacattcttgatgaccatgaggtgagagtggataacgaggcgttccataaagcaacctgtgattgtgaacatgactatgaattgaatgaagaaatcggaatgtgttgcagattgtgtggtcatgtaggaactgagataaaacatgtttctgcaccttttgcgcggcacaagaaatggacgacggagactaagcaaatcaacgaagatgacattaatactactatagttaaccaagatggagttgagagccatactttcactataccagttgcttcctcagatatgccatcggctgaagaaagtgacaatgtctggtctttaatacctcagcttaagagaaaactgcatttgcaccagaaaaaagcttttgagtttctctggaagaacctagccgggtcagtggttcccgcgatgatggatccgagttcagataagataggtgggtgtgtagtttctcatactcccggagcaggaaaaacatttctaatcatagcttttctcgcgagctacttgaagatatttccgggtaaaagacctttggttcttgctccaaaaacaactttgtacacttggtacaaggagttcatcaaatgggagattccggtccctgttcacttgctccatggtcgtagaacctactgtatgtccaaagagaagaccattcagttcgagggaattccaaaaccaagccaagatgttatgcatgttcttgactgtttagacaaaatccagaaatggcatgcacagccgagtgttcttgtaatgggttacacatcgtttctaactttgatgagggaagattcaaagtttgctcatagaaagtacatggctaaagtactgagagagtctcctggattactggttctagacgagggacataacccgaggagtaccaagtcgagattacgaaaggccttgatgaaagttgatactgacttgaggattctgctttctggtacattgtttcagaacaacttctgtgagtacttcaacactttgtgcttggctagacccaagtttgttcatgaggttctagtggagttggacaagaagttccagaccaaccaagccgagcaaaaggcgcctcacttgcttgaaaatagagctcggaagttcttccttgacattatagccaagaagattgacacaaaagtgggcgatgagcgcttgcagggtctcaacatgttgaggaatatgacgagtggtttcatcgataactatgaagggagtggaagcggaagtggtgatgttctcccaggtttgcagatttacacattgttgatgaattccactgatgtacagcacaagagtcttaccaaacttcagaacataatgtcaacttaccatggatatccactcgagctcgagttactcataacgttagctgctatccatccttggttggtcaaaaccacaacctgttgcgccaaattcttcaaccctcaggagcttttagagattgagaagctcaagcacgatgcaaagaaaggatcaaaagtcatgtttgtgcttaatcttgtgttccgggtggtcaagagggagaaaatcctcatattttgtcacaacattgcgccgatccgcctgtttcttgagctgttcgagaatgtattcaggtggaagagaggccgagagctcctgaccttgacaggggatctcgagctgtttgaaagaggcagagtaatagacaaatttgaagagccaggaggccagtcccgtgttctgctggcttcgattacagcctgtgcagaaggcatcagtctaaccgctgcttcacgggtgatcatgcttgattcagagtggaatccttctaagacaaagcaagcaatcgcacgtgcattcagaccgggacagcagaaagtggtgtacgtttaccagctcttgtcgagaggaacacttgaagaagacaaatacaggaggacgacctggaaagaatgggtctccagtatgattttcagtgaagaatttgtggaggacccatctcaatggcaagctgagaagattgaggacgatgttcttagagaaatcgtggaggaagacaaagtcaaatccttccatatgatcatgaagaacgagaaagcttcaacaggtggctga

SEQ ID NO: 1330 - protein, 1256 aa, Arabidopsis thaliana
  G2041,SWI/SNF domain coordinates 670-906,1090-1175
MKRKHYFEFNHPFNPCPFEVFCWGTWKAVEYLRIENGTMTMRLLENGQVLDDIKPFQRLRIRSRKATLIDCTSFLRPGIDVCVLYQRDEETPEPVWVDARVLSIERKPHESECLCTFHVSVYIDQGCIGLEKHRMNKVPVLVGLNEIAILQKFCKEQSLDRYYRWRYSEDCSSLVKTRLNLGKFLPDLTWLLVTSVLKNIVFQIRTVHEKMVYQIVTDEDCEGSSSSLSAMNITVEDGVVMSKVVLFNPAEDTCQDSDVKEEIEEEVMELRRSKRRSGRPERYGDSEIQPDSKDGWVRMMPYRYNIWNVSSDDDDEEEDCEDDKDTDDDLYLPLSHLLRKKGSKKGFSKDKQREIVLVDKTERKKRKKTEGFSRSCELSVIPFTPVFEPIPLEQFGLNANSLCGGVSGNLMDEIDKYRSKAAKYGKKKKKKIEMEEMESDLGWNGPIGNVVHKRNGPHSRIRSVSRETGVSEEPQIYKKRTLSAGAYNKLIDSYMSRIDSTIAAKDKATNVVEQWQGLKNPASFSIEAEERLSEEEEDDGETSENEILWREMELCLASSYILDDHEVRVDNEAFHKATCDCEHDYELNEEIGMCCRLCGHVGTEIKHVSAPFARHKKWTTETKQINEDDINTTIVNQDGVESHTFTIPVASSDMPSAEESDNVWSLIPQLKRKLHLHQKKAFEFLWKNLAGSVVPAMMDPSSDKIGGCVVSHTPGAGKTFLIIAFLASYLKIFPGKRPLVLAPKTTLYTWYKEFIKWEIPVPVHLLHGRRTYCMSKEKTIQFEGIPKPSQDVMHVLDCLDKIQKWHAQPSVLVMGYTSFLTLMREDSKFAHRKYMAKVLRESPGLLVLDEGHNPRSTKSRLRKALMKVDTDLRILLSGTLFQNNFCEYFNTLCLARPKFVHEVLVELDKKFQTNQAEQKAPHLLENRARKFFLDIIAKKIDTKVGDERLQGLNMLRNMTSGFIDNYEGSGSGSGDVLPGLQIYTLLMNSTDVQHKSLTKLQNIMSTYHGYPLELELLITLAAIHPWLVKTTTCCAKFFNPQELLEIEKLKHDAKKGSKVMFVLNLVFRVVKREKILIFCHNIAPIRLFLELFENVFRWKRGRELLTLTGDLELFERGRVIDKFEEPGGQSRVLLASITACAEGISLTAASRVIMLDSEWNPSKTKQAIARAFRPGQQKVVYVYQLLSRGTLEEDKYRRTTWKEWVSSMIFSEEFVEDPSQWQAEKIEDDVLREIVEEDKVKSFHMIMKNEKASTGG

SEQ ID NO: 1331 - DNA, 852 bp, Arabidopsis thaliana
  G2051,family:NAC
atggtaggatcatttttaccacctggtttcagattttatccaacagatgaagaacttgtaggttattacctgcacagaagaaacgaagggcttgagatcgagctcgaaataatcccattaatggacttatacaagtttgatccttgggaacttccagagaaatccttcttgccaaatcgagatatggaatggtttttcttctgtcatcgcgacagaaaataccagaacggatctcgaataaacagagcaactaaatctggttattggaaagccactggcaaagatcgaaaaatcgtttgccactcttcttcttcttcatcatcttcctctatcaccggctgccgaaaaaccctagttttttatatgggtcgagctccttttggtggtagaaccgagtgggtaatgcatgagtatcgcctcttcgacaacgatacttcacaaggatcactaaacttcaagggagacttcgcgctgtgtcgtgtgataaagaggaatgagcatacgcttaagaaatgtgaaattatctcaccagaggtttcagatgagtcattaagcaataatgttaacaatttttgtcaagcaagtgacctagaaaagggttcttgtgatgcaagtaacacacgtttgtcttctcctgatttcatccttgaatcatcttttcagggaaattcacattcaaaaacagaagaagattccggtttccaagtatttacattacccgaattcgaatatccgctagaggtttttgcagatttgaatttcgatttggaaatggaggatccattcatgttcgattatcatccagagcctcatatgaacaatgaagtcatgagccatcacattcgtgggtaa

SEQ ID NO: 1332 - protein, 283 aa, Arabidopsis thaliana
  G2051,NAC domain coordinates 7-158
MVGSFLPPGFRFYPTDEELVGYYLHRRNEGLEIELEIIPLMDLYKFDPWELPEKSFLPNRDMEWFFFCHRDRKYQNGSRINRATKSGYWKATGKDRKIVCHSSSSSSSSSITGCRKTLVFYMGRAPFGGRTEWVMHEYRLFDNDTSQGSLNFKGDFALCRVIKRNEHTLKKCEIISPEVSDESLSNNVNNFCQASDLEKGSCDASNTRLSSPDFILESSFQGNSHSKTEEDSGFQVFTLPEFEYPLEVFADLNFDLEMEDPFMFDYHPEPHMNNEVMSHHIRG

SEQ ID NO: 1333 - DNA, 879 bp, Arabidopsis thaliana
  G2052,family:NAC
atgggaagttcatgtttacctccagggttccggtttcatcctacggatgaagaactcatcgaatattacttgaaaagaaaagtcgaaggtctcgagattgagcttgaagtcattcccgtcatcgatctttatagtttcgatccttgggagttaccagacaagtcgtttctcccaaaccgggacatggaatggtacttcttctgctcaagggacaaaaaatatcctaatggttttcgtacaaatcgaggaacaaaggctggttattggaaagcaaccggaaaagatcgaaaaattacttctcgttcatcttctataattggttatagaaaaactctagttttctacaaaggccgtgccccgttaggcgatagaagcaattggatcatgcatgaatatcgactatgcgatgatgatacatcacaaggatcacaaaatttaaagggagcttttgtgttatgtcgtgttgctatgaagaatgagatcaaaactaatacgaaaatccgaaaaattccaagcgagcaaacaatcggatcaggagaaagctcgggtttatcaagccgagtaacgtctcctagtcgcgatgaaacaatgccgtttcactcatttgccaatcctgtatctactgaaactgattcttccaacatttggatttcacctgaattcatcctcgattcttcaaaggactatcctcaaatccaagatgtcgcatctcagtgcttccaacaagactttgattttccgatcatcggtaaccaaaacatggagtttccagcgagtacaagcttagatcagaacatggatgagtttatgcaaaacggttattggacaaattatggatacgatcaaaccggtttattcggttactcagatttctcctag

SEQ ID NO: 1334 - protein, 292 aa, Arabidopsis thaliana
  G2052,NAC domain coordinates 7-158
MGSSCLPPGFRFHPTDEELIEYYLKRKVEGLEIELEVIPVIDLYSFDPWELPDKSFLPNRDMEWYFFCSRDKKYPNGFRTNRGTKAGYWKATGKDRKITSRSSSIIGYRKTLVFYKGRAPLGDRSNWIMHEYRLCDDDTSQGSQNLKGAFVLCRVAMKNEIKTNTKIRKIPSEQTIGSGESSGLSSRVTSPSRDETMPFHSFANPVSTETDSSNIWISPEFILDSSKDYPQIQDVASQCFQQDFDFPIIGNQNMEFPASTSLDQNMDEFMQNGYWTNYGYDQTGLFGYSDFS

SEQ ID NO: 1335 - DNA, 1029 bp, Arabidopsis thaliana
  G2053,family:NAC
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataa

SEQ ID NO: 1336 - protein, 342 aa, Arabidopsis thaliana
  G2053,NAC domain coordinates 6-152
MENPVGLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGDVREISSSSASYGSEIEQSRDSLIPLLVNDSEEEAQIEDAIPIEEWETWLTDDGVDEQVNHIMNMKDDRNNHRPQKPLTGVLIDDSSDDDDDSDLLSPTTNSIENSSTCDSFGSSDQINLVSLTQEVSQALITSIDTPEKIKSPYDDAQGTGAGGQKLGQETREKKRAGFFHRMIQIFVKKIHQCSSISRT

SEQ ID NO: 1337 - DNA, 1307 bp, Arabidopsis thaliana
  G2057,family:TEO
gccgtctcgacgaatatgctctaccaatgtctgacgaccaattccatcacccgccgcctccttcttcaatgaggcaccgttctacgtcggatgcggcggacggcggctgcggcgagattgttgaggtgcaaggtggtcacattgttcggtctaccggaagaaaagaccgccacagcaaagtctgcacggctaaagggccacgtgaccggcgcgtgagactctctgctcacacggcgattcagttttacgatgttcaagacaggcttggtttcgaccgacctagcaaagccgttgattggcttatcaaaaaggctaagacttccattgacgagctcgctgagcttcctccctggaatcccgccgatgcaattcgcctagccgctgctaacgctaaacccagaagaaccaccgccaaaacccaaatctctccgtctccgccaccgccgcaacagcaacaacaacaacaacagcttcagttcggtgttggcttcaacggaggaggagcagagcatccgagtaacaacgagtcgagttttctcccgccgtcaatggattcagattcgatagctgacactataaagtcgttttttccggtgattggctcttcaacggaggctccttcgaatcataaccttatgcacaactatcatcatcagcatccgccggatttgctttctcgaactaatagccaaaaccaagatctccgtctctcgctgcaatcgttcccggatggtccaccgtcgcttctgcaccaccaacatcaccaccacacctctgcttccgcctccgagcctactctgttctacggacagagcaatccgttagggtttgacacatcgagttgggagcagcagtcgtcggaattcggaaggattcagagactagtggcttggaacagcggcggtggcggcggagcaaccgatacaggaaacggaggagggtttctgttcgctcctcctactccttcaacgacgtcgtttcagccagttcttggccaaagccaacagctttattctcagaggggtccccttcagtccagttacagtcccatgatccgtgcttggtttgatcctcaccatcatcaccaatccatctccaccgacgatctcaaccaccaccatcaccttcctccaccggttcaccaatcagcaatccccggaatcggattcgcctcaggtgaattctcttcgggttttcgcataccagcacggtttcagggccaagaagaggagcagcacgacggtctcactcacaagccgtcctctgcttcctctatttctcgccattgacaatcgaaactaatcctc

SEQ ID NO: 1338 - protein, 420 aa, Arabidopsis thaliana
  G2057,TEO domain coordinates 46-103
MSDDQFHHPPPPSSMRHRSTSDAADGGCGEIVEVQGGHIVRSTGRKDRHSKVCTAKGPRDRRVRLSAHTAIQFYDVQDRLGFDRPSKAVDWLIKKAKTSIDELAELPPWNPADAIRLAAANAKPRRTTAKTQISPSPPPPQQQQQQQQLQFGVGFNGGGAEHPSNNESSFLPPSMDSDSIADTIKSFFPVIGSSTEAPSNHNLMHNYHHQHPPDLLSRTNSQNQDLRLSLQSFPDGPPSLLHHQHHHHTSASASEPTLFYGQSNPLGFDTSSWEQQSSEFGRIQRLVAWNSGGGGGATDTGNGGGFLFAPPTPSTTSFQPVLGQSQQLYSQRGPLQSSYSPMIRAWFDPHHHHQSISTDDLNHHHHLPPPVHQSAIPGIGFASGEFSSGFRIPARFQGQEEEQHDGLTHKPSSASSISRH

SEQ ID NO: 1339 - DNA, 1270 bp, Arabidopsis thaliana
  G2059,family:AP2
ttaagaacaggcttcattctctggacaaacactcaaaaaacaaacaaaaaaaggaacatggaagatcagtttcctaaaatagaaactagcttcatgcacgacaagctcttgtcttctggaatctacgggttcttgagttcttcgacgccgccacaacttctcggtgttccaatatttttggaaggtatgaaatctcctcttcttcctgcttcttcgactccgagctactttgtgtcgcctcatgatcatgagctcacatcttctattcatccatctccggtagcttctgttccttggaactttctagaatcttttcctcagtctcaacatcctgatcatcatccttctaaacctccaaaccttactttgttccttaaagaaccaaagctactagaactttctcaatccgaaagcaacatgagcccttaccataaatacatcccaaactccttttatcaatcagaccaaaacagaaacgaatgggtagagatcaataaaactctaaccaactatccctcgaaaggttttggaaactattggctaagtaccaccaagactcaacccatgaagtcaaaaacaagaaaggttgttcagacgacgaccccaacaaaactgtatagaggagtgagacaaagacactggggcaaatgggtcgcagagattaggcttccaaggaacagaacccgtgtttggctcggcacttttgaaaccgctgagcaagcagcaatggcttacgatacagcagcttatatccttcgtggcgaattcgcacacctcaactttcctgatcttaaacaccagctcaagtccggttctttgcgatgcatgatcgcctcacttttggagtccaagattcaacagatctcatcttcccaagtaagtaactctccttctcctcctcctccaaaagtgggaacaccggagcaaaagaatcatcacatgaagatggagtcaggagaagacgtgatgatgaagaaacagaaaagccataaggaagtgatggaaggagatggtgtacaattgagtaggatgccttctttggatatggatctcatttgggatgctctctcatttcctcattcttcttgacttcaaattaatatttgtcaaacttattttacttacttctacccttttttatatcaaaagtttccaccaaagaaagaaattcatattatgatgccaagattggtttgcatttggggttgaacacattgtaattcttcttacgaccacataatcaagtggttctcctttttttgtctgctaa

SEQ ID NO: 1340 - protein, 343 aa, Arabidopsis thaliana
  G2059,AP2 domain coordinates 184-251
MEDQFPKIETSFMHDKLLSSGIYGFLSSSTPPQLLGVPIFLEGMKSPLLPASSTPSYFVSPHDHELTSSIHPSPVASVPWNFLESFPQSQHPDHHPSKPPNLTLFLKEPKLLELSQSESNMSPYHKYIPNSFYQSDQNRNEWVEINKTLTNYPSKGFGNYWLSTTKTQPMKSKTRKVVQTTTPTKLYRGVRQRHWGKWVAEIRLPRNRTRVWLGTFETAEQAAMAYDTAAYILRGEFAHLNFPDLKHQLKSGSLRCMIASLLESKIQQISSSQVSNSPSPPPPKVGTPEQKNHHMKMESGEDVMMKKQKSHKEVMEGDGVQLSRMPSLDMDLIWDALSFPHSS

SEQ ID NO: 1341 - DNA, 1164 bp, Arabidopsis thaliana
  G2060,family:WRKY
atgatcaaagaggagaccgtttcatacttccaaactttcgatggtgttatggcagaatctgacaaggaagaggagcttgatgcaacaaaagcaaaggtggagaaagttcgggaagaaaatgagaaattaaagctcttactctctacgattcttaataattacaactctcttcaaatgcaagtctctaaagttctcggacaacaacaaggagcttcgtctatggagctagaccacattgatcgtcaagatgaaaataacgactatgatgtggatatatcacttaggcttggaagatcagagcaaaagatctctaaaaaggaggaaaataaggtggacaagatttctactaagaacgtagaggagtcaaaagataaaagatctgcactgggttttggatttcagattcaaagctatgaagcctcgaaactagatgatctttgtaggcaggttaagcttgcaaacgctgaaaataaatgtgtatcttcgaggaaagatgtcaaatcagttagaaatgaaaaccatcaagatgttttggaggagcatgaacaaacaggtttgaagaaaactagggtttgtgttaaagcatcatgtgaagacccatcaataaacgacggttgccagtggaggaaatatggtcaaaagactgcgaaaaccaatcctctcccacgagcctattaccgttgctccatgtcgtcaaattgtcccgttagaaaacaggtgcaaagatgtggagaagaagaaacctccgcttttatgacaacgtacgaaggaaaccatgaccatcctctccccatggaagcaagccacatggcagctggaacttccgcggctgcctccttattacaatctggctcctcctcttcctcctcctccacctcagcgagtctaagctatttcttcccttttcaccacttctctatctccaccactaactcgcacccgactgtaacattggacctcacacgaccaaactatcccaatcagttaccagacgactaccctctatcgtcctcctctttcagtctcaacttttcctctccagatcctccacctccatcatcgcatgaccacaccttgaactttagtggcttgcgaacacaagctccgttgagtacagattcattattggcccgttatcgaacgagactttccggacagcaataa

SEQ ID NO: 1342 - protein, 387 aa, Arabidopsis thaliana
  G2060,WRKY domain coordinates 204-263
MIKEETVSYFQTFDGVMAESDKEEELDATKAKVEKVREENEKLKLLLSTILNNYNSLQMQVSKVLGQQQGASSMELDHIDRQDENNDYDVDISLRLGRSEQKISKKEENKVDKISTKNVEESKDKRSALGFGFQIQSYEASKLDDLCRQVKLANAENKCVSSRKDVKSVRNENHQDVLEEHEQTGLKKTRVCVKASCEDPSINDGCQWRKYGQKTAKTNPLPRAYYRCSMSSNCPVRKQVQRCGEEETSAFMTTYEGNHDHPLPMEASHMAAGTSAAASLLQSGSSSSSSSTSASLSYFFPFHHFSISTTNSHPTVTLDLTRPNYPNQLPDDYPLSSSSFSLNFSSPDPPPPSSHDHTLNFSGLRTQAPLSTDSLLARYRTRLSGQQ

SEQ ID NO: 1343 - DNA, 549 bp, Arabidopsis thaliana
  G2063,family:MADS
atgaatcccaagaaaaccaaaggaaaacaaaagattaacatcaagaaaattgaaaaagatgaaggcagatcggtcacattctctaagcgtctaaatggtatctacactaaaatcagtgagctttctattctctgtggtgttgaagttgcgtttatcgggtattcttgctctggaaaaccatacacttttggcagtccatccttccaagccgtggcggagcggtttctcaacggcgatgcctcgtcgtcttcttcatcatcattggtcatgaatgctcacaagcaagcgaagattcaagagctttgcaaaaaatacaatagattggtggaggagttaaaggtggacgaagtcaaagtcaagaaggcagctgcattggcggagacgagggtcgtgaataaggatgtgtggtggaaagtggatccaaatgacgtgaaggatcacgaaaaggcgaagaagatgatggagaagtatcaagagctctatgataaactgtgtgagcaagctgcttcaaggatcaagagaggacatgatgagaataataacaaatga

SEQ ID NO: 1344 - protein, 182 aa, Arabidopsis thaliana
  G2063,MADS domain coordinates 7-63
MNPKKTKGKQKINIKKIEKDEGRSVTFSKRLNGIYTKISELSILCGVEVAFIGYSCSGKPYTFGSPSFQAVAERFLNGDASSSSSSSLVMNAHKQAKIQELCKKYNRLVEELKVDEVKVKKAAALAETRVVNKDVWWKVDPNDVKDHEKAKKMMEKYQELYDKLCEQAASRIKRGHDENNNK

SEQ ID NO: 1345 - DNA, 975 bp, Arabidopsis thaliana
  G2067,family:AP2
gtcattcagaatacttttatctcatattcccaacacttgttcaagcatatctaagtcaataacaacattacaacataacatggtgaaacaagaactcaagatccaagttactacttcctcatcatcactctctcattcttcatcttcttcttcttcttcaacgtcggcactacgtcatcaatcttgtaagaacaagataaagaagtataaaggtgtgaggatgcgaagttggggatcatgggttactgaaattagggcaccaaatcaaaagacaagaatctggttaggttcttactccaccgcagaagcagctgctagggcttacgacgctgctctcttgtgtcttaagggacctaaagctaatctcaacttccctaacatcaccactacttctccttttcttatgaacatcgacgaaaagacccttttgtccccaaaatcaatccaaaaggtcgccgctcaagccgctaactcctcttctgaccattttacccctccgtccgatgaaaatgatcatgatcatgatgacggactcgatcaccatccatctgcttcttcttcagctgcatcttcaccaccagatgatgatcatcataatgatgacgatggtgatttggtatcgttgatggaatctttcgtggattacaacgaacacgtgtctctgatggatccatcgctgtatgaatttggacataatgagatcttcttcaccaacggagatccgtttgattattctccacagttacatagctcagaggcaacgatggatgacttctacgacgatgttgatattccgctatggagtttcagttaatccaacggtccatattattatactacgaaacacttttaattcacattatttcatttaatttattctttcaattcatattattcgtccttgttgtttcgttatgtattaaatatacacacactaatttaagaagatcacatggactagaggtttttttgtca

SEQ ID NO: 1346 - protein, 244 aa, Arabidopsis thaliana
  G2067,AP2 domain coordinates 40-102
MVKQELKIQVTTSSSSLSHSSSSSSSSTSALRHQSCKNKIKKYKGVRMRSWGSWVTEIRAPNQKTRIWLGSYSTAEAAARAYDAALLCLKGPKANLNFPNITTTSPFLMNIDEKTLLSPKSIQKVAAQAANSSSDHFTPPSDENDHDHDDGLDHHPSASSSAASSPPDDDHHNDDDGDLVSLMESFVDYNEHVSLMDPSLYEFGHNEIFFTNGDPFDYSPQLHSSEATMDDFYDDVDIPLWSFS

SEQ ID NO: 1347 - DNA, 447 bp, Arabidopsis thaliana
  G2070,family:bZIP
atgttttatactaatatggagacggttcataactgcttcaatgatgctacgataaccggtgatgaaatcattgatatattggcgtttcttcaatcagacgagtcggacaatccaagcggtataaacgaggtagtaccggtggatgataagaagagaagacggacgatatcaaaccgggaatcggccaagagatcgaggatgaaaaagaagaaacgttttgaagagttaactgaagaggtgaaccggttaaacataagaaatcaggagctgaaaaaccggttagctaatgttgttagttgtggtaattttatatctagggagaataaccggttgaaaaccgaatcggtttgccttgagataaggcttttagagttgtaccgttttttagtggccatgcaatcgccaatctcaacgagtgtaaattacatcacaacgctcgagatttaa

SEQ ID NO: 1348 - protein, 148 aa, Arabidopsis thaliana
  G2070,bZIP domain coordinates 45-137
MFYTNMETVHNCFNDATITGDEIIDILAFLQSDESDNPSGINEVVPVDDKKRRRTISNRESAKRSRMKKKKRFEELTEEVNRLNIRNQELKNRLANVVSCGNFISRENNRLKTESVCLEIRLLELYRFLVAMQSPISTSVNYITTLEI

SEQ ID NO: 1349 - DNA, 1482 bp, Arabidopsis thaliana
  G2071,family:bZIP
taggtaaagctaaaagggtctgattcgtttgttttttcactgaagaatttggaaggaagtgattccgttgtgaaacagaaaagaagtatgggtactcacattgatatcaacaacttaggcggcgatacttctagagggaatgagtcaaagccattggcgaggcagtcttcgttatattccttaacgtttgatgagcttcagagcacattaggtgagccggggaaagattttgggtctatgaatatggatgagttactcaagaacatatggactgctgaggatactcaagcctttatgactactacatcttcggttgcagccccgggacctagtggttttgttccgggaggaaatggtttacagaggcaaggctccttgaccttgcctagaacgcttagtcagaagactgtcgatgaagtctggaaatacctgaattcgaaagaaggtagtaatgggaatactggaacggatgcgcttgagaggcaacagactttaggggaaatgactctggaagatttcttactccgtgctggcgttgttaaagaagataatactcagcagaacgaaaacagtagtagcgggttttatgctaacaacggtgctgctggtttggagtttggatttggtcagccgaatcaaaacagcatatcgttcaacgggaacaatagttctatgatcatgaatcaagcacctggtttaggcctcaaagttggtggaaccatgcagcagcagcagcagccacatcagcagcagttgcagcagccacatcagagactgcctccaactatctttccaaaacaagcgaatgtaacatttgcggcgcctgtaaatatggtcaacaggggtttatttgagactagcgcagatggtccagccaacagtaatatgggaggagcagggggtactgttacagctacttctcctgggacgagcagtgcagaaaacaatacttggtcatcaccagttccttacgtgtttggtcggggaagaagaagcaatacgggcctggagaaggttgttgagagaaggcaaaagagaatgatcaagaatcgggaatccgctgctagatcaagggctcgaaaacaggcttataccttggaattggaagctgagattgaaagtctcaagctagtgaatcaagatttgcagaagaaacaggctgaaataatgaaaacccataatagtgagctaaaggaattttcgaagcagcctccattgctggccaaaagacaatgcttgagaagaacccttaccggtccgtggtaagaaggtgaagtcaaagcaagaagaacctgctaatgtaatacaggaccactcaaaaggaagacactgggagagtaatatgtaatagaagatagtgctactgtacaggagaaattacagagacgcttacaatgtagaaatcttttgagctgaatttaactaagagtgcagtctgtgtagagtatgagagctttcaatatgaattcataattttcataa

SEQ ID NO: 1350 - protein, 392 aa, Arabidopsis thaliana
  G2071,bZIP domain coordinates 307-358
MGTHIDINNLGGDTSRGNESKPLARQSSLYSLTFDELQSTLGEPGKDFGSMNMDELLKNIWTAEDTQAFMTTTSSVAAPGPSGFVPGGNGLQRQGSLTLPRTLSQKTVDEVWKYLNSKEGSNGNTGTDALERQQTLGEMTLEDFLLRAGVVKEDNTQQNENSSSGFYANNGAAGLEFGFGQPNQNSISFNGNNSSMIMNQAPGLGLKVGGTMQQQQQPHQQQLQQPHQRLPPTIFPKQANVTFAAPVNMVNRGLFETSADGPANSNMGGAGGTVTATSPGTSSAENNTWSSPVPYVFGRGRRSNTGLEKVVERRQKRMIKNRESAARSRARKQAYTLELEAEIESLKLVNQDLQKKQAEIMKTHNSELKEFSKQPPLLAKRQCLRRTLTGPW

SEQ ID NO: 1351 - DNA, 1099 bp, Arabidopsis thaliana
  G2072,family:bZIP
tcgacccacgcgtccgcccacgcgtccggatcttttcacagaagaccaaccagcttggctcgatgagctcctaagtgagccagcatcacctaagattaacaaaggtcatagacgttcagctagtgacacagctgcttacttgaactcagctttaatgccttcgaaggaaaatcatgttgctggttcgtcttggcagttccagaactatgatttgtggcagtccaactcttatgaacaacacaataaattaggatgggatttctctacagcaaatggaactaatatccaaagaaatatgtcatgcggagctttaaatatgtcgtcgaaacccattgagaaacatgtaagcaaaatgaaagaaggaacttctacaaaaccagatggtcctagatcaaagactgactcaaaacgtatcaaacatcaaaatgctcatcgagcgcgtttgagaaggcttgagtacatatcagaccttgaaaggaccatccaagtgctacaagttgaaggatgtgaaatgtcatctgccattcactacttggatcagcagttactcatgcttagcatggaaaatagagctttaaaacaacgtatggatagtttagcagaaatccaaaagcttaaacatgtggagcagcaattgcttgagagagagataggaaacctacagtttcgacgacaccaacaacaaccacagcaaaaccaaaaacaagtccaagcaatacaaaatcgatacaccaaatatcaaccacctgttacacaagaacccgatgcccaatttgcagccttggcaatatgatttaggaaatatggatacattgttcagattaagctgagctcctcttgctctaccttaatgtccatacaacataggtgaacttgatgtttgtagccttgaatgaaaacctaaaaaagcatcgttatgtaaatcaaaatgtggttgcccatatcctcctctattgcatttctctctatttatggcatggtagagaatctcttgtcaagaaacttcatgttatgtaataacttgtaatccttcttatttcatctattatatatatgaataagtaatttttttgccaaaaaaaaaaaaaaaaaaaaaaaa

SEQ ID NO: 1352 - protein, 212 aa, Arabidopsis thaliana
  G2072,bZIP domain coordinates 90-149
MPSKENHVAGSSWQFQNYDLWQSNSYEQHNKLGWDFSTANGTNIQRNMSCGALNMSSKPIEKHVSKMKEGTSTKPDGPRSKTDSKRIKHQNAHRARLRRLEYISDLERTIQVLQVEGCEMSSAIHYLDQQLLMLSMENRALKQRMDSLAEIQKLKHVEQQLLEREIGNLQFRRHQQQPQQNQKQVQAIQNRYTKYQPPVTQEPDAQFAALAI

SEQ ID NO: 1353 - DNA, 780 bp, Arabidopsis thaliana
  G2084,family:RING/C3HC4
atgcacaaggaaagagggaaaatgccggtttctagcaacagaaatagagtatcgccatacccgcttcgctcttgcaggaacaagaaacaaaaagaagtcgaggcgtcgtcgtcacctgttgagttagagagtgttagtgaatgggaggatgtgaggtgtgtgatttgtatggagcctcctcacaatgctgtcctcttgcaatgctcttctttctccaaaggatgtcgtgcttacatgtgtgatacaagcgctcgtcactccaattgtttcaagcagtaccgcagaagcaacagctcaagccgttgtagtggcaagactctacattgtccctactgcagaggagaggttcaggggactatgaagtcgacttgtgctcggagattcatgaatgctagaccgaggtgttgtactgttgacaagtgcgatttctcagggacctatgcgcagctgaaaaatcacttgaaaactgagcatcctggttttacaccgccaaagttagacccttgggagcaacacatgtgggagcagttggagagagaggcggagtacattgaaatgctcaacgctcgtcagagatgggatgcagaacagagattgttggcgacttctctccatcagcttccatatcgtcatcccatgattgatctcaactttgatgcgttggtgcataatctgtttcttggtgcgtccatggagagccgtgcaagcaccgacaattacccggctcacataccccgtctggagttccatgcccccatgtatcccagatggacgccatga

SEQ ID NO: 1354 - protein, 259 aa, Arabidopsis thaliana
  G2084,RING/C3HC4 domain coordinates 41-172
MHKERGKMPVSSNRNRVSPYPLRSCRNKKQKEVEASSSPVELESVSEWEDVRCVICMEPPHNAVLLQCSSFSKGCRAYMCDTSARHSNCFKQYRRSNSSSRCSGKTLHCPYCRGEVQGTMKSTCARRFMNARPRCCTVDKCDFSGTYAQLKNHLKTEHPGFTPPKLDPWEQHMWEQLEREAEYIEMLNARQRWDAEQRLLATSLHQLPYRHPMIDLNFDALVHNLFLGASMESRASTDNYPAHIPRLEFHAPMYPRWTP

SEQ ID NO: 1355 - DNA, 1119 bp, Arabidopsis thaliana
  G2085,family:GATA/Zn
gttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatctcag

SEQ ID NO: 1356 - protein, 309 aa, Arabidopsis thaliana
  G2085,GATA/Zn domain coordinates 214-241
MFGRHSIIPNNQIGTASASAGEDHVSASATSGHIPYDDMEEIPHPDSIYGAASDLIPDGSQLVAHRSDGSELLVSRPPEGANQLTISFRGQVYVFDAVGADKVDAVLSLLGGSTELAPGPQVMELAQQQNHMPVVEYQSRCSLPQRAQSLDRFRKKRNARCFEKKVRYGVRQEVALRMARNKGQFTSSKMTDGAYNSGTDQDSAQDDAHPEISCTHCGISSKCTPMMRRGPSGPRTLCNACGLFWANRGTLRDLSKKTEENQLALMKPDDGGSVADAANNLNTEAASVEEHTSMVSLANGDNSNLLGDH

SEQ ID NO: 1357 - DNA, 450 bp, Arabidopsis thaliana
  G2094,family:GATA/Zn
atgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaa

SEQ ID NO: 1358 - protein, 149 aa, Arabidopsis thaliana
  G2094,GATA/Zn domain coordinates 43-68
MLDPTEKVIDSESMESKLTSVDAIEEHSSSSSNEAISNEKKSCAICGTSKTPLWRGGPAGPKSLCNACGIRNRKKRRTLISNRSEDKKKKSHNRNPKFGDSLKQRLMELGREVMMQRSTAENQRRNKLGEEEQAAVLLMALSYASSVYA

SEQ ID NO: 1359 - DNA, 1536 bp, Arabidopsis thaliana
  G2105,family:TH
ctctctgacttgaactcttctcttctaccgaatcaaaccaaatggaggatcatcaaaaccatccacagtacggtatagaacaaccatcttctcaattctcctctgatctcttcggcttcaacctcgtttcagcgccggaccagcaccatcgtcttcatttcaccgaccatgagataagtttattgccacgtggaatacaagggcttacggtggctggaaacaacagtaacactattacaacgatccagagtggtggctgtgttggtgggtttagtggctttacggacggcggaggaacagggaggtggccgaggcaagagacgttgatgttgttggaggtcagatctcgtcttgatcacaagttcaaagaagctaatcaaaagggtcctctctgggatgaagtttctaggattatgtcggaggaacatggatacactaggagtggcaagaagtgtagagagaagttcgagaatctctacaagtactataaaaaaacaaaagaaggcaaatccggtcggcgacaagatggtaaaaactatagatttttccggcagcttgaagcgatatacggcgaatccaaagactcggtttcttgctataacaacacgcagttcataatgaccaatgctcttcatagtaatttccgcgcttctaacattcataacatcgtccctcatcatcagaatcccttgatgaccaataccaatactcaaagtcaaagccttagcatttctaacaatttcaactcctcctccgatttggatctaacttcttcctctgaaggaaacgaaactactaaaagagaggggatgcattggaaggaaaagatcaaggaattcattggtgttcatatggagaggttgatagagaagcaagatttttggcttgagaagttgatgaagattgtggaagacaaagaacatcaaaggatgctgagagaagaggaatggagaaggattgaagcggaaaggatcgataaggaacgttcgttttggacaaaagagagggagaggattgaagctcgggatgttgcggtgattaatgccttgcagtacttgacgggaagggcattgataaggccggattcttcgtctcctacagagaggattaatgggaatggaagcgataaaatgatggctgataatgaatttgctgatgaaggaaataagggcaagatggataaaaaacaaatgaataagaaaaggaaggagaaatggtcaagccacggagggaatcatccaagaaccaaagagaatatgatgatatacaacaatcaagaaactaagattaatgatttttgtcgagatgatgaccaatgccatcatgaaggttactcaccttcaaactccaagaacgcaggaactccgagctgcagcaatgccatggcagctagtacaaagtgctttccattgcttgaaggagaaggagatcagaacttgtgggagggttatggtttgaagcaaaggaaagaaaataatcatcagtaagctacatttttcattctcaaaatgaagaataagagaacttagaaacgat

SEQ ID NO: 1360 - protein, 481 aa, Arabidopsis thaliana
  G2105,TH domain coordinates 100-153
MEDHQNHPQYGIEQPSSQFSSDLFGFNLVSAPDQHHRLHFTDHEISLLPRGIQGLTVAGNNSNTITTIQSGGCVGGFSGFTDGGGTGRWPRQETLMLLEVRSRLDHKFKEANQKGPLWDEVSRIMSEEHGYTRSGKKCREKFENLYKYYKKTKEGKSGRRQDGKNYRFFRQLEAIYGESKDSVSCYNNTQFIMTNALHSNFRASNIHNIVPHHQNPLMTNTNTQSQSLSISNNFNSSSDLDLTSSSEGNETTKREGMHWKEKIKEFIGVHMERLIEKQDFWLEKLMKIVEDKEHQRMLREEEWRRIEAERIDKERSFWTKERERIEARDVAVINALQYLTGRALIRPDSSSPTERINGNGSDKMMADNEFADEGNKGKMDKKQMNKKRKEKWSSHGGNHPRTKENMMIYNNQETKINDFCRDDDQCHHEGYSPSNSKNAGTPSCSNAMAASTKCFPLLEGEGDQNLWEGYGLKQRKENNHQ

SEQ ID NO: 1361 - DNA, 1126 bp, Arabidopsis thaliana
  G2106,family:AP2
cctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctgtaaattttctcggaatcctattgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaa

SEQ ID NO: 1362 - protein, 352 aa, Arabidopsis thaliana
  G2106,AP2 domain coordinates 56-139,165-233
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPVNFLGILLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 1363 - DNA, 845 bp, Arabidopsis thaliana
  G2107,family:AP2
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgccaaaaaaaaaaaaaaaaaaaaaaaaa

SEQ ID NO: 1364 - protein, 181 aa, Arabidopsis thaliana
  G2107,AP2 domain coordinates 27-94
MENDDITVAEMKPKKRAGRRIFKETRHPIYRGVRRRDGDKWVCEVREPIHQRRVWLGTYPTADMAARAHDVAVLALRGRSACLNFSDSAWRLPVPASTDPDTIRRTAAEAAEMFRPPEFSTGITVLPSASEFDTSDEGVAGMMMRLAEEPLMSPPRSYIDMNTSVYVDEEMCYEDLSLWSY

SEQ ID NO: 1365 - DNA, 722 bp, Arabidopsis thaliana
  G2108,family:AP2
gagagagaaacattgatctctgaatattgtgaacatgttgaaatcaagtaacaagagaaaaagcaaagaagagaagaagttacaagaagggaagtaccttggagtgaggagacgtccatggggaagatatgcagctgaaatcagaaacccttttactaaagaaagacattggcttggaacgtttgatacagccgaagaagctgcttttgcatatgacgttgctgctcgatccatcagcggctctctagctacaacaaacttcttctacactgaaaacacctctttagaaagacatccacaacagtctttggagcctcatatgacttggggatcttctagtctctgtcttcttcaagatcagccttttgaaaacaaccattttgttgctgatcctatctcttcttctttttctcaaaaacaagagtcttctaccaatctcactaacactttctcacattgttataatgatggtgatcatgttggccaaagcaaagagatttctttacctaatgatatgtcaaacagtttattcggtcatcaggacaaagtcggtgaacatgacaatgcagaccatatgaagtttggctcagttctcagcgacgaacctctctgctttgagtatgactacattgggaattatcttcagagttttctcaaagatgtcaacgacgatgctccacagtttcttatgtgagcttgtattaccgatccttcaatttatg

SEQ ID NO: 1366 - protein, 219 aa, Arabidopsis thaliana
  G2108,AP2 domain coordinates 18-85
MLKSSNKRKSKEEKKLQEGKYLGVRRRPWGRYAAEIRNPFTKERHWLGTFDTAEEAAFAYDVAARSISGSLATTNFFYTENTSLERHPQQSLEPHMTWGSSSLCLLQDQPFENNHFVADPISSSFSQKQESSTNLTNTFSHCYNDGDHVGQSKEISLPNDMSNSLFGHQDKVGEHDNADHMKFGSVLSDEPLCFEYDYIGNYLQSFLKDVNDDAPQFLM

SEQ ID NO: 1367 - DNA, 1428 bp, Arabidopsis thaliana
  G2109,family:MADS
gtattggttttgaacaggggatgggaagggttaagttgaagattaaaagacttgagagcacaagcaacaggcaagttacatacacgaagagaaaaaatgggattttgaagaaagccaaagagttatcgattttgtgtgatattgatattgtccttcttatgttttcccctaccggaagagctactgctttccatggagaacacagttgcattgaagaggttatttccaagtttgcgcaattaactccacaagaaaggacaaaaaggaaactggagagccttgaagcattgaagaaaacttttaagaaactggatcatgatgtaaatatacatgactttttaggagcaaggaatcaaactattgagggtctaagtaaccaagtagccatttaccaagctcagctaatggagtgtcataggaggttgagttgttggacgaacatcgatagaatagaaaacactgagcacctcgatttattggaagaatcattgaggaaatccattgaaagaatccagattcacaaggaacattacagaaagaaccaactcttgccaatagaatgtgcaacaacacagtttcacagcgggatacagttgcctatggcgatgggaggtaatagtagtatgcaagaagctcactccatgtcttggcttcctgataatgatcaccagcaaacaatcttacctggtgattccagttttcttccccatagagagatggatggttcgattcccgtttactcaagctgcttctttgagtctacgaaaccagaagatcagatatgcagcaacccgggacaacagtttgagcagttagaacaacaaggaaacggttgtttggggttacaacaacttggagaggaatattcatatcctacaccgtttggtactactttgggaatggaagaagatcaagagaaaaagataaaatctgaaatggaattgaacaacttgcaacaacagcaacagcaacaacaacaacaacaacaacaagatccttcaatgtatgatcccatggctaataataatggtggctgctttcagattcctcatgatcagtccatgtttgtcaatgatcatcatcatcatcatcaccaccatcatcaaaattgggttccagattcaatgtttggtcagacttcttacaaccagcaaccgaactaactcaagacatggctcatgtatgtatgatgactggacttatgtctgaccaaggactagtttgagccattgcctacaatgtctaagataaatatatatatgtagacagcgagagagtgtgtgtacatgtttttgtatgtgtgagcttgtgtcatatactcaggggagttttaggcatttgtgtataagagatgttgtctaggaaccgtatattacctttaacaagaatgataagtatatcaatatattaatgtttttaaaaaaaaaa

SEQ ID NO: 1368 - protein, 380 aa, Arabidopsis thaliana
  G2109,MADS domain coordinates 1-57
MGRVKLKIKRLESTSNRQVTYTKRKNGILKKAKELSILCDIDIVLLMFSPTGRATAFHGEHSCIEEVISKFAQLTPQERTKRKLESLEALKKTFKKLDHDVNIHDFLGARNQTIEGLSNQVAIYQAQLMECHRRLSCWTNIDRIENTEHLDLLEESLRKSIERIQIHKEHYRKNQLLPIECATTQFHSGIQLPMAMGGNSSMQEAHSMSWLPDNDHQQTILPGDSSFLPHREMDGSIPVYSSCFFESTKPEDQICSNPGQQFEQLEQQGNGCLGLQQLGEEYSYPTPFGTTLGMEEDQEKKIKSEMELNNLQQQQQQQQQQQQQDPSMYDPMANNNGGCFQIPHDQSMFVNDHHHHHHHHHQNWVPDSMFGQTSYNQQPN

SEQ ID NO: 1369 - DNA, 1828 bp, Arabidopsis thaliana
  G2110,family:WRKY
gagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaagttggactcaactaaagtcgaaatggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacgatgaacgacggatgtcaatggaggaaatatggccagaaaatagctaaaggcaatccatgtccccgagcttactatcgttgcaccattgcagcttcttgtccagtaagaaaacaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagcccttaaagagaattgttatatatatgttcttatatactcagtacattggtaaatgggtttagactttcactagtttcctagttcatctatatattggttgtttaatcacaagtttattttgttgttggagtttatggaactaatgtgtacatatgaaactttagaacgaataaataaaacttggaattcctttttaaaaaaaaaaaaaaaaa

SEQ ID NO: 1370 - protein, 528 aa, Arabidopsis thaliana
  G2110,WRKY domain coordinates 239-298
MEKDDFLRSGHGREESHDEMRKLDSSHDDSHQEHDHIIRSKLDSTKVEMDEAKEENRRLKSSLSKIKKDFDILQTQYNQLMAKHNEPTKFQSKGHHQDKGEDEDREKVNEREELVSLSLGRRLNSEVPSGSNKEEKNKDVEEAEGDRNYDDNEKSSIQGLSMGIEYKALSNPNEKLEIDHNQETMSLEISNNNKIRSQNSFGFKNDGDDHEDEDEILPQNLVKKTRVSVRSRCETPTMNDGCQWRKYGQKIAKGNPCPRAYYRCTIAASCPVRKQVQRCSEDMSILISTYEGTHNHPLPMSATAMASATSAAASMLLSGASSSSSAAADLHGLNFSLSGNNITPKPKTHFLQSPSSSGHPTVTLDLTTSSSSQQPFLSMLNRFSSPPSNVSRSNSYPSTNLNFSNNTNTLMNWGGGGNPSDQYRAAYGNINTHQQSPYHKIIQTRTAGSSFDPFGRSSSSHSPQINLDHIGIKNIISHQVPSLPAETIKAITTDPSFQSALATALSSIMGGDLKIDHNVTRNEAEKSP

SEQ ID NO: 1371 - DNA, 964 bp, Arabidopsis thaliana
  G2111,family:MADS
atttgatactagacatacaaattcctttttattgttgtcattaccatgacgaggaagaagctaaacctatcttacatcaccaatgagtcaatgagaaaagcaacattcaataagagaaagaaagggcttgtgaaaaaaatccacgagctttccgttctctgcggaatcgaagcatgtgcagtgatttatagtccgttcaactcaaaccctgaagtctggccatcgaattcagaagttaaaaatgtaatggaaaattttgagatgttgacaaagttggagcaagagaagaaaatggtgagccacgaaggttttatcagacaaaacatctcaaaaactatggagagtaacaacaaaaagatgatcgataatgcggagaggacgatgaaagaagccatgttccaacttcttagtggaaaaggggagaagcttaatttgactgatagaaaccgtgaagatttgtgtaagtacattgatcaatatcttaaagaactttatcaccacaaaaacaaaaccataaatcaatcacatattgaacctggagaatcttcgggagctacaaatgccatgacaccaacatctgttgttgaagtgagttcttattcctttccaattatctcgatgttttcaactctccttgactaatcaatgatttctcgtctttgaagcctattatctcttcaatccagcgaccaaatcaggttaatatcttctccagtaattttctatctagtgatgctgaccagtaaagttattctctagtgataaatccatttggtgtttatgatcagaatccaaattttaatcatcttagtcataatcaatatcaatatcaacaacagtttggatatccgattttggttcaagatggaatttacaatccgagtcaaattcagaatcaacatgaggaatggctggatgatcatatgatgaatcattctaaggaaataagtcatcctttgatgga

SEQ ID NO: 1372 - protein, 198 aa, Arabidopsis thaliana
  G2111,MADS domain coordinates 1-57
MTRKKLNLSYITNESMRKATFNKRKKGLVKKIHELSVLCGIEACAVIYSPFNSNPEVWPSNSEVKNVMENFEMLTKLEQEKKMVSHEGFIRQNISKTMESNNKKMIDNAERTMKEAMFQLLSGKGEKLNLTDRNREDLCKYIDQYLKELYHHKNKTINQSHIEPGESSGATNAMTPTSVVEVSSYSFPIISMFSTLLD

SEQ ID NO: 1373 - DNA, 640 bp, Arabidopsis thaliana
  G2113,family:AP2
ataacaaactcatcaaacttcctcagcgtttctttttcttacataaacaatttttcttacataaacaaatcttgttgtttgttgttgtcatggcaccgacagttaaaacggcggccgtcaaaaccaacgaaggtaacggagtccgttacagaggagtgaggaagagaccatggggacgttacgcagccgagatcagagatcctttcaagaagtcacgtgtctggctcggtactttcgacactcctgaagaagccgctcgtgcctacgacaaacgtgctattgagtttcgtggagctaaagccaaaaccaacttcccttgttacaacatcaacgcccactgcttgagtttgacacagagcctgagccagagcagcaccgtggaatcatcgtttcctaatctcaacctcggatctgactctgttagttcgagattcccttttcctaagattcaggttaaggctgggatgatggtgttcgatgaaaggagtgaatcggattcttcgtcggtggtgatggatgtcgttagatatgaaggacgacgtgtggttttggacttggatcttaatttccctcctccacctgagaactgattaagatttaattatgattattagatataattaaatgtttctgaattgag

SEQ ID NO: 1374 - protein, 166 aa, Arabidopsis thaliana
  G2113,AP2 domain coordinates 55-122
MAPTVKTAAVKTNEGNGVRYRGVRKRPWGRYAAEIRDPFKKSRVWLGTFDTPEEAARAYDKRAIEFRGAKAKTNFPCYNINAHCLSLTQSLSQSSTVESSFPNLNLGSDSVSSRFPFPKIQVKAGMMVFDERSESDSSSVVMDVVRYEGRRVVLDLDLNFPPPPEN

SEQ ID NO: 1375 - DNA, 1500 bp, Arabidopsis thaliana
  G2114,family:AP2
ataaaacgaaaccctatacatataaactaagagcgagaaagacagctagagagagagagagagatgaagaaatggttgggattttcattgacacctcctttgagaatctgcaatagtgaagaagaagaacttaggcatgacggttccgatgtttggagatatgatattaactttgatcatcatcatcatgatgaagacgttccaaaggtggaagatctcctctcaaactctcatcaaaccgagtatcctataaaccataaccaaaccaatgtcaactgcaccactgtggttaacaggttaaacccacccggttaccttctccacgaccaaaccgtagttacaccacattacccgaacctagatccgaaccttagcaatgattatggaggttttgagagggtcggttcggtctcggttttcaaatcttggttagagcaaggcactccagcattcccactctcgagtcattacgttactgaagaggctggtacgagcaataatattagtcattttagtaacgaagagactggttataacaccaatggctcaatgctatcattggctttgagccatggggcttgttctgatttgatcaacgaatcgaatgtatccgcacgggtcgaagaaccggttaaggtagatgagaagcggaagagattggttgttaaacctcaggtaaaggaatccgttcctcggaagtcggttgatagttatggacaaagaacttctcagtatcgtggagttacaaggcatagatggacagggagatatgaagctcacttatgggataatagctgtaagaaggagggacagacaaggagaggaagacaagtgtatcttggagggtatgatgaggaggagaaagcagcgagggcatatgatttagcggctctgaagtattggggtcctaccactcacttaaatttccctttgagtaattacgaaaaggagatcgaggaactcaataacatgaatcggcaagaatttgttgccatgttgaggaggaatagcagcgggttttcgaggggagcttccgtgtatagaggagttacaaggcatcatcaacatggaaggtggcaagccagaattggaagagttgctggaaacaaggacttgtaccttggaacatttagcacgcaagaagaagcagcggaggcgtacgatatcgcggcaattaaattcagaggcctaaacgctgtaaccaatttcgatataaatagatatgacgtgaagaggatatgttcaagctcaacgattgttgatagcgaccaggccaaacattctcccaccagctctggcgccggccactaaccgacaccgtaaactcctcgccggagagactattcccacgtacggttggtttgaggaaataagttcgtccagtctgtttaatcatttatggtttaataaacatatattcctaagtaattgaggccggtctacatatatacaacttttttagcaaattaagttatcagaatccactatatattattctct

SEQ ID NO: 1376 - protein, 415 aa, Arabidopsis thaliana
  G2114,AP2 domain coordinates 221-295,323-393
MKKWLGFSLTPPLRICNSEEEELRHDGSDVWRYDINFDHHHHDEDVPKVEDLLSNSHQTEYPINHNQTNVNCTTVVNRLNPPGYLLHDQTVVTPHYPNLDPNLSNDYGGFERVGSVSVFKSWLEQGTPAFPLSSHYVTEEAGTSNNISHFSNEETGYNTNGSMLSLALSHGACSDLINESNVSARVEEPVKVDEKRKRLVVKPQVKESVPRKSVDSYGQRTSQYRGVTRHRWTGRYEAHLWDNSCKKEGQTRRGRQVYLGGYDEEEKAARAYDLAALKYWGPTTHLNFPLSNYEKEIEELNNMNRQEFVAMLRRNSSGFSRGASVYRGVTRHHQHGRWQARIGRVAGNKDLYLGTFSTQEEAAEAYDIAAIKFRGLNAVTNFDINRYDVKRICSSSTIVDSDQAKHSPTSSGAGH

SEQ ID NO: 1377 - DNA, 765 bp, Arabidopsis thaliana
  G2115,family:AP2
aatcactctacaaagcctgtacgtacacaacaacattaccatggtgaaacaagaacgcaagatccaaaccagcagcacaaaaaaggaaatgcctttgtcatcatcaccatcttcttcttcttcttcatcttcttcctcgtcttcgtcttcgtgtaagaacaagaacaagaagagtaagattaagaagtacaaaggagtgaggatgagaagttggggatcatgggtctctgagattagggcaccaaatcaaaagacaaggatttggttaggttcttactcaacagctgaagcagctgctagagcttacgatgttgcactcttatgtctcaaaggccctcaagccaatctcaacttccctacttcttcttcttctcatcatcttcttgataatctcttagatgaaaatacccttttgtcccccaaatccatccaaagagtagctgctcaagctgccaactcatttaaccattttgcccctacttcatcagccgtctcgtcaccgtccgatcatgatcatcaccatgatgatgggatgcaatctttgatgggatcttttgtggacaatcatgtgtctttgatggattcaacatcttcatggtatgatgatcataatgggatgttcttgtttgataatggagctccattcaattactctcctcaactaaactcgacgacgatgctcgatgaatacttctacgaagatgctgacattccgctttggagtttcaattaatccgacggtccataatacatactttaattagt

SEQ ID NO: 1378 - protein, 230 aa, Arabidopsis thaliana
  G2115,AP2 domain coordinates 47-113
MVKQERKIQTSSTKKEMPLSSSPSSSSSSSSSSSSSSCKNKNKKSKIKKYKGVRMRSWGSWVSEIRAPNQKTRIWLGSYSTAEAAARAYDVALLCLKGPQANLNFPTSSSSHHLLDNLLDENTLLSPKSIQRVAAQAANSFNHFAPTSSAVSSPSDHDHHHDDGMQSLMGSFVDNHVSLMDSTSSWYDDHNGMFLFDNGAPFNYSPQLNSTTMLDEYFYEDADIPLWSFN

SEQ ID NO: 1379 - DNA, 1148 bp, Arabidopsis thaliana
  G2116,family:bZIP
ttcatctccatcattatctccattgacattgttctcaattgcgaataataatcataattattcacacaaccaaagcattcatctctcagattctcttaaaaaaatggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattgacgacaagattatgatgaggctcatttttctg

SEQ ID NO: 1380 - protein, 337 aa, Arabidopsis thaliana
  G2116,bZIP domain coordinates 150-210
MEKSDPPPVPKPGATIIPSSDPIPNADPIPSSSFHRRSRSDDMSMFMFMDPLSSAAPPSSDDLPSDDDLFSSFIDVDSLTSNPNPFQNPSLSSNSVSGAANPPPPPSSRPRHRHSNSVDAGCAMYAGDIMDAKKAMPPEKLSELWNIDPKRAKRILANRQSAARSKERKARYIQELERKVQSLQTEATTLSAQLTLYQRDTNGLANENTELKLRLQAMEQQAQLRNALNEALRKEVERMKMETGEISGNSDSFDMGMQQIQYSSSTFMAIPPYHGSMNLHDMQMHSSFNPMEMSNSQSVSDFLQNGRMQGLEISSNSSSLVKSEGPSLSASESSSAY

SEQ ID NO: 1381 - DNA, 506 bp, Arabidopsis thaliana
  G2117,family:bZIP
atacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaag

SEQ ID NO: 1382 - protein, 138 aa, Arabidopsis thaliana
  G2117,bZIP domain coordinates 46-106
MAGSVYNLPSQNPNPQSLFQIFVDRVPLSNLPATSDDSSRTAEDNERKRRRKVSNRESARRSRMRKQRHMEELWSMLVQLINKNKSLVDELSQARECYEKVIEENMKLREENSKSRKMIGEIGLNRFLSVEADQIWTF

SEQ ID NO: 1383 - DNA, 657 bp, Arabidopsis thaliana
  G2123,family:GF14
atgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgaaaggagattattttcgatatatggcagagtttggttctgatgctgaacgtaaagaaaatgcagataattctctagatgcatataaggttgcaatggaaatggcagagaatagtttagcacccaccaatatggttagacttggattggctttaaatttctcgatattcaattatgagatccataaatctattgaaagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttag

SEQ ID NO: 1384 - protein, 218 aa, Arabidopsis thaliana
  G2123,GF14 domain coordinates 99-109
MRKVCELDIELSEEERDLLTTGYKNVMEAKRVSLRVISSIEKMEDSKGNDQNVKLIKGQQEMVKYEFFNVCNDILSLIDSHLIPSTTTNVESIVLFNRVKGDYFRYMAEFGSDAERKENADNSLDAYKVAMEMAENSLAPTNMVRLGLALNFSIFNYEIHKSIESACKLVKKAYDEAITELDGLDKNICEESMYIIEMLKYNLSTWTSGDGNGNKTDG

SEQ ID NO: 1385 - DNA, 1120 bp, Arabidopsis thaliana
  G2124,family:TEO
gaacagcaaaaccctagatttcctgttcaagctcaagaccgtacaaaactttggaactcatatataaagatctcgagaatagcattatgaatatcgtctcttggaaagatgcaaacgacgaagttgcaggcggcgctacgacaagacgtgaaagagaagtaaaagaggatcaagaagaaaccgaagtcagagccaccagtggcaaaaccgtaattaaaaagcagcctacatcgatctcttcttcttcttcttcgtggatgaaatccaaggatccgaggattgttagggtttcacgcgcctttggaggcaaagaccgtcacagcaaagtgtgtacgttacgtggactacgtgacagacgcgtgagattatcagtcccaacggctattcagctctacgatcttcaagaacggctcggtgttgaccagcctagcaaagccgttgactggttgcttgatgcagctaaagaggagatcgacgagctacctccgttacctatctcgccggaaaatttcagcatcttcaaccatcatcagtccttcttgaatcttggtcaacggcccggtcaagatccgacccaactcgggtttaaaatcaatggatgtgtacaaaagtctactactactagccgcgaagaaaacgatagagagaaaggagaaaacgatgtcgtttacacaaacaatcatcatgttgggtcttatggaacttatcacaacctggaacatcatcatcatcatcaccaacatttgagtttacaggcagattatcatagtcatcaactacatagtcttgtcccatttccatcacaaattttggtatgtccaatgacgacatcaccaacaactacaactatacaatctttgtttccatcatcatcgtcagctggttcagggactatggagacattagatccgaggcaaatgtagcaacaatggtggtagagacattgataatcggatgtcgtcggtccaattcaaccgaactaatagcactacaacggctaacatgtcgaggcatctaggctcggagcgttgtacaagtagaggaagtgatcaccatatgtgaagttagattattgaaacgatataattgttgtttgatgtgttcagaaataaggggacac

SEQ ID NO: 1386 - protein, 278 aa, Arabidopsis thaliana
  G2124,TEO domain coordinates 75-132
MNIVSWKDANDEVAGGATTRREREVKEDQEETEVRATSGKTVIKKQPTSISSSSSSWMKSKDPRIVRVSRAFGGKDRHSKVCTLRGLRDRRVRLSVPTAIQLYDLQERLGVDQPSKAVDWLLDAAKEEIDELPPLPISPENFSIFNHHQSFLNLGQRPGQDPTQLGFKINGCVQKSTTTSREENDREKGENDVVYTNNHHVGSYGTYHNLEHHHHHHQHLSLQADYHSHQLHSLVPFPSQILVCPMTTSPTTTTIQSLFPSSSSAGSGTMETLDPRQM

SEQ ID NO: 1387 - DNA, 902 bp, Arabidopsis thaliana
  G2129,family:bZIP
actcatttcctcatcttttggtctttctcttttcattcttagaaaaagaaaatttgaaaaaaagataaaaagaaaaagaaaagtaaatctaaaaagttattaggaaaaacccccatcaatattctactaatgtctgaccaaaatagcctcatgtgtgtattctctcgtccataaatatggacctccaacaatgcaattcttcccttttccccttctaatctctctcgcatctctacattttgagatcattttaaattgtcctctcttttattttccggttaagcaccatgatgtctactatttccccggttttctcaaccgaaccgggtctattaacctctgtcctcccagcttttgaaaccagtttcactccatgggacatttcacacctcttctcggtcttcgattcattaatcgatccaaaaccggtttcgacccatgactatggttcagtaaaccagatcggttcagacatgtctccgaccgacaataccgacgagcggaaaaagaaacggaaattatcgaaccgggaatcggctaagcggtcaagagagaagaaacaaaagcacttggaggagatgagtatccagctaaaccaactcaaaattcagaaccaagaattgaagaaccagcttcggtacgttttataccattgtcaacgaacgaagatggaaaatgatcgtctacttatggagcaccgtatactgcatgataagttgttgaacatcagacaagttttgatgtttcgtcaaacctaacgaagctcatcaaactgtgccacttggccttgtaataacagtactgttgttacggtccagcaagatccgtcgatcatgttatcataagttgaggtttctgaaattgtttcgacggtaaaatgggaacaatttgtaaaaacaatt

SEQ ID NO: 1388 - protein, 156 aa, Arabidopsis thaliana
  G2129,bZIP domain coordinates 71-140
MMSTISPVFSTEPGLLTSVLPAFETSFTPWDISHLFSVFDSLIDPKPVSTHDYGSVNQIGSDMSPTDNTDERKKKRKLSNRESAKRSREKKQKHLEEMSIQLNQLKIQNQELKNQLRYVLYHCQRTKMENDRLLMEHRILHDKLLNIRQVLMFRQT

SEQ ID NO: 1389 - DNA, 1019 bp, Arabidopsis thaliana
  G2130,family:AP2
cctctcttcattttttaactccctctctctctctctctctatggagagacgaacgagacgagtgaagttcacagagaatcgtacggtcacaaacgtagcagctacaccatctaacgggtctccgagactggtccgtatcactgttactgatcctttcgctactgactcgtctagcgacgacgacgacaacaacaacgtcacggtggttccaagagtgaaacgatacgtgaaggagattagattctgccaaggtgaatcttcttcctccaccgcggcgaggaaaggtaagcacaaggaggaggaaagcgtagtggttgaagatgacgtgtcgacgtcggtgaagcctaaaaagtacagaggcgtgagacagagaccttggggaaaattcgcggcggagattagagatccgtcgagccgtactcggatttggcttgggacttttgtcacggcggaggaagctgctatagcgtacgatagagccgcgattcatctcaaaggacctaaagcgctcacgaatttcctaactccgccgacgccaacgccggttatcgatctccaaacggtttccgcctgcgattacggtagagattctcggcagagccttcattcaccgacctctgttctaagattcaacgtcaacgaggaaacagagcatgagattgaagcgatcgagctatctccggagagaaagtcgacggttataaaagaagaagaagaatcgtcggcgggtttggtgttcccggatccgtatctgttaccggatttatctctcgccggcgaatgtttttgggataccgaaattgcccctgaccttttgtttctcgatgaagaaaccaaaatccaatcaacgttgttaccaaacacagaggtttcgaaacaaggagaaaacgaaactgaagatttcgagtttggtttgattgatgatttcgagtcttctccatgggatgtggatcatttcttcgaccatcatcatcactctttcgattaaaaatctcttcttttttggggaaatttttgtg

SEQ ID NO: 1390 - protein, 315 aa, Arabidopsis thaliana
  G2130,AP2 domain coordinates 101-169
MERRTRRVKFTENRTVTNVAATPSNGSPRLVRITVTDPFATDSSSDDDDNNNVTVVPRVKRYVKEIRFCQGESSSSTAARKGKHKEEESVVVEDDVSTSVKPKKYRGVRQRPWGKFAAEIRDPSSRTRIWLGTFVTAEEAAIAYDRAAIHLKGPKALTNFLTPPTPTPVIDLQTVSACDYGRDSRQSLHSPTSVLRFNVNEETEHEIEAIELSPERKSTVIKEEEESSAGLVFPDPYLLPDLSLAGECFWDTEIAPDLLFLDEETKIQSTLLPNTEVSKQGENETEDFEFGLIDDFESSPWDVDHFFDHHHHSFD

SEQ ID NO: 1391 - DNA, 1065 bp, Arabidopsis thaliana
  G2131,family:AP2
gtctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaatatattct

SEQ ID NO: 1392 - protein, 313 aa, Arabidopsis thaliana
  G2131,AP2 domain coordinates 50-121,146-217
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 1393 - DNA, 1064 bp, Arabidopsis thaliana
  G2132,family:AP2
attctgttacttagtaccggagtttagtcggagagagaacaatgatcagtttcagagaagagaacatcgatctcaacttgattaaaacaattagtgtaatctgtaatgatccagacgccaccgattcctctagcgacgatgaatctatctccggcaataatcctcgccgtcagatcaaaccaaaaccaccgaaacgttacgtctcaaagatctgtgtcccgacgctgatcaaaaggtatgagaacgtttcgaattctacagggaataaagcagccggaaaccggaaaacgtcgtcgggtttcaaaggcgtacgacggaggccgtgggggaaatttgcggcggagataagaaatccgtttgagaagaagagaaagtggcttggaacgtttcctactgaagaagaagcagcagaagcttaccaaaagagtaaaagagagtttgatgaacgattgggtttagttaaacaggaaaaagacctagtagatttgaccaagccgtgcggtgtacgtaaaccagaagagaaggaagttactgagaagtcgaattgcaaaaaggtaaataagagaattgttactgatcagaagccatttggttgtggttataacgctgatcatgaagaagagggagtgattagtaaaatgttggaagatccgttgatgacatcgtcaattgctgatatttttggtgattcggctgttgaagcaaatgatatttgggtggattacaattcagtggaatttatttccattgtagatgatttcaagtttgattttgtggagaatgatagagtaggaaaggagaaaacatttggatttaagattggggatcacactaaagttaatcaacatgccaaaatcgtatcgaccaatggggacttattcgtcgatgatttacttgattttgatccgttgatagatgattttaagttagaagattttcctatggatgatcttggattattaggagatccagaggatgatgattttagttggtttaatggtactactgattggatcgataagtttttatgaatactttcttgacacggccaacggtattagtac

SEQ ID NO: 1394 - protein, 329 aa, Arabidopsis thaliana
  G2132,AP2 domain coordinates 84-151
MISFREENIDLNLIKTISVICNDPDATDSSSDDESISGNNPRRQIKPKPPKRYVSKICVPTLIKRYENVSNSTGNKAAGNRKTSSGFKGVRRRPWGKFAAEIRNPFEKKRKWLGTFPTEEEAAEAYQKSKREFDERLGLVKQEKDLVDLTKPCGVRKPEEKEVTEKSNCKKVNKRIVTDQKPFGCGYNADHEEEGVISKMLEDPLMTSSIADIFGDSAVEANDIWVDYNSVEFISIVDDFKFDFVENDRVGKEKTFGFKIGDHTKVNQHAKIVSTNGDLFVDDLLDFDPLIDDFKLEDFPMDDLGLLGDPEDDDFSWFNGTTDWIDKFL

SEQ ID NO: 1395 - DNA, 739 bp, Arabidopsis thaliana
  G2136,family:MADS
acaaaaatctcttgttcttcttgtcttcaatatggaggatggggaagcttcaacaatcactttcttaccaaccacggaaccaaaacccctacaaaaccctaacttgctggccaaaccaaaaaaagagactaaacaaaaaaaacctaaaaccaccaaaggtcgacagaagatagagatcaaggagatcatgctggagacccgaaggcaagtgacgttttccaaacgacgatccgggcttttcaaaaaagcggcagaattaagcgttctctgcggcgcacagattggtatcataacgttttcacgttgcgataggatctactcgtttggtaacgtgaactcactcatcgataaatacttgcgtaaggctccggtgatgctgaggtcacatcccggtggtaacgtggcaaacggagaggaagataacgacggtttgatgtggtgggagagagcggtggagagtgtgccggaggagcatatggaagagtacaagaatgccttgagtgtgttaagggagaatttgttgacgaggatctaccagatgagtggtgatcggacggttgagaatcttccggcatttccaaatgagatggctatggctgactggaaattaacgaatgaaaatctgatggctaggaacgatcgaggttatggaggtaacaatggtgatttggagtttgcgtttatgcctcaaaacggtagacagtgaggtgttttttctttaatttattattacagtttg

SEQ ID NO: 1396 - protein, 224 aa, Arabidopsis thaliana
  G2136,MADS domain coordinates 43-100
MEDGEASTITFLPTTEPKPLQNPNLLAKPKKETKQKKPKTTKGRQKIEIKEIMLETRRQVTFSKRRSGLFKKAAELSVLCGAQIGIITFSRCDRIYSFGNVNSLIDKYLRKAPVMLRSHPGGNVANGEEDNDGLMWWERAVESVPEEHMEEYKNALSVLRENLLTRIYQMSGDRTVENLPAFPNEMAMADWKLTNENLMARNDRGYGGNNGDLEFAFMPQNGRQ

SEQ ID NO: 1397 - DNA, 1225 bp, Arabidopsis thaliana
  G2137,family:WRKY
gggatttgactttagcacttcaaaatccaaagctaaaagacaaaaaagaatagaggttcgatttgcatctccattaatgggcatcgatctttctcttaagctcgaggccgaggagaaaaagaaagagatagaaggatcgaaacatagccgtgagaacaaagaagacgaagaacatgatgctagtggtgatgaagatgaacaaatggtgaaagaagacgaagatgattcttcttctttaggtttaagaacccgagaagaagaaaacgaacgtgaagagctcttgcagctacagatccagatggaaagtgtgaaagaagagaatactaggttgaggaagcttgtcgagcagactcttgaagattatcgtcatcttgagatgaaattcccggttatcgataaaaccaagaagatggatcttgaaatgttccttggagtacaaggcaaacgatgtgtggatataacaagtaaggctcggaaaagaggagctgagagatctccgtcaatggaaagagaaatagggctttcactttctctagagaaaaaacagaaacaagaagagagcaaagaagctgttcagtctcatcaccaaagatacaatagtagcagcttagatatgaatatgccacgtatcatttcatcttctcaaggtaatagaaaggccagggtgtccgtgagggcgagatgtgagaccgcaacaatgaatgatggatgccaatggaggaagtacggtcagaaaaccgcgaaagggaatccatgtcctcgagcttattaccgatgcaccgtggctccaggatgtcccgttagaaaacaggtgcaaaggtgtttagaagacatgtcaatactgataacaacctacgaaggaacacataaccatccacttccggtcggagcaacagccatggcttccactgcctctacttctccattcttgttactcgattccagtgacaacctctctcatccttcctattaccaaactcctcaagccatagactcttctttgattacatacccacaaaatagcagctacaacaatcgaaccataagaagcttgaactttgatggtccatctagaggagatcacgtttcatcttctcaaaaccgattaaattggatgatgtagagtttcctatatctctatgcttgttctttggtcccattatttgtcattatggattctttgcctttcttcttgttctcgtttctaacatttatgtttcgtata

SEQ ID NO: 1398 - protein, 348 aa, Arabidopsis thaliana
  G2137,WRKY domain coordinates 109-168
MGIDLSLKLEAEEKKKEIEGSKHSRENKEDEEHDASGDEDEQMVKEDEDDSSSLGLRTREEENEREELLQLQIQMESVKEENTRLRKLVEQTLEDYRHLEMKFPVIDKTKKMDLEMFLGVQGKRCVDITSKARKRGAERSPSMEREIGLSLSLEKKQKQEESKEAVQSHHQRYNSSSLDMNMPRIISSSQGNRKARVSVRARCETATMNDGCQWRKYGQKTAKGNPCPRAYYRCTVAPGCPVRKQVQRCLEDMSILITTYEGTHNHPLPVGATAMASTASTSPFLLLDSSDNLSHPSYYQTPQAIDSSLITYPQNSSYNNRTIRSLNFDGPSRGDHVSSSQNRLNWMM

SEQ ID NO: 1399 - DNA, 539 bp, Arabidopsis thaliana
  G2138,family:AP2
ggaaccctaatttccgcaaattcactatgaagcgtattatcagaatctcattcaccgacgcagaagccaccgattcttctagcgacgaagacacggaggagcgtggaggagcatcccagactcggcgccgtgggaaacgcctcgttaaagagatcgtaatcgatccttccgattccgccgataaactcgatgtctgcaaaacacggttcaaaatcaggatcccggcggaatttctcaagacggcgaaaacggagaagaaatatcgtggagtgaggcagaggccgtgggggaagtgggtggcggagatcagatgtggaagaggagcttgtaaaggacgacgtgatcgtctctggctgggtacttttaacactgctgaggaagctgctctagcttatgataacgcttcaattaagctgattggacctcacgcgccgaccaattttggtttgccggcggagaatcaagaggataagacggtgattggagcttctgaggttgctagaggcgcgtgaagtggggttggtaatttagttgttagc

SEQ ID NO: 1400 - protein, 161 aa, Arabidopsis thaliana
  G2138,AP2 domain coordinates 76-148
MKRIIRISFTDAEATDSSSDEDTEERGGASQTRRRGKRLVKEIVIDPSDSADKLDVCKTRFKIRIPAEFLKTAKTEKKYRGVRQRPWGKWVAEIRCGRGACKGRRDRLWLGTFNTAEEAALAYDNASIKLIGPHAPTNFGLPAENQEDKTVIGASEVARGA

SEQ ID NO: 1401 - DNA, 1514 bp, Arabidopsis thaliana
  G2140,family:HLH/MYC
actctcttaactttcgtttcttctcctaccttcttttaccaacctttcctttctcttacacacatatatatatacatatatagagagagagaagaggacaaagagttgaaagatgaagactctcatgtcttcatagaaacaagtgatatgtgcgctaagaaagaagaagaagaagaagaagaagaagacagttctgaagccatgaacaacatacaaaattaccaaaatgacctcttctttcaccaactcatctctcatcatcaccatcatcatcatgatccttctcaatctgaaactttgggagcatccggtaacgttggatctggtttcactatcttctctcaagattccgtctctccaatatggtctctacctccacctacctcgatccaaccaccatttgatcagtttcctcctccttcttcttctccagcatctttctacggaagtttcttcaacagaagtcgagctcatcatcagggattacagtttgggtacgagggttttggtggagccacgtcagcagcacatcatcatcatgaacaacttcggatcttgtcggaagctttaggtccggtagtacaagccgggtccggtccttttgggttacaagctgagttagggaagatgacagcacaagagatcatggacgctaaagctttggctgcttcaaagagtcatagtgaagctgagagaagaagaagagagagaatcaataatcatctcgctaagctccgtagcatattacccaacaccaccaaaacggataaagcgtcgttactagctgaagtgatccaacatgtgaaagagttgaagagagagacttcagtgatctcagagacaaatcttgtcccaacggaaagcgatgagttaacggtagctttcacggaggaggaagaaaccggagatggcagatttgtaattaaagcgtcgctttgctgtgaagacaggtcggatctcttgcctgacatgattaaaacattgaaagctatgcgtctcaaaacgctcaaggcggagataaccaccgttgggggacgagtcaagaacgttttgtttgttaccggagaagagagctccggtgaggaagtggaggaagagtactgtatagggacgattgaggaagctttgaaagcggtgatggagaagagcaatgtagaggaatcatcttcttctggaaatgctaagagacagagaatgagtagtcacaacactatcactatcgtcgaacaacaacaacaatataatcagaggtaatcaattttttacttaaatcgcttttttttcttactttcggtgtatctactacgtgtgttgtttgctggttatggaaatgaatgttgtacgtcacgttatactatagatatatgtgtgtttgtgtgtatgtataacggaagtatttgtatccgttgtggtcttggacttttggtttggttctaagatacttatttttaaaaacttgtatcgttgagttggttttctagatatgcttaatgggagtatgtgacgaaaaaaaa

SEQ ID NO: 1402 - protein, 368 aa, Arabidopsis thaliana
  G2140,HLH/MYC domain coordinates 170-227
MCAKKEEEEEEEEDSSEAMNNIQNYQNDLFFHQLISHHHHHHHDPSQSETLGASGNVGSGFTIFSQDSVSPIWSLPPPTSIQPPFDQFPPPSSSPASFYGSFFNRSRAHHQGLQFGYEGFGGATSAAHHHHEQLRILSEALGPVVQAGSGPFGLQAELGKMTAQEIMDAKALAASKSHSEAERRRRERINNHLAKLRSILPNTTKTDKASLLAEVIQHVKELKRETSVISETNLVPTESDELTVAFTEEEETGDGRFVIKASLCCEDRSDLLPDMIKTLKAMRLKTLKAEITTVGGRVKNVLFVTGEESSGEEVEEEYCIGTIEEALKAVMEKSNVEESSSSGNAKRQRMSSHNTITIVEQQQQYNQR

SEQ ID NO: 1403 - DNA, 1523 bp, Arabidopsis thaliana
  G2141,family:HLH/MYC
cttctgattagtgagtggtgttcatcaagtattagaagaagatggatttaagtgcgaaagatgagttttcagcagagaagaggaatcctgataactatgattctgttaataatccgtctggagattggcgagttgattcatatccttcagagaatctgatttcagctggtcctgcgtcttgttctccttctcagatgatggattcatttgggcaaactctttggtatgatcccacgagtgttcaggctgttggttatgccggttttaatggtggtaatgcttcgtcttcttcgtttaggggtagtattgatagatctcttgaaatgggttggaatctgcctaatttgttgcctcctaaaggcaatggtcttttcttaccgaatgcgagtagtttccttcctccgagtatggctcagttcccggctgattcaggttttatagagcgtgcagcgaggttttcgctctttagcggtgggaattttagtgatatggtgaatcaaccacttgggaattctgaggctattggtttgtttcttcaaggtggtggaacaatgcaagggcagtgtcaaagtaatgaacttaatgttggtgaacctcacaatgatgtatctgtagcagtgaaagaatcaactgttagatctagtgaacaagctaaaccgaatgttcctggatcgggcaatgtatccgaggatactcagtctagtggtggtaatggtcagaaaggcagagaaacctcttccaacacaaagaagaggaaaagaaatgggcagaagaactctgaagcagctcaatcacacagatcccagcagtctgaggaagaaccagacaacaatggtgatgaaaagcgcaatgatgagcaaagtccaaattcacctggaaagaagtcaaacagtgggaaacaacagggcaaacaaagttctgatcctccaaaagatggatatattcatgtacgggcacgaagaggccaggccacaaatagccatagtcttgcagaaagagttaggagagaaaaaattagtgaaaggatgaagtttcttcaagatctagtaccgggttgcaacaaggtgactgggaaggcagttatgcttgacgaaatcataaactacgtacaatcactacaacgccaagttgagtttttatcgatgaaacttgcaactgtgaacccacaaatggactttaaccttgaaggtcttcttgcaaaagatgcacttcaactacgagctggttcttcatctacaacaccattcccaccaaatatgtcaatggcttatcctcctctacctcatggattcatgcaacaaactctttccagcattggaaggaccattacctctccattgtctcctatgaatggtggattcaagcgacaggaaacaaatggatgggagggtgatttgcaaaatgtgatccacattaactatggagctggtgatgtcacacctgaccctcaagcagcagctacagcatctcttccagctgcaaatatgaaggttgagccatgatatttcgtcctgttagatagc

SEQ ID NO: 1404 - protein, 486 aa, Arabidopsis thaliana
  G2141,HLH/MYC domain coordinates 306-364
MDLSAKDEFSAEKRNPDNYDSVNNPSGDWRVDSYPSENLISAGPASCSPSQMMDSFGQTLWYDPTSVQAVGYAGFNGGNASSSSFRGSIDRSLEMGWNLPNLLPPKGNGLFLPNASSFLPPSMAQFPADSGFIERAARFSLFSGGNFSDMVNQPLGNSEAIGLFLQGGGTMQGQCQSNELNVGEPHNDVSVAVKESTVRSSEQAKPNVPGSGNVSEDTQSSGGNGQKGRETSSNTKKRKRNGQKNSEAAQSHRSQQSEEEPDNNGDEKRNDEQSPNSPGKKSNSGKQQGKQSSDPPKDGYIHVRARRGQATNSHSLAERVRREKISERMKFLQDLVPGCNKVTGKAVMLDEIINYVQSLQRQVEFLSMKLATVNPQMDFNLEGLLAKDALQLRAGSSSTTPFPPNMSMAYPPLPHGFMQQTLSSIGRTITSPLSPMNGGFKRQETNGWEGDLQNVIHINYGAGDVTPDPQAAATASLPAANMKVEP

SEQ ID NO: 1405 - DNA, 1071 bp, Arabidopsis thaliana
  G2142,family:HLH/MYC
tcgacggcaaaagttgaaaataaaacaataaacagtcgaaattctccggcgaagatgagaaccggaaaaggaaatcaagaggaagaagattacggagaagaagactttaactctaaacgtgaaggtccttcttccaacactactgttcatagcaacagagattcaaaggaaaatgataaagctagtgcgatacgttctaaacattcggtcactgagcaacgtagaagaagcaaaatcaatgaaagatttcagatattgagagaactaattcccaacagtgaacaaaaacgtgacactgcttcattccttttagaggtgatagattatgttcagtatttacaagagaaggtgcaaaagtatgaaggatcgtatccaggttggagtcaggaaccaacaaagttgacgccatggaggaataatcattggcgagttcaaagtttggggaaccacccagtagctataaataatggatctggtccagggataccttttcctggaaagtttgaagacaacactgtgacttcgacacctgcaattattgcagaaccgcaaatcccgattgaatctgacaaagcaagagctataaccggcatatcgattgaaagtcaacctgagttagacgacaaaggattaccaccactacaaccaattcttccaatggtacaaggcgaacaagctaatgaatgtcctgcaactagtgatgggctaggccaaagtaatgacctggttattgaaggtggaaccattagcatctctagtgcctactcgcatgagttattgagctcattaacacaagcactccagaatgcaggcattgatctgtcgcaagcaaagctttctgtgcagatcgatcttgggaagcgagccaatcaaggtctaactcatgaagagccatcaagtaagaatccattatcatatgatacgcaaggaagggattcaagcgttgaggaagaatctgaacattctcacaagcggatgaaaacactgtgacatttctctctcaggctccacggcgctggaatatataaatgtattgacagattccttgtatcgtgtacattgttcggcttc

SEQ ID NO: 1406 - protein, 311 aa, Arabidopsis thaliana
  G2142,HLH/MYC domain coordinates 42-100
MRTGKGNQEEEDYGEEDFNSKREGPSSNTTVHSNRDSKENDKASAIRSKHSVTEQRRRSKINERFQILRELIPNSEQKRDTASFLLEVIDYVQYLQEKVQKYEGSYPGWSQEPTKLTPWRNNHWRVQSLGNHPVAINNGSGPGIPFPGKFEDNTVTSTPAIIAEPQIPIESDKARAITGISIESQPELDDKGLPPLQPILPMVQGEQANECPATSDGLGQSNDLVIEGGTISISSAYSHELLSSLTQALQNAGIDLSQAKLSVQIDLGKRANQGLTHEEPSSKNPLSYDTQGRDSSVEEESEHSHKRMKTL

SEQ ID NO: 1407 - DNA, 1024 bp, Arabidopsis thaliana
  G2143,family:HLH/MYC
tcttcttcttcctccataccttatctcaccagcttctccatatctctcaaagaaaaaacaaaccctataaattccacaaaaaaggaggatggataactccgacattctaatgaacatgatgatgcagcagatggagaagcttcctgaacacttctctaactcaaaccctaaccctaatccccataacattatgatgctttctgaatccaacacccacccgttcttcttcaaccccactcattctcatctcccatttgaccaaaccatgcctcaccaccaacccggtttaaatttccggtacgccccctccccgtcatcatctctcccggagaagagaggaggctgcagcgacaacgccaacatggcggcgatgagagagatgatctttcgaatagccgtgatgcagcctatacatattgatccggaatccgtaaagccaccaaagagaaagaacgtgaggatctctaaggatccacagagcgtggcagctcggcatcgaagggagaggataagcgagcggattcggattcttcagcggcttgttcccggtgggactaagatggatacggcgtcgatgctcgatgaggctatccattacgttaagtttctcaagaagcaagtgcagtcgctggaggaacatgcggtggttaacggcggaggaatgacggcggtggccggaggagcacttgcgggtactgttggtggaggatatggaggaaaagggtgtggcattatgcggtctgatcatcaccagatgcttggaaatgcacagattcttagatgatgatgatgttgatttttaaatatatatcatatgtttattaatatgacgggaaaaaatattatcgagggagttgaatttagtatcatgaaactatgagagcattttttttaaatgtttttatctttccgggtttcgataatgtttgggatggttaattaacaatttaaaagtcagacaacttggttgtaaagactaaagaataagcatagtttatcaatttatcattactaaatgaaatag

SEQ ID NO: 1408 - protein, 231 aa, Arabidopsis thaliana
  G2143,HLH/MYC domain coordinates 122-179
MDNSDILMNMMMQQMEKLPEHFSNSNPNPNPHNIMMLSESNTHPFFFNPTHSHLPFDQTMPHHQPGLNFRYAPSPSSSLPEKRGGCSDNANMAAMREMIFRIAVMQPIHIDPESVKPPKRKNVRISKDPQSVAARHRRERISERIRILQRLVPGGTKMDTASMLDEAIHYVKFLKKQVQSLEEHAVVNGGGMTAVAGGALAGTVGGGYGGKGCGIMRSDHHQMLGNAQILR

SEQ ID NO: 1409 - DNA, 1456 bp, Arabidopsis thaliana
  G2144,family:HLH/MYC
attagggttttgttgtcgtgagatttgattacacaaattgctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactggtatgattgtttcttattcttgtaccagatttcgacaatgtagaatttagtaggatatgatcattttgatctcgttatatata

SEQ ID NO: 1410 - protein, 379 aa, Arabidopsis thaliana
  G2144,HLH/MYC domain coordinates 207-265
MDLTGGFGARSGGVGPCREPIGLESLHLGDEFRQLVTTLPPENPGGSFTALLELPPTQAVELLHFTDSSSSQQAAVTGIGGEIPPPLHSFGGTLAFPSNSVLMERAARFSVIATEQQNGNISGETPTSSVPSNSSANLDRVKTEPAETDSSQRLISDSAIENQIPCPNQNNRNGKRKDFEKKGKSSTKKNKSSEENEKLPYVHVRARRGQATDSHSLAERARREKINARMKLLQELVPGCDKIQGTALVLDEIINHVQSLQRQVEMLSMRLAAVNPRIDFNLDTILASENGSLMDGSFNAAPMQLAWPQQAIETEQSFHHRQLQQPPTQQWPFDGLNQPVWGREEDQAHGNDNSNLMAVSENVMVASANLHPNQVKMEL

SEQ ID NO: 1411 - DNA, 777 bp, Arabidopsis thaliana
  G2145,family:HLH/MYC
atggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcggaaacgaagagagaagattaacgaaaggctcaagacactacaaaaccttgtgccaaacgggacaaaagtcgatataagcacgatgcttgaagaagcggtccattacgtgaagttcttgcagcttcagattaagttgttgagctcggatgatctatggatgtacgcaccattggcttacaacggcctggacatggggttccatcacaaccttttgtctcggcttatgtga

SEQ ID NO: 1412 - protein, 258 aa, Arabidopsis thaliana
  G2145,HLH/MYC domain coordinates 170-227
MDVFVDGELESLLGMFNFDQCSSSKEERPRDELLGLSSLYNGHLHQHQHHNNVLSSDHHAFLLPDMFPFGAMPGGNLPAMLDSWDQSHHLQETSSLKRKLLDVENLCKTNSNCDVTRQELAKSKKKQRVSSESNTVDESNTNWVDGQSLSNSSDDEKASVTSVKGKTRATKGTATDPQSLYARKRREKINERLKTLQNLVPNGTKVDISTMLEEAVHYVKFLQLQIKLLSSDDLWMYAPLAYNGLDMGFHHNLLSRLM

SEQ ID NO: 1413 - DNA, 958 bp, Arabidopsis thaliana
  G2146,family:HLH/MYC
attagatatcccctccaattactcaaaattattatcaaaataagaaagagctcaacattgttctctgactctataaataactgttcttggaaattttccaagagaacaagaaacaaaaacaaaacgttgtttaagtgtggttctatagatttcttgtgaatgtcttctgaacaaggaaatggatcgaatccttccacgtcaccggaggtagaagggactaaaacaatcccctttcgccggagattgcaaagaggacaaagagttttcgctccaaagctgatggaggctctacgtcgatcaagggtaagctctgaagaagctccggtaaggcatcttagtcgtagatggagagccacaacggcgcagaaggtatattccctaaagctctacgacgctcttcaacgatcgcggcggagcgcaacagtccgggacacggccgacaaagtccttgcgacgaccgctcgtggtgcaactcggtggagccgagccattttggttagtcgattcggaacgagtctgaggcggcgtaggaataccaaaccggcgtcggcattagctgcggcgatcaggggaagtggtggaagtgggaggaggaggaagttatcggcggtgggaaatcgggtccgggttttgggtgggttggtgccgggttgccggagaacggcgttaccggagcttttggacgagacagcagattacatagcggctttggaaatgcaagtccgagccatgacagctctatcaaagattctgtcggagcttcagccgtctactaatctcggctcggctttatagccgagtgtataagccgatgaatttgtttcaattaattcttttacgattttatcgtgggaatgtcttattgtttttaatgatttgtttgccctggaaaaaaaaaattgtcaaaatcatcacgagttggacgaaaatactatgtttttctaaaaaccttataata

SEQ ID NO: 1414 - protein, 211 aa, Arabidopsis thaliana
  G2146,HLH/MYC domain coordinates 132-189
MSSEQGNGSNPSTSPEVEGTKTIPFRRRLQRGQRVFAPKLMEALRRSRVSSEEAPVRHLSRRWRATTAQKVYSLKLYDALQRSRRSATVRDTADKVLATTARGATRWSRAILVSRFGTSLRRRRNTKPASALAAAIRGSGGSGRRRKLSAVGNRVRVLGGLVPGCRRTALPELLDETADYIAALEMQVRAMTALSKILSELQPSTNLGSAL

SEQ ID NO: 1415 - DNA, 1366 bp, Arabidopsis thaliana
  G2147,family:HLH/MYC
ctgtgattgtcaagagtttgaacacacaaagaagaaagaagaactcaacatttcaagcaagaagaaagagagaagagagaaggtccaataatagagagaacaaaaaaaaagagagcttaattgtcagtttattctctgcaaacgtgcggcctaagtaacacatgtcgaattatggagttaaagagctcacatgggaaaatgggcaactaaccgttcatggtctaggcgacgaagtagaaccaaccacctcgaataaccctatttggactcaaagtctcaacggttgtgagactttggagtctgtggttcatcaagcggctctacagcagccaagcaagtttcagctgcagagtccgaatggtccaaaccacaattatgagagcaaggatggatcttgttcaagaaaacgcggttatcctcaagaaatggaccgatggttcgctgttcaagaggagagccatagagttggccacagcgtcactgcaagtgcgagtggtaccaatatgtcttgggcgtcttttgaatccggtcggagcttgaagacagctagaaccggagacagagactatttccgctctggatcggaaactcaagatactgaaggagatgaacaagagacaagaggagaagcaggtagatctaatggacgacggggacgagcagcagcgattcacaacgagtccgaaaggagacggcgtgataggataaaccagaggatgagaacacttcagaagctgcttcctactgcaagtaaggcggataaagtctcaatcttggatgatgttatcgaacacttgaaacagctacaagcacaagtacagttcatgagcctaagagccaacttgccacaacaaatgatgattccgcaactacctccaccacagtcagttctcagcatccaacaccaacaacaacaacaacaacagcagcagcagcagcaacaacagcagcaacagtttcagatgtcgttgcttgcaacaatggcaagaatgggaatgggaggtggtggaaatggttatggaggtttagttcctcctcctcctcctccaccaatgatggtccctcctatgggtaacagagactgcaccaacggttcttcagccacattatctgatccatacagcgcctttttcgcacagacaatgaatatggatctctacaataaaatggcagcagctatctatagacaacagtctgatcaaacaacaaaggtaaatatcggcatgccttcaagttcttcgaatcatgagaaaagagattagtctagcgacctagtattattgatccatatatatagttcttgaaagattgttgtatcatgattgtaaaaactgttttgagtatggaaaaagacttgcagataaaa

SEQ ID NO: 1416 - protein, 366 aa, Arabidopsis thaliana
  G2147,HLH/MYC domain coordinates 163-220
MSNYGVKELTWENGQLTVHGLGDEVEPTTSNNPIWTQSLNGCETLESVVHQAALQQPSKFQLQSPNGPNHNYESKDGSCSRKRGYPQEMDRWFAVQEESHRVGHSVTASASGTNMSWASFESGRSLKTARTGDRDYFRSGSETQDTEGDEQETRGEAGRSNGRRGRAAAIHNESERRRRDRINQRMRTLQKLLPTASKADKVSILDDVIEHLKQLQAQVQFMSLRANLPQQMMIPQLPPPQSVLSIQHQQQQQQQQQQQQQQQQQFQMSLLATMARMGMGGGGNGYGGLVPPPPPPPMMVPPMGNRDCTNGSSATLSDPYSAFFAQTMNMDLYNKMAAAIYRQQSDQTTKVNIGMPSSSSNHEKRD

SEQ ID NO: 1417 - DNA, 1466 bp, Arabidopsis thaliana
  G2150,family:HLH/MYC
gttttgtttttgaagaaacacacataaagtttgtctttttacttctcaaatttggttgttttcactcaatttcaatcttgctttctgattcagattctgggttttcttcagaattcccagagaagttgttggaattgaatttttcacttttttgttcataaaagttctagtctttttagatgaacatggacaaggaaacagagcaaaccctaaattacttacctttgggtcagagcgatccctttggcaatggcaatgaaggaacaattggagatttccttggaagatactgcaacaaccctcaggagatttcaccgttaactctacaatccttctctctgaattctcagatctccgagaatttcccaatctctggtggaatcagattccctccatatccaggtcaatttggatccgatcgtgaatttgggtcacaaccaacaacgcaggagagtaacaagagctctttgttggatccagattcagtttcggatcgagttcacaccacgaaatctaactctagaaagaggaagtcgattcctagtggtaatggcaaggagtctccagcttcatcgtctcttacagcttccaattcaaaggtttcaggagagaatggtggatctaaaggtgggaagagaagcaagcaagatgtagctgggagtagtaaaaacggagtagagaagtgcgatagtaaaggcgacaataaggacgatgctaagcctcctgaggcgcctaaagattatattcatgtcagagctagaaggggtcaagcaactgatagccatagtcttgctgaaagagcaagaagagaaaagattagtgagagaatgacgttgcttcaggatctggttcctggttgcaaccggattacagggaaagcagtcatgcttgatgaaattataaattatgtgcagtccttgcagagacaagttgagttcttgtccatgaagctggctaccgtaaatccaaggatggagtttaatgctaatgcttctttatccacagagatgattcaaccgggggagtcgttaacgcagtctctttacgcaatggcttgctcagagcaaagacttccatcagcatactattcacttggcaagaacatgccaagattctcagacacacaattcccctcaaacgatggatttgttcacactgagacaccaggattctgggaaaataatgacctgcaaagcattgttcagatgggttttggagatatcctccagcaacagagcaacaacaacaacaacaactgttctgagccaacgcttcagatgaagcttgaaccatagtccatagctatgattattatctctgttgtacatacagaaaaccaagtagtgatgagtaacggagtgaatcatattggaattttaatgtttacaatcgttgcttctttgcttgtgtctctgttgatttcttctcaaccttaaacaaaaaaaaaacaagaaaacttcagatta

SEQ ID NO: 1418 - protein, 371 aa, Arabidopsis thaliana
  G2150,HLH/MYC domain coordinates 194-252
MNMDKETEQTLNYLPLGQSDPFGNGNEGTIGDFLGRYCNNPQEISPLTLQSFSLNSQISENFPISGGIRFPPYPGQFGSDREFGSQPTTQESNKSSLLDPDSVSDRVHTTKSNSRKRKSIPSGNGKESPASSSLTASNSKVSGENGGSKGGKRSKQDVAGSSKNGVEKCDSKGDNKDDAKPPEAPKDYIHVRARRGQATDSHSLAERARREKISERMTLLQDLVPGCNRITGKAVMLDEIINYVQSLQRQVEFLSMKLATVNPRMEFNANASLSTEMIQPGESLTQSLYAMACSEQRLPSAYYSLGKNMPRFSDTQFPSNDGFVHTETPGFWENNDLQSIVQMGFGDILQQQSNNNNNNCSEPTLQMKLEP

SEQ ID NO: 1419 - DNA, 1383 bp, Arabidopsis thaliana
  G2153,family:AT-hook
ttcttgcttagtatcattctttgtcgtgttcttttaattaaccttttgcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgatgaaaaccagtcagttgctacttgttactagtgagctatatagtttgtggacattatattatgttctctcttgactatgattattatttgctaaatttcacttagctaaaaaaaaaaaaaaaaaa

SEQ ID NO: 1420 - protein, 315 aa, Arabidopsis thaliana
  G2153,At-hook amino acids 80-88,2nd cons. domain 88-239,DUF296 107-232
MANPWWTGQVNLSGLETTPPGSSQLKKPDLHISMNMAMDSGHNNHHHHQEVDNNNNDDDRDNLSGDDHEPREGAVEAPTRRPRGRPAGSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEEEEAAERGGGGGSGGVVPGQLGGGGSPLSSGAGGGDGNQGLPVYNMPGNLVSNGGSGGGGQMSGQEAYGWAQARSGF

SEQ ID NO: 1421 - DNA, 1050 bp, Arabidopsis thaliana
  G2155,family:AT-hook
ctcatatataccaaccaaacctctctctgcatctttattaacacaaaattccaaaagattaaatgttgtcgaagctccctacacagcgacacttgcacctctctccctcctctccctccatggaaaccgtcgggcgtccacgtggcagacctcgaggttccaaaaacaaacctaaagctccaatctttgtcaccattgaccctcctatgagtccttacatcctcgaagtgccatccggaaacgatgtcgttgaagccctaaaccgtttctgccgcggtaaagccatcggcttttgcgtcctcagtggctcaggctccgttgctgatgtcactttgcgtcagccttctccggcagctcctggctcaaccattactttccacggaaagttcgatcttctctctgtctccgccactttcctccctcctctacctcctacctccttgtcccctcccgtctccaatttcttcaccgtctctctcgccggacctcaggggaaagtcatcggtggattcgtcgctggtcctctcgttgccgccggaactgtttacttcgtcgccactagtttcaagaacccttcctatcaccggttacctgctacggaggaagagcaaagaaactcggcggaaggggaagaggagggacaatcgccgccggtctctggaggtggtggagagtcgatgtacgtgggtggctctgatgtcatttgggatcccaacgccaaagctccatcgccgtactgaccacaaatccatctcgttcaaactagggtttcttcttctttagatcatcaagaatcaacaaaaagattgcatttttagattctttgtaatatcataattgactcactctttaatctctctatcacttcttctttagctttttctgcagtgtcaaacttcacatatttgtagtttgatttgactatccccaagttttgtattttatcatacaaatttttgcctgtctctaatggttgttttttcgtttgtataatcttatgcattgtttattggagctccagagattgaatgtataatataatggtttaat

SEQ ID NO: 1422 - protein, 225 aa, Arabidopsis thaliana
  G2155,amino acids At-hook 24-32,2nd domain 32-180, DUF296 49-173
MLSKLPTQRHLHLSPSSPSMETVGRPRGRPRGSKNKPKAPIFVTIDPPMSPYILEVPSGNDVVEALNRFCRGKAIGFCVLSGSGSVADVTLRQPSPAAPGSTITFHGKFDLLSVSATFLPPLPPTSLSPPVSNFFTVSLAGPQGKVIGGFVAGPLVAAGTVYFVATSFKNPSYHRLPATEEEQRNSAEGEEEGQSPPVSGGGGESMYVGGSDVIWDPNAKAPSPY

SEQ ID NO: 1423 - DNA, 1361 bp, Arabidopsis thaliana
  G2156,family:AT-hook
ttttttttccctttcctcgttcaaaaaaagtacttgcagagtcactcactctcagtctcagcacatgaattaatttgaagcttccctagaattctttcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttcatttctcaaaattaaaagaaaaaaaaaa

SEQ ID NO: 1424 - protein, 302 aa, Arabidopsis thaliana
  G2156,At-hook amino acids 72-80,2nd cons. domain 80-232,DUF296 99-225
MDGGYDQSGGASRYFHNLFRPELHHQLQPQPQLHPLPQPQPQPQPQQQNSDDESDSNKDPGSDPVTSGSTGKRPRGRPPGSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLEDEGGEGGEGGEVGEGGGGEGGPPPATSSSPPSGAGQGQLRGNMSGYDQFAGDPHLLGWGAAAAAAPPRPAF

SEQ ID NO: 1425 - DNA, 1496 bp, Arabidopsis thaliana
  G2157,family:AT-hook
tcttttgattttaaccttttttcagtagcaagccaaaaaaaaaaaacagacaaagaagttccttttatgataaaggtatgatgatagcaaacaaatgatacccccatgtcttgtgtgtctgcttcatgcaacatgttggtttggatttggttaatctaaaagtttaagataaggttttcggattctcttcctgtcttgtaatagtttcttgtcggagagccatcaacaccaacttcaacaaaaaaaacaagaaaaagaaaaagattctctttctcgttttatttccattagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaattgattgtagaatcgtcttttgaattttgatgttggaaaaaaccaa

SEQ ID NO: 1426 - protein, 310 aa, Arabidopsis thaliana
  G2157,amino acids 88-96,2nd cons. domain 96-240,DUF296 115-223
MANPWWVGNVAIGGVESPVTSSAPSLHHRNSNNNNPPTMTRSDPRLDHDFTTNNSGSPNTQTQSQEEQNSRDEQPAVEPGSGSGSTGRRPRGRPPGSKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEEEQQQEQPLQLEDGKKQKEENDDNESGNNGNEGSMQPPMYNMPPNFIPNGHQMAQHDVYWGGPPPRAPPSY

SEQ ID NO: 1427 - DNA, 1674 bp, Arabidopsis thaliana
  G2184,family:NAC
atggcggattcttcacccgattcgtgtttcaaaggaggcaaatttagtgctccagggtttcgatttcatccaactgatgaagagcttgtgatgtattatttgaagaggaagatttgtaggaagaggcttagagttaatgttatcggtgttgttgatgtttacaaaatggatcctgaggaattgcctggtcaatcaatgttgaagacgggagatagacagtggttctatttcactccaaggagtaggaagtatccaaacgcagctaggtctaatagaggaactgaaaatgggtattggaaggctacagggaaggatcgagtcattgagtataattctagatcggtgggacttaaaaagactcttgttttctatagaggccgggctcctagtggtgagcggactgattgggtgatgcatgagtatacgatggatgaagatgaactagggagatgtaagaaccctcaggagtactatgctctttataagttgttcaagaaaagtggggctggtcctaagaatggtgaacagtatggtgctccgtttcaagaagaggaatgggttgatgatgataatgaagatgtgaatgctattgctgtagctgtgccagagcaacctgtggttcgttatgaggatgctcgtcgtgtggatgagaggagactttttaatcctgttattcttcagttagaggatatcgatgagcttctcaatggaatccctaatgcacctggtgttcctcaaagatgtattcctcaggtgaatagtgaagaagagctgcagagtacgttggtgaataattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcaggtagaagtcttctcttgaaagactag

SEQ ID NO: 1428 - protein, 557 aa, Arabidopsis thaliana
  G2184,NAC domain coordinates 17-147
MADSSPDSCFKGGKFSAPGFRFHPTDEELVMYYLKRKICRKRLRVNVIGVVDVYKMDPEELPGQSMLKTGDRQWFYFTPRSRKYPNAARSNRGTENGYWKATGKDRVIEYNSRSVGLKKTLVFYRGRAPSGERTDWVMHEYTMDEDELGRCKNPQEYYALYKLFKKSGAGPKNGEQYGAPFQEEEWVDDDNEDVNAIAVAVPEQPVVRYEDARRVDERRLFNPVILQLEDIDELLNGIPNAPGVPQRCIPQVNSEEELQSTLVNNSAREFLPNGQQYNRPSSFDSLETAEVTSAPLVFEKEDFIEMDDLLLIPEFGASSTEKAAQFSNHGEFDDFNEFDQLFHDVSMSLDMEPIDQGTSANLSSLSDSANYTSDQKQQLLYQQFQDQTPENQLNNIMDPSTTLNQITSDIWFEDDQAILFDQQQSFSGAFASPSSGVMPDSTNPTMSVNAQGHEIQNGGGTTSQFSSALWALMDSIPSTPASACEGPLNRTFVRMSSFSRMRFNGKANGTPVSTTIAKKGIRNRGFLLLSIVGALCAIFWVLVATVRVSGRSLLLKD

SEQ ID NO: 1429 - DNA, 3004 bp, Arabidopsis thaliana
  G2192,family:bZIP-NIN
cggaaagagatcaaccaacgatagaggagaagaagaacttgcatacgcaaaaaaactttcccgggaaaattccagaaactgctttggaaaaatgtgcgagcccgatgataattccgctagaaacggcgtcactactcaaccttcgaggtcaagggagcttctaatggatgttgacgacttagatcttgacggttcatggccactagatcaaatcccttacttatcctcatcgaatcgcatgatttctccgatttttgtctcctcttcctctgagcagccttgctcgcctctctgggctttctccgacggtggaggaaatggttttcaccacgcaacctccggtggcgatgatgagaagatcagctctgtctccggtgttccttctttccgtctcgccgagtatcctctcttcctcccttactcttctccatcagcagctgagaacacaacagagaagcataacagtttccagtttccgtctccattgatgagcctagtcccaccagagaacacagacaactactgtgtgatcaaagagaggatgactcaggcgcttcgatacttcaaagaatcaaccgaacaacacgttttggctcaggtctgggctcctgtgagaaagaatggtcgtgatttgctgacgactttgggtcaaccttttgttcttaatcctaatggtaatgggcttaatcaatacaggatgatctctctcacatatatgttttctgtggatagtgaaagtgacgtagagctcggactcccgggtcgagttttccgtcagaaattgcctgaatggactccaaatgttcagtactattccagcaaagaattctcgcggcttgatcacgccttgcactacaacgtgcgtggtacactggccttgcctgtctttaatccctctggtcagtcctgcataggtgttgtggaacttataatgacctcagagaagattcactatgcacccgaagtggacaaagtttgcaaagcccttgaggcggtaaatctgaaaagctcggaaatacttgatcaccaaacaacacagatatgcaatgagagtcgccaaaacgcgcttgctgagattctcgaagtgctgacagttgtatgtgagacccataacttgcctctcgctcagacttgggttccatgtcagcatgggagcgttcttgccaatggtggcggtctaaagaaaaactgcaccagctttgacggtagctgcatgggtcaaatctgcatgtctacaaccgacatggcctgctatgtcgtggatgctcatgtctggggctttagagatgcctgtcttgaacaccatctccagaaaggccagggagtcgctggacgagcttttctcaatggtggctcatgtttctgcagagacatcaccaagttctgcaaaacgcagtacccactagtccattatgcgctcatgttcaagttgaccacttgttttgcaatatctctccagagctcttacacgggcgacgacagttacattcttgaattttttcttccttcgagtataacagacgaccaagagcaagatttgctgttgggttctattttggtgacaatgaaagaacattttcagagtctgagggttgcatctggggttgactttggtgaagatgacgacaaattgtctttcgagatcatccaagcattaccggacaagaaggttcattcaaaaatagaatccattcgagttcccttttctggttttaagtcaaatgcaacagagacgatgttgattcctcagcctgtggttcagtcttctgatccagtaaatgagaaaatcaacgtggccactgttaacggtgtggttaaggagaagaagaaaacagagaaaaagcgtgggaagactgagaaaacaatcagtctagatgtacttcagcagtatttcactggaagtctcaaagacgctgcaaagagcctaggagtttgcccgacgacaatgaagcgaatttgcaggcaacacggaatctcgcggtggccatcgaggaagatcaagaaagtgaatcgttcaatcacaaagctgaaacgagtcatcgaatctgttcaaggtactgatggaggcctcgacctgacttccatggccgttagttccatcccttggacacacggtcaaacatcagcacagccactaaactcacccaatggttccaaaccacctgagctaccaaacaccaataattcacctaaccattggtcaagtgatcacagtccgaacgagccaaatggttcgcctgagttaccaccaagcaatggtcacaagcgatcacgaacggtggatgagagcgctgggactccaacctctcatggctcatgtgacggtaaccaattagatgaaccgaaagtcccaaatcaagatccgctcttcacggttggtggatcacccgggctcctttttccaccttattctagagatcatgatgtatctgcagcttccttcgcaatgccgaacaggcttcttggttctatagaccatttccgaggaatgctcattgaagacgctggaagttcaaaagatctgagaaatctctgccccactgcagcatttgacgataagtttcaagacacaaactggatgaacaatgataataatagcaacaacaacttatacgctcccccaaaggaagaggccattgcaaatgttgcatgcgaaccatcaggctcagaaatgagaacggtaacaatcaaagcaagttacaaagacgacataatacggttcagaatatcctcgggttcaggtataatggaattgaaggatgaagtggctaagaggctgaaagttgatgcaggaacgttcgatatcaagtatcttgacgatgataacgaatgggttttaatagcttgtgatgctgatcttcaagaatgtctcgagatccctagatcctcccgcacgaaaatcgtaaggctcttagttcatgatgtaacgacaaatctagggagctcctgcgagagcactggagaattgtgacctgataattcattcgaactcttttgtaaatag

SEQ ID NO: 1430 - protein, 959 aa, Arabidopsis thaliana
  G2192,bZIP-NIN domain coordinates 600-700
MCEPDDNSARNGVTTQPSRSRELLMDVDDLDLDGSWPLDQIPYLSSSNRMISPIFVSSSSEQPCSPLWAFSDGGGNGFHHATSGGDDEKISSVSGVPSFRLAEYPLFLPYSSPSAAENTTEKHNSFQFPSPLMSLVPPENTDNYCVIKERMTQALRYFKESTEQHVLAQVWAPVRKNGRDLLTTLGQPFVLNPNGNGLNQYRMISLTYMFSVDSESDVELGLPGRVFRQKLPEWTPNVQYYSSKEFSRLDHALHYNVRGTLALPVFNPSGQSCIGVVELIMTSEKIHYAPEVDKVCKALEAVNLKSSEILDHQTTQICNESRQNALAEILEVLTVVCETHNLPLAQTWVPCQHGSVLANGGGLKKNCTSFDGSCMGQICMSTTDMACYVVDAHVWGFRDACLEHHLQKGQGVAGRAFLNGGSCFCRDITKFCKTQYPLVHYALMFKLTTCFAISLQSSYTGDDSYILEFFLPSSITDDQEQDLLLGSILVTMKEHFQSLRVASGVDFGEDDDKLSFEIIQALPDKKVHSKIESIRVPFSGFKSNATETMLIPQPVVQSSDPVNEKINVATVNGVVKEKKKTEKKRGKTEKTISLDVLQQYFTGSLKDAAKSLGVCPTTMKRICRQHGISRWPSRKIKKVNRSITKLKRVIESVQGTDGGLDLTSMAVSSIPWTHGQTSAQPLNSPNGSKPPELPNTNNSPNHWSSDHSPNEPNGSPELPPSNGHKRSRTVDESAGTPTSHGSCDGNQLDEPKVPNQDPLFTVGGSPGLLFPPYSRDHDVSAASFAMPNRLLGSIDHFRGMLIEDAGSSKDLRNLCPTAAFDDKFQDTNWMNNDNNSNNNLYAPPKEEAIANVACEPSGSEMRTVTIKASYKDDIIRFRISSGSGIMELKDEVAKRLKVDAGTFDIKYLDDDNEWVLIACDADLQECLEIPRSSRTKIVRLLVHDVTTNLGSSCESTGEL

SEQ ID NO: 1431 - DNA, 2959 bp, Arabidopsis thaliana
  G2207,family:bZIP-NIN
caaaattcatagtaaggtctcgccatgtcccgatgcataaatgagataacgatccacaaaattttcattttaaaaatttcatctttttttgttttcatcttccgtgaagaagtagtaccacataacccccatcagacatctttaaagctttcttcttttccttgtttcttttggttttgagatttgggtttcttttcatatctgttccttctatctcagacaacaaattgcaacagaggaaatttaaaaacccacttgaggaaggaatctttgagaatctctctctgacttatgttgcttcattgattttggagatatatccatggaagatagtttccttcaatctgagaacgtggttatggacgctgacttcatggatggattgttactagatggttgttggttagagactacagatggatctgagtttcttaacatagctccttcaacttcttctgttagcccttttgatccaacttccttcatgtggtctccaactcaagatacatcagctctttgcacatcaggagttgtatctcagatgtatggtcaggattgtgtagaaagatctagtcttgatgagtttcaatggaacaaacgatggtggattggaccaggaggtggtggttcttcggttactgagaggttggttcaagcagttgaacacattaaagattacacaacagcgagaggctcacttattcagttatgggttccggttaatagaggcggtaagcgagttttgaccacaaaggaacaaccttttagccatgatccgttgtgtcaaagacttgcaaactatagagagatctctgtgaattatcacttctctgctgagcaagatgattccaaggctttagctggtttgcctgggagggttttcttggggaagcttcctgaatggactcctgatgttaggtttttcaagagcgaggagtatccgagagtacaccatgctcaggactgcgatgtccgtggaacgctggcgattccggtgtttgaacaaggtagtaagatttgcttgggtgttattgaggttgtaatgaccactgagatggttaaactaagacctgagcttgaaagcatttgcagagcacttcaggcagttgatcttaggagcaccgagcttccgattccaccttctctaaagggatgtgacttatcctacaaagctgccttacctgaaatccgaaacctcttgagatgtgcttgtgagactcataaactacctttagctcagacatgggtttcttgtcaacagcaaaacaaaagcgggtgccgtcacaacgatgagaactacatccattgcgtatcaaccattgatgatgcttgctacgttggtgatccaacagttcgtgagttccatgaagcttgctctgagcatcacctcttgaaaggccaaggagttgcaggtcaagccttcttgaccaatggaccttgcttttcatctgatgtatctaactacaagaaatcagagtaccctctctctcaccatgctaatatgtacggtttacatggcgcggttgcaattcgcctgcggtgcatccacacgggctctgctgatttcgtcttagagttctttttgcctaaagactgcgatgatctggaggaacagaggaaaatgttgaatgctctttcaactattatggctcatgtgcctagaagcttaaggactgttacagacaaagaactagaagaagagagtgaagtgatagagagggaagagatagtaacgccaaagatagaaaacgcatctgaactccacggaaattccccatggaatgcctctcttgaagaaatccagcggagtaataatactagtaatcctcagaatcttggactggtatttgatggaggagacaaaccaaatgatggttttggcttaaaaagaggttttgactacaccatggattctaatgtcaatgagagcagcactttctctagtggtggtttcagtatgatggccgagaaaaagcgtacaaaagcagataaaaccatcactttggatgttcttcgacagtatttcgctgggagcttgaaagatgcagccaagaatatcggtgtttgtccaacgaccttgaagagaatatgcagacagcatggtatacaaagatggccttcaagaaagataaaaaaagtgggacattctctgcagaagatccaacgagtgattgattcggttcaaggtgtttctggtcctcttcccataggctcattctatgcaaatttccccaatttagtctcacagtcacaagaaccatcacaacaagccaagaccacgcctcctcctccgccgccagtgcagcttgcaaagtcccctgtatcctcgtatagtcacagttcaaactctagccaatgttgctccagtgaaacccaactaaacagcggtgcaacaaccgatcctccttcaactgatgtaggaggtgcattgaagaagacgagcagcgaaatcgagcttcaaagctcgagtcttgacgagacaattttgactctctccagtttagaaaacatccctcaaggcaccaacttgttatcatctcaagatgatgactttctgaggattaaagttagctacggagaagagaagatcagattacggatgcggaattcgcgcaggttaagagatctattgtgggagattgggaagcggtttagcatagaggatatgagcaggtatgatctaaagtacttagacgaagacaatgaatgggttttgttgacttgcgacgaagatgtagaagagtgtgtagatgtctgcagaactacaccgagtcataccattaagcttttgcttcaggcttcttctcatcatttccctgaacgttcttcagctactgaatacagtttatggcactgaccttaaatcagagaaagaagaaagaaaaagaagcgttttaggacatgacacaaaagatagtaatacctttgtgttctgttataattgttcataattttatct

SEQ ID NO: 1432 - protein, 844 aa, Arabidopsis thaliana
  G2207,bZIP-NIN domain coordinates 180-227,546-627
MEDSFLQSENVVMDADFMDGLLLDGCWLETTDGSEFLNIAPSTSSVSPFDPTSFMWSPTQDTSALCTSGVVSQMYGQDCVERSSLDEFQWNKRWWIGPGGGGSSVTERLVQAVEHIKDYTTARGSLIQLWVPVNRGGKRVLTTKEQPFSHDPLCQRLANYREISVNYHFSAEQDDSKALAGLPGRVFLGKLPEWTPDVRFFKSEEYPRVHHAQDCDVRGTLAIPVFEQGSKICLGVIEVVMTTEMVKLRPELESICRALQAVDLRSTELPIPPSLKGCDLSYKAALPEIRNLLRCACETHKLPLAQTWVSCQQQNKSGCRHNDENYIHCVSTIDDACYVGDPTVREFHEACSEHHLLKGQGVAGQAFLTNGPCFSSDVSNYKKSEYPLSHHANMYGLHGAVAIRLRCIHTGSADFVLEFFLPKDCDDLEEQRKMLNALSTIMAHVPRSLRTVTDKELEEESEVIEREEIVTPKIENASELHGNSPWNASLEEIQRSNNTSNPQNLGLVFDGGDKPNDGFGLKRGFDYTMDSNVNESSTFSSGGFSMMAEKKRTKADKTITLDVLRQYFAGSLKDAAKNIGVCPTTLKRICRQHGIQRWPSRKIKKVGHSLQKIQRVIDSVQGVSGPLPIGSFYANFPNLVSQSQEPSQQAKTTPPPPPPVQLAKSPVSSYSHSSNSSQCCSSETQLNSGATTDPPSTDVGGALKKTSSEIELQSSSLDETILTLSSLENIPQGTNLLSSQDDDFLRIKVSYGEEKIRLRMRNSRRLRDLLWEIGKRFSIEDMSRYDLKYLDEDNEWVLLTCDEDVEECVDVCRTTPSHTIKLLLQASSHHFPERSSATEYSLWH

SEQ ID NO: 1433 - DNA, 771 bp, Arabidopsis thaliana
  G2213,family:bZIP-NIN
atgagttcgtcaaaacattcctctgtttttaactattctgctctgtttctatcactgtttcttcaacaaatggatcagaactctcttcatcatctcgattctccaaaaatcgaaaacgagtatgaaccagattcgttatacgacatgttagataagttgcctccgcttgattctctcctagatatggaagatttgaaaccaaatgcagggttgcactttcagttccattacaatagctttgaagatttcttcgaaaacattgaagtggataacacaattccatctgatattcacttgttgacacaagagccctacttctcaagtgactcctcttcctcttcaccattggctatccaaaacgacggtctcatttccaacgtgaaagttgaaaaggtaacagttaagaagaagaggaaccttaagaaaaagaggcaagacaaattggagatgtctgagatcaaacaatttttcgataggccgatcatgaaagcggctaaagaactgaacgtgggactcactgtgttgaagaagcgatgcagggaattaggaatttaccggtggcctcaccggaagctcaagagtctaaactctcttataaagaatctcaagaatgttggaatggaagaggaagtgaagaacttggaggaacataggtttcttattgaacaagaacctgatgcagaactcagtgatggaaccaagaagctaaggcaagcttgtttcaaagccaattataagagaagaaaatcacttggtgatgattattattga

SEQ ID NO: 1434 - protein, 256 aa, Arabidopsis thaliana
  G2213,bZIP-NIN domain coordinates 156-205
MSSSKHSSVFNYSALFLSLFLQQMDQNSLHHLDSPKIENEYEPDSLYDMLDKLPPLDSLLDMEDLKPNAGLHFQFHYNSFEDFFENIEVDNTIPSDIHLLTQEPYFSSDSSSSSPLAIQNDGLISNVKVEKVTVKKKRNLKKKRQDKLEMSEIKQFFDRPIMKAAKELNVGLTVLKKRCRELGIYRWPHRKLKSLNSLIKNLKNVGMEEEVKNLEEHRFLIEQEPDAELSDGTKKLRQACFKANYKRRKSLGDDYY

SEQ ID NO: 1435 - DNA, 897 bp, Arabidopsis thaliana
  G2215,family:bZIP-NIN
atggctgatcacacaaccaaagaacagaagtcattctcattcctagctcattctccatcctttgatcacagctccttaagttatcctttattcgactgggaagaagatcttcttgctctccaagaaaactctggctctcaagcatttccttttactacaacttctctgcctttacctgatcttgaacccttgtctgaagatgtactcaattcatacagctctgcgtcatggaacgaaacagagcaaaacagaggagatggcgcttcatcggagaagaagagggaaaatggaacagtgaaagagacaactaagaagaggaaaatcaatgagagacacagagaacatagcgtgagaatcatcagcgatattactacctacacaactagttcagctccaacgacattgtcaaaggaaactgtctctcgctacttctacatgcccataactcaggctgcaatagcacttaacgttggtttaactctactaaaaaggagatgtcgcgaattgggtattcgccgatggcctcatcgtaaacttatgagcttaaacactttgatcagtaacgtcaaggagctgcagaagatggaaggcgaagagaatgcagaaaaactgcaggacgcgttggagatgcttgagaaggagaagaggacaattgaggatttgccggatttggagtttaaggacaagacaaagaggctaagacaagcttgtttcaaggctaaccacaagaggaagaagaagagaagtctcaagtccgatcagtctcaagtaccctcgtgttcaagcagcggatcagttcctagtgatgagtcggttgatgaagcaggaatggagagtgatgaagaaatgaagtatctcttgtgtggtttctcaagtgaatttactagtggtttgtga

SEQ ID NO: 1436 - protein, 298 aa, Arabidopsis thaliana
  G2215,bZIP-NIN domain coordinates 150-246
MADHTTKEQKSFSFLAHSPSFDHSSLSYPLFDWEEDLLALQENSGSQAFPFTTTSLPLPDLEPLSEDVLNSYSSASWNETEQNRGDGASSEKKRENGTVKETTKKRKINERHREHSVRIISDITTYTTSSAPTTLSKETVSRYFYMPITQAAIALNVGLTLLKRRCRELGIRRWPHRKLMSLNTLISNVKELQKMEGEENAEKLQDALEMLEKEKRTIEDLPDLEFKDKTKRLRQACFKANHKRKKKRSLKSDQSQVPSCSSSGSVPSDESVDEAGMESDEEMKYLLCGFSSEFTSGL

SEQ ID NO: 1437 - DNA, 548 bp, Arabidopsis thaliana
  G2226,family:RING/C3H2C3
agacaacatcatttctaccgacaaagatttgatatcgaatccaacaagtgaaagatgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtgactgct

SEQ ID NO: 1438 - protein, 162 aa, Arabidopsis thaliana
  G2226,RING/C3H2C3 domain coordinates 103-144
MGLSSLPGPSEGMLCVILVNTALSISIVKGIVRSFLGIVGISLSPSSSSPSSVTVSSENSSTSESFDFRVCQPESYLEEFRNRTPTLRFESLCRCKKQADNECSVCLSKFQGDSEINKLKCGHLFHKTCLEKWIDYWNITCPLCRTPLVVVPEDHQLSSNVW

SEQ ID NO: 1439 - DNA, 1310 bp, Arabidopsis thaliana
  G2227,family:RING/C3H2C3
aacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttcagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattca

SEQ ID NO: 1440 - protein, 407 aa, Arabidopsis thaliana
  G2227,RING/C3H2C3 domain coordinates 199-239
MPSTPTTPTTTTPITASYWCYSCTRFVSVWADQGTTTVGSVACPHCDGGFIEQINDSSSAATELTIPASTEVRSINNNRRSVIRRRRSGRRPSFNPVIVLQGGAGEREEGEEGDAARDRRAFEFYYDDGSGSGLRPLPDSVSEILMGSGFERLLEQLSQIEASATGIGRSGNPPASKSAIESLPRVEISDCHIGSEANCAVCTEIFETETEAREMPCKHLFHDDCIVPWLSIRNSCPVCRFELPSEPNRRSNNNEEDNAVGMTIWRLPGGGFAVGRFNAAMRDGERVLPVVLTEMDGGGIGNSQDGPRRISWVRSHGTLESDSNGTGSGSGSGGRLRRMVRGMVSLMRRVRPNRSSSSSSAAISTSSDNLDLNIEVESRVLDRSNSVMRRYFRRNRSNRDSSSSVLH

SEQ ID NO: 1441 - DNA, 1228 bp, Arabidopsis thaliana
  G2239,family:RING/C3H2C3
aactcaaaatcatgagaagctccgatcatatggcgtttgccggcgttttgccgattgttttcttgcttatattatcatcagcggatctagcagcgagtcaatcacagcccggtccaacaaatcaaccgtataactacggcagactaagtccagccatggcagtgatcgtcgtgatcctaatcgctgctctcttcttcatgggcttcttctctatctacttccgtcactgctcaggcgtaccagacgccggtgtttctccagctggtggagctagatccagagcaaccgtcaacgcggcggcgcgtggtctcgacgtttcagttgtcgagacttttcctacgttcttgtactcagatgtgaaaacgcagaagcttggtaaaggagagttagagtgtgcgatatgtttgaacgagttcgaagacgacgaaacgctgcgtttgcttcccaagtgtgatcacgtgtttcatccgcactgcatcgatgcttggctcgaggctcacgtgacttgtcccgtttgcagagcgaatcttgctgaacaggtagctgaaggtgagtcagttgaaccgggaggaactgaaccggatcttgaattgcagcaggttgtggtgaatcctgaaccggtggttactgcaccggtaccggaacaattggtgactagtgaagtcgattcgaggagattacctggtgtaccggtggatcttaaaagagttaaattctcgagatcgcatacgacgggacattcggtggttcaaccgggagaatgtaccgaacggtttactcttcggttaccggaagatgtgaggaagaggataatgaaggattggaaattgaaccggacgaatagtcttctggttcttcctagaggagggagttcgaggagaggtaaaccgattgaccggtcaagggctcggtctgatcgatggttgtttcgtaaaacgccttcgtttctgtggaggagtcgtgatgatggttcgattaggttaggtgctaccggtagcgttcgagccagtgctgtaccgaattcaaccggtagtgattcggtacgtgcaggagaccggtgggcttttcttagaaacgcgtcgtttttgtggaggaactcttcggtacatgtgccaagaggaggagtcaataaagacggcgaaggaacttcggttaaatcgaccggtgcaagtggctcaactagcggttcggtgagattaccggtttagttgacttttcttttctcatc

SEQ ID NO: 1442 - protein, 398 aa, Arabidopsis thaliana
  G2239,RING/C3H2C3 domain coordinates 128-169
MRSSDHMAFAGVLPIVFLLILSSADLAASQSQPGPTNQPYNYGRLSPAMAVIVVILIAALFFMGFFSIYFRHCSGVPDAGVSPAGGARSRATVNAAARGLDVSVVETFPTFLYSDVKTQKLGKGELECAICLNEFEDDETLRLLPKCDHVFHPHCIDAWLEAHVTCPVCRANLAEQVAEGESVEPGGTEPDLELQQVVVNPEPVVTAPVPEQLVTSEVDSRRLPGVPVDLKRVKFSRSHTTGHSVVQPGECTERFTLRLPEDVRKRIMKDWKLNRTNSLLVLPRGGSSRRGKPIDRSRARSDRWLFRKTPSFLWRSRDDGSIRLGATGSVRASAVPNSTGSDSVRAGDRWAFLRNASFLWRNSSVHVPRGGVNKDGEGTSVKSTGASGSTSGSVRLPV

SEQ ID NO: 1443 - DNA, 682 bp, Arabidopsis thaliana
  G2251,family:RING/C3H2C3
ctcacccattctccaccttatcatcacaatccaaaactctctctctctctctctctctgtctcttgtcttatcatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtccaaacaaaaaaaaaagacatattaaatcctttttttttggtactttcattgggaattgggtttgg

SEQ ID NO: 1444 - protein, 166 aa, Arabidopsis thaliana
  G2251,RING/C3H2C3 domain coordinates 89-132
MGFPVGYSELLLPKIFFYLLSFLGLIRKLISTMFKIIGLPDFLEPEPVSTSWPDPPPTLTKPDSAAILAGEMLPVVRFSDINRPESECCAVCLYDFENDDEIRRLTNCRHIFHRGCLDRWMMGYNQMTCPLCRTQFIPDHLQLEFNQRLWSQSSAVSSQLLDESSS

SEQ ID NO: 1445 - DNA, 680 bp, Arabidopsis thaliana
  G2269,family:RING/C3H2C3
ccacatggccctaacctctttcttcaccatcaaatgtcaaccgccaccctcgtcgtcttccctcctccacctcctgtccctatccctacctatataactagcctcggccttggctactccatagccatagctctaggtttcctcgttcttatctccacaatcattctctcttcttacatctgttgccgcgcctcacgcctccgcttctctgcctccgccgcaaacgcaaacgcaaacgcatcgtttagcgaccgtggcgttatcgtcccaagaatcatattcgtagctgaagacgacgatcttgagtctggaaacgtcgtcgttggaggtcttgatcattcagtcatcaactcttaccctaaattccatttcactaaagatatcaccgccgtagtaaacggtgatgggtttcacgacggagaaggaagagagacgacgtgttcgatctgtttatgtgagtacatggaagaagagatgttaaggatgatgcctgagtgtaaacactacttccatgtttattgtcttgacgcttggcttaagctcaatggttcttgtcccgtttgtcggaattctccacttccgacgccgcaatctacgccgcagtcaactcctttgtcggaagttgtgccgttgtctcaatacgccgccgatcggaggagatccagaagataaaacatttc

SEQ ID NO: 1446 - protein, 212 aa, Arabidopsis thaliana
  G2269,RING/C3H2C3 domain coordinates 136-177
MSTATLVVFPPPPPVPIPTYITSLGLGYSIAIALGFLVLISTIILSSYICCRASRLRFSASAANANANASFSDRGVIVPRIIFVAEDDDLESGNVVVGGLDHSVINSYPKFHFTKDITAVVNGDGFHDGEGRETTCSICLCEYMEEEMLRMMPECKHYFHVYCLDAWLKLNGSCPVCRNSPLPTPQSTPQSTPLSEVVPLSQYAADRRRSRR

SEQ ID NO: 1447 - DNA, 1312 bp, Arabidopsis thaliana
  G2290,family:WRKY
ttctttctttctttctttctcttccaatcaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtagcaatagctaaggaggtgctaactcattatatatagaagatattgcagaccagaatatgcgcagggagggtataacaatatggcgttgtaacaatggatctatatattacctcattgttgatcaatagcacaccaccggtacgtttgcaatttcttcatgtatatttcttgttatatatgtagttatatatccaggtataattttgatgtaacacaacattaatcttaatcgtggatccatcccacatttgatgcatgtatgtgcacttaagaaaaagaacatggaggaaataacgttattttttattattct

SEQ ID NO: 1448 - protein, 287 aa, Arabidopsis thaliana
  G2290,WRKY domain coordinates 147-205
MNDPDNPDLSNDDSAWRELTLTAQDSDFFDRDTSNILSDFGWNLHHSSDHPHSLRFDSDLTQTTGVKPTTVTSSCSSSAAVSVAVTSTNNNPSATSSSSEDPAENSTASAEKTPPPETPVKEKKKAQKRIRQPRFAFMTKSDVDNLEDGYRWRKYGQKAVKNSPFPRSYYRCTNSRCTVKKRVERSSDDPSIVITTYEGQHCHQTIGFPRGGILTAHDPHSFTSHHHLPPPLPNPYYYQELLHQLHRDNNAPSPRLPRPTTEDTPAVSTPSEEGLLGDIVPQTMRNP

SEQ ID NO: 1449 - DNA, 827 bp, Arabidopsis thaliana
  G2291,family:AP2
gctttctcacctttataaaatagaaaatggaaaacagctacaccgttgatggtcaccgtcttcaatattccgttccgttaagctccatgcatgaaaccagtcaaaactccgaaacttacggattatccaaagagtcgccgttggtctgcatgcccttgttcgaaaccaacactacttcattcgatatctcttctcttttctcgtttaacccaaaaccagaacccgaaaacacgcatcgtgtcatggacgattccatcgccgccgtcgtgggcgaaaacgttcttttcggtgataaaaacaaagtctctgatcacttgaccaaagaaggtggtgtgaagcgggggcggaagatgccgcagaagaccggaggattcatgggagtgagaaaacggccgtgggggagatggtcggcggagataagagacaggatagggcggtgcagacactggttaggaacgttcgacacggcggaagaggcagcgcgtgcgtatgacgcggcggcgaggaggcttagagggaccaaagccaagaccaatttcgtgattcctccgctttttcccaaggaaatagctcaggctcaggaggataataggatgaggcagaagcagaagaagaagaagaagaaaaaagtgagtgtgaggaagtgtgttaaagtcacatcggttgcacagttgttcgatgatgccaattttataaattcttctagtattaaaggaaatgtgattagttctattgataatcttgaaaaaatgggtctagagcttgatttgagtttagggttgttgtctaggaagtgataaagcactcgtagttaagtagttgtagtt

SEQ ID NO: 1450 - protein, 256 aa, Arabidopsis thaliana
  G2291,AP2 domain coordinates 113-180
MENSYTVDGHRLQYSVPLSSMHETSQNSETYGLSKESPLVCMPLFETNTTSFDISSLFSFNPKPEPENTHRVMDDSIAAVVGENVLFGDKNKVSDHLTKEGGVKRGRKMPQKTGGFMGVRKRPWGRWSAEIRDRIGRCRHWLGTFDTAEEAARAYDAAARRLRGTKAKTNFVIPPLFPKEIAQAQEDNRMRQKQKKKKKKKVSVRKCVKVTSVAQLFDDANFINSSSIKGNVISSIDNLEKMGLELDLSLGLLSRK

SEQ ID NO: 1451 - DNA, 687 bp, Arabidopsis thaliana
  G2294,family:AP2
tcctcccttaattagtatcaaaaatggtgaaaacacttcaaaagacaccaaagagaatgtcatctccatcatcatcatcttcatcatcctcatcaacatcatcatcatccataaggatgaagaagtacaagggagtgagaatgagaagttggggttcatgggtttcagagatcagagctcctaatcaaaagacaaggatctggcttggttcttactcaactgctgaagccgcggctagagcctacgacgcagcactcctatgtcttaaaggatcctcagctaataatctcaacttcccagagatctcaacttctctctaccatattatcaacaatggtgataacaacaatgacatgtcccctaagtctatacaaagagtagcagctgcagctgctgctgccaacacagatccttcctcatcatcagtctctacttcatctccattgctttcctctccatctgaagatctctatgatgttgtctccatgtcacagtatgaccaacaagtctccttgtctgaatcatcatcatggtacaactgctttgatggtgatgatcagttcatgttcattaatggagtctccgcgccgtatttgacaacatcactttctgatgatttctttgaggaaggagatatcagattatggaacttctgctgattctactttcattataccttattctttg

SEQ ID NO: 1452 - protein, 211 aa, Arabidopsis thaliana
  G2294,AP2 domain coordinates 32-95
MVKTLQKTPKRMSSPSSSSSSSSSTSSSSIRMKKYKGVRMRSWGSWVSEIRAPNQKTRIWLGSYSTAEAAARAYDAALLCLKGSSANNLNFPEISTSLYHIINNGDNNNDMSPKSIQRVAAAAAAANTDPSSSSVSTSSPLLSSPSEDLYDVVSMSQYDQQVSLSESSSWYNCFDGDDQFMFINGVSAPYLTTSLSDDFFEEGDIRLWNFC

SEQ ID NO: 1453 - DNA, 962 bp, Arabidopsis thaliana
  G2295,family:MADS
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttagggttttatagttttg

SEQ ID NO: 1454 - protein, 294 aa, Arabidopsis thaliana
  G2295,MADS domain coordinates 1-57
MVPKVVDLQRIANDKTRITTYKKRKASLYKKAQEFSTLCGVETCLIVYGPTKATDVVISEPEIWPKDETKVRAIIRKYKDTVSTSCRKETNVETFVNDVGKGNEVVTKKRVKRENKYSSWEEKLDKCSREQLHGIFCAVDSKLNEAVTRQERSMFRVNHQAMDTPFPQNLMDQQFMPQYFHEQPQFQGFPNNFNNMGFSLISPHDGQIQMDPNLMEKWTDLALTQSLMMSKGNDGTQFMQRQEQPYYNREQVVSRSAGFNVNPFMGYQVPFNIPNWRLSGNQVENWELSGKKTI

SEQ ID NO: 1455 - DNA, 860 bp, Arabidopsis thaliana
  G2296,family:WRKY
atcctaaacagaaaatatgtctcttgagattgatgcgaaggctgtctcagcactcctccttggccaaggatgcgctaacaatctcaagacgctcctcaaaaaccatgaaacaggctcagtttcaacagagccactcatcaactccattcttgattctttctcgtttgctctgtcttctcagaacataccacgtcatgtgtctcaaagatcatcaaagaaaaagatgtgtggaatacaaggtatggaagattctccgacaccggcccacattgatggcttcatctggaggaaatatggacaaaagaccatcaaaacctctccgcaccaaaggtggtactaccgatgtgcctatgcgaaagaccaaaactgcgacgctaccaagcgggtacagaagatccaagacaatcctccagtgtacagaaacacctatgtcggacaacatgcatgtgaagctccagcttatgcagttaataatggtggtacatacggttcaaaaatgatcaaattcgactatgttattcctgaatcggttatgcctcaacctttatcaattgattcccaagaaattaccatggaggataaagacacagacgaccatattttgaactatattaacgagcatttgatggaagatgaggcgtatgatgttttccctgatgtacttggagaacgttgctgctttggattagaaccctttccaggattgaacattaataaatcttaaaagcttttcatgttcttcgatcttatggtggagaatgaatgattcattcttcatttcttttcatgttcatgttttgtaattttgatttacgtgttgtttttttgtaaaaggaagttttatcagtgatgtatttctt

SEQ ID NO: 1456 - protein, 235 aa, Arabidopsis thaliana
  G2296,WRKY domain coordinates 85-145
MSLEIDAKAVSALLLGQGCANNLKTLLKNHETGSVSTEPLINSILDSFSFALSSQNIPRHVSQRSSKKKMCGIQGMEDSPTPAHIDGFIWRKYGQKTIKTSPHQRWYYRCAYAKDQNCDATKRVQKIQDNPPVYRNTYVGQHACEAPAYAVNNGGTYGSKMIKFDYVIPESVMPQPLSIDSQEITMEDKDTDDHILNYINEHLMEDEAYDVFPDVLGERCCFGLEPFPGLNINKS

SEQ ID NO: 1457 - DNA, 1013 bp, Arabidopsis thaliana
  G2298,family:AP2
ttttcactatactgtcagctccaaaacatacctgaataagtgaatatacattaaaacctaatctatcatcatatccatctctttccctctctgcatttagagatatggatgcatccccaaagtacacaggtgtacggaagaggaagtggggaaaatgggtggctgagattcgtctccccaacagccgtgacaggatctggttaggctctttcgactctgctgagaaggcggcgcgtgctttcgacgcggctctttactgtcttcgtggccccggagcacgcttcaacttccccgacaatcctccggagattcccggtggtcgttctctgacgccgcagcagattcaggtcgtagctagccgtttcgcctgcgaggaggagctactaccaccggaacaacatcatccgtcaccgccacgtggcgaccataataccgaggaagaagtgataatttcggcacgtggggaaattaatagtggtagtggtgggcctacgttagggcaagttggggaagataataacaacgagggtaatagtaatgacacgtcgtcgtattggcctttaatatgggaggaggagaattttgtaggtcctcctaactcagatcatgagttcggttttttcacagatgattcaaccaatttgtacttcccgacacaacaacaacaacaacatcagctctcgtctgatttttactatgatggagcttgtgaagatgatttctctcattacaatattaacctttggaatttctgagatccatttttttggtgatcttggaccaaatattcctatattgattaattcaatttgtggatttcgaattcgagatttcaaatgatcttgaaccagaattttcaccacccactagtagtgtgaatcatttgtttgaactttgaagcgaatcctatatgccacaatgtaagcaagcctgagtaatagcttcactacttaattatcttattcttcttcttctttttggttattaaaaccaatctgtttcatatgattttt

SEQ ID NO: 1458 - protein, 216 aa, Arabidopsis thaliana
  G2298,AP2 domain coordinates 4-70
MDASPKYTGVRKRKWGKWVAEIRLPNSRDRIWLGSFDSAEKAARAFDAALYCLRGPGARFNFPDNPPEIPGGRSLTPQQIQVVASRFACEEELLPPEQHHPSPPRGDHNTEEEVIISARGEINSGSGGPTLGQVGEDNNNEGNSNDTSSYWPLIWEEENFVGPPNSDHEFGFFTDDSTNLYFPTQQQQQHQLSSDFYYDGACEDDFSHYNINLWNF

SEQ ID NO: 1459 - DNA, 864 bp, Arabidopsis thaliana
  G2311,family:MYB-related
atgggaaaccagaaactaaagtggacggcggaggaagaggaggcgttactcgccggaatcagaaagcacggtcctggaaagtggaagaatattctccgggatccagaattcgctgatcagctcatccatcgctccaacattgacctaaaggataagtggcgtaacttgagtgttccccctggtactcaaagtttaactaataaggcacggccagcaaaagtcaaagaggaaggcgacactccggctgcagatgcaaatgatgctgtcactattccacggcctattcctactattccacctcctcccggtcggcgtactttaccttctgagttgatccctgatgaaaatacaaagaatgctcctaggtatgacggggtgatatttgaagctctctctgctttagccgatggtaatggatctgatgtcagttccatttatcatttcattgagcccaggcatgaagtaccgccaaattttagaagaatccttagtacaagactgaggaggcttgcagctcagagcaaacttgaaaaggttagcaccttcaaatctatacagaacttctataagatacccgatccatcaggaacaaaaataggtgtcccaaaaccaaaggagacacatacgaagctgcgccaagcaaacaatcagacctctgctgattcacaacagatgatcgaggaagctgcaataaccgcagcctgtaaagtcgtagaggcggagaataaaatagacgttgccaaactagcagcagaagagtttgagaagatgacaaagattgcagaagaaaatagaaaactcctggtcatagctactgagatgcatgaactatgttcctgtggggagactatgctcttggcttga

SEQ ID NO: 1460 - protein, 287 aa, Arabidopsis thaliana
  G2311,MYB-related domain coordinates 6-54
MGNQKLKWTAEEEEALLAGIRKHGPGKWKNILRDPEFADQLIHRSNIDLKDKWRNLSVPPGTQSLTNKARPAKVKEEGDTPAADANDAVTIPRPIPTIPPPPGRRTLPSELIPDENTKNAPRYDGVIFEALSALADGNGSDVSSIYHFIEPRHEVPPNFRRILSTRLRRLAAQSKLEKVSTFKSIQNFYKIPDPSGTKIGVPKPKETHTKLRQANNQTSADSQQMIEEAAITAACKVVEAENKIDVAKLAAEEFEKMTKIAEENRKLLVIATEMHELCSCGETMLLA

SEQ ID NO: 1461 - DNA, 755 bp, Arabidopsis thaliana
  G2313,family:MYB-related
cgtcgacacaatcgctcttccgtaacatattccacaaaacgatcttcttgtttcttgaatttttagccatctcttttttttttttctcattttctcggatactatggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttagatgttggaagatagaagaatggtgtgaaagc

SEQ ID NO: 1462 - protein, 206 aa, Arabidopsis thaliana
  G2313,MYB-related domain coordinates 111-159
MASSPRWTEDDNRRFKSALSQFPPDNKRLVNVAQHLPKPLEEVKYYYEKLVNDVYLPKPLENVTQHLQKPMEMEEMKYMYEKMANDVNQMPEYVPLAESSQSKRRKKDTPNPWTEEEHRLFLQGLKKYGEGASTLTSTNFVKTKTPRQVSSHAQYYKRQKSDNKKEKRRSIFDITLESTEGNPDSGNQNPPDDDDPSQGQGTCLGV

SEQ ID NO: 1463 - DNA, 1414 bp, Arabidopsis thaliana
  G2317,family:MYB-related
aaaaaaaaaaggaagcagaagaagattcttattttatctttacactgttcagaaatcttcggtggacggataacttgcagagttctgattgaggctggttttgtgagaattatagttgcagcaagaaagcgtttcagatattttttaatggccgctgaggatcgaagtgaggaactaagcagcaatgtagaaaatggaagttgcaattccaatgaaggaattaatcctgaaaccagcagtcattggattgaaaacgttgtcaaggttaggaaaccgtacacagtaactaagcagagagagaagtggagtgaggaagagcatgataggtttcttgaagctatcaagctttatggtcgtggttggcgtcaaatccaagaacacataggtacaaaaaccgctgtacagatacgaagccatgctcaaaagttcttctccaagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaagtcaatagatgctcttcgcctaattcgtgtaccagtgacatccaatccattggtgcaacttccattgataaaaagaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaaaagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctagttttagccattgtacagtttggagtcaattttgatgatccgtgaacattgttttagccatttgctgggtgacttggatcatagcattccacgaaccaaatcctaaatccgagttggtaagtggttttacttgtccgccacatgtaattcttgtaatgaagtttctcctgctgtctcacgttaagaagacacttctttttttcttcatatacaaatcagttttaaca

SEQ ID NO: 1464 - protein, 346 aa, Arabidopsis thaliana
  G2317,MYB-related domain coordinates 51-97
MAAEDRSEELSSNVENGSCNSNEGINPETSSHWIENVVKVRKPYTVTKQREKWSEEEHDRFLEAIKLYGRGWRQIQEHIGTKTAVQIRSHAQKFFSKMAQEADSRSEGSVKAIVIPPPRPKRKPAHPYPRKSPVPYTQSPPPNLSAMEKGTKSPTSVLSSFGSEDQVNRCSSPNSCTSDIQSIGATSIDKKNNYTTSKQPFKDDSDIGSTPISSITLFGKIVLVAEESHKPSSYNDDDLKQMTCQENHYSGMLVDTNLSLGVWETFCTGSNAFGSVTEASENLEKSAEPISSSWKRLSSLEKQGSCNPVNASGFRPYKRCLSEREVTSSLTLVASDEKKSQRARIC

SEQ ID NO: 1465 - DNA, 849 bp, Arabidopsis thaliana
  G2319,family:MYB-related
atgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaagctgatattggatcaaagggcttattaaatgttagtagcccttctacatctggcatgggaagctcaagccgaacagtatcaggttctgagattgtaagaaaggctaaacagcctccagtgcttcacggtgttcctgattttgctgaagtttataatttcattgggagtgtctttgatcctgaaacgagaggccatgtggaaaagctcaaggaaatggatcctataaatttcgaaactgttctgttattgatgagaaacctcacatttaacttatcaaaccctgatttagaatccacttcggattgtaatgatgctgcagaggaaagtcctcttatcatatga

SEQ ID NO: 1466 - protein, 282 aa, Arabidopsis thaliana
  G2319,MYB-related domain coordinates 44-90
MSSSPSRNPTNAEAPPPPPTSTDAVAEGSSKKVRKPYTITKSRESWTEEEHDKFLEALQLFDRDWKKIEDFVGSKTVIQIRSHAQKYFLKVQKNGTLAHVPPPRPKRKAAHPYPQKASKNAQMPLQVSTSFTTTRNGDMPGYASWDDASMLLNRVISPQHELATLRGAEADIGSKGLLNVSSPSTSGMGSSSRTVSGSEIVRKAKQPPVLHGVPDFAEVYNFIGSVFDPETRGHVEKLKEMDPINFETVLLLMRNLTFNLSNPDLESTSDCNDAAEESPLII

SEQ ID NO: 1467 - DNA, 1412 bp, Arabidopsis thaliana
  G2334,family:GRF-like
gcaaccaacacatttctctgtctgtctctctttctctctctctcactcactctctctttgttccatggacttgcaactgaaacaatggagaagtcagcagcagaatgagtcagaagaacaaggctctgctgcaactaagatatcaaactttttctttgatcagattcagtcccaaactgctacttctgctgctgcggctcctcttcctctctttgtccctgaacccacttcttcctcttctttctcttgcttctctcctgactcttctaattcttcttcttcttccaggttcctcaagatgggaaacttcttcagctgggcacagtggcaagaacttgagctacaagcactgatctatagatacatgttggctggtgcttctgttcctcaagagcttctcttacctattaagaaaagtctcctccatcaatctcctatgcatttccttcaccatcctcttcaacatagttttcctcatcaccaaccttcttggtattggggaagaggagcaatggatcctgagccagggaggtgtaagagaactgacggcaagaaatggagatgttcaagggatgttgtagcgggccacaagtattgtgaccgccacattcaccgtggaagaaaccgttcaagaaagcctgtggaaaccgccacaaccaccatcacaacgacagccacaacaaccgcatcttcttttgtcttaggtgaggagcttggtcatggaccaaacaacaaccacttcttctcctctggttcatctcaacctctccaccttagtcatcaacaaagttgttcttcagagatgaaacaagaaagcaacaacaacaagaggccatatgaagctaacagtggattcagcaatggaagatcagacgatggtcacatcttgaggcatttctttgacgattggccacgatcatcagactctacctccagtccaatgagctcatccacttgtcatctttcaatctccatgcccggtaacaacacgtcctcagatgtttctctaaaactttccacaggcaatgaagaagaagaagagaacatgagaaataacaacaatgagagggagcaaatgaattggtggagcaatggagggaatcaccacaacaatatgggaggaccattagctgaggctttgaggtcagcttcttcgacgtcaagtgttcttcatcagatgggaatctctactcaagtttttcattaaagaaaagtgtttgtaatctttttggtttgtgctctttgaatctttattttctgcagaaaataatctttgaatttgtcttcttttggaattgtgagttctgcttttggaattgttttgttccttactctgctattatatttatgtttaaagcttgacaattttgtataagcaatgaaactaatatgatcctctgcctgcaagtaag

SEQ ID NO: 1468 - protein, 380 aa, Arabidopsis thaliana
  G2334,GRF-like domain coordinates 82-194
MDLQLKQWRSQQQNESEEQGSAATKISNFFFDQIQSQTATSAAAAPLPLFVPEPTSSSSFSCFSPDSSNSSSSSRFLKMGNFFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVETATTTITTTATTTASSFVLGEELGHGPNNNHFFSSGSSQPLHLSHQQSCSSEMKQESNNNKRPYEANSGFSNGRSDDGHILRHFFDDWPRSSDSTSSPMSSSTCHLSISMPGNNTSSDVSLKLSTGNEEEEENMRNNNNEREQMNWWSNGGNHHNNMGGPLAEALRSASSTSSVLHQMGISTQVFH

SEQ ID NO: 1469 - DNA, 1406 bp, Arabidopsis thaliana
  G2340,family:MYB-(R1)R2R3
atacaaaactccctcttctctatcttcttcatcttaaagaaaaaataagagatattcgtaaagagagaacacaaaatttcagtttacgaaaagctagcaaagtcgagtatcgaggaataacagaataagacgtatctatccttgccttaatgttcttaccaaaagatctagtcctttctttgtatgatcgatccatcacaagcccacaacaacaacaactacatctctttctctatctctagcttctatttttaatacattcaagaatcaagaatggtacggacgccgtgttgtagagcagaagggttgaagaaaggagcatggactcaagaagaagaccaaaagcttatcgcctatgttcaacgacatggtgaaggcggttggcgaacccttccggacaaagctggactcaaaagatgtggcaaaagctgcagattgagatgggcgaattacttaagacctgacattaaacgtggagagtttagccaagacgaggaagattccatcatcaacctccacgccattcatggcaacaaatggtcggccatagctcgtaaaataccaagaagaacagacaatgagatcaagaaccattggaacactcacatcaagaaatgtctggtcaagaaaggtattgatccgttgacccacaaatcccttctcgatggagccggtaaatcatctgaccattccgcgcatcccgagaaaagcagcgttcatgacgacaaagatgatcagaattcaaataacaaaaagttgtcaggatcatcatcagctcggtttttgaacagagtagcaaacagattcggtcatagaatcaaccacaatgttctgtctgatattattggaagtaatggcctacttactagtcacactactccaactacaagtgtttcagaaggtgagaggtcaacgagttcttcctccacacatacctcttcgaatctccccatcaaccgtagcataaccgttgatgcaacatctctatcctcatccacgttctctgactcccccgacccgtgtttatacgaggaaatagtcggtgacattgaagatatgacgagattttcatcaagatgtttgagtcatgttttatctcatgaagatttattgatgtccgttgagtcttgtttggagaatacttcattcatgagggaaattacaatgatctttcaagaggataaaatcgagacgacgtcgtttaatgatagctacgtgacgccgatcaatgaagttgatgactcctgtgaagggattgacaattattttggatgagttatattgatgatgatgaaaatttgcatttggcatgtaaatcaattagagtttgatttgctatggtgtttttagtttgtgtgtgtagtgtgtttcgaccgtcaaaaaaaaaaaaaaaaaaaaaaaaaaaa

SEQ ID NO: 1470 - protein, 333 aa, Arabidopsis thaliana
  G2340,MYB-(R1)R2R3 domain coordinates 14-120
MVRTPCCRAEGLKKGAWTQEEDQKLIAYVQRHGEGGWRTLPDKAGLKRCGKSCRLRWANYLRPDIKRGEFSQDEEDSIINLHAIHGNKWSAIARKIPRRTDNEIKNHWNTHIKKCLVKKGIDPLTHKSLLDGAGKSSDHSAHPEKSSVHDDKDDQNSNNKKLSGSSSARFLNRVANRFGHRINHNVLSDIIGSNGLLTSHTTPTTSVSEGERSTSSSSTHTSSNLPINRSITVDATSLSSSTFSDSPDPCLYEEIVGDIEDMTRFSSRCLSHVLSHEDLLMSVESCLENTSFMREITMIFQEDKIETTSFNDSYVTPINEVDDSCEGIDNYFG

SEQ ID NO: 1471 - DNA, 1113 bp, Arabidopsis thaliana
  G2343,family:MYB-(R1)R2R3
atgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaa

SEQ ID NO: 1472 - protein, 370 aa, Arabidopsis thaliana
  G2343,MYB-(R1)R2R3 domain coordinates 14-116
MGHHSCCNQQKVKRGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKIRKPHHHYSRHQPSVTTVTLNADTTSIATTIEASTTTTSTIDNLHFDGFTDSPNQLNFTNDQETNIKIQETFFSHKPPLFMVDTTLPILEGMFSENIITNNNKNNDHDDTQRGGRENVCEQAFLTTNTEEWDMNLRQQEPFQVPTLASHVFNNSSNSNIDTVISYNLPALIEGNVDNIVHNENSNVQDGEMASTFECLKRQELSYDQWDDSQQCSNFFFWDNLNINVEGSSLVGNQDPSMNLGSSALSSSFPSSF

SEQ ID NO: 1473 - DNA, 573 bp, Arabidopsis thaliana
  G2344,family:CAAT
atgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttga

SEQ ID NO: 1474 - protein, 190 aa, Arabidopsis thaliana
  G2344,CAAT domain coordinates 100-159
MTSSIHELSDNIGSHEKQEQRDSHFQPPIPSARNYESIVTSLVYSDPGTTNSMAPGQYPYPDPYYRSIFAPPPQPYTGVHLQLMGVQQQGVPLPSDAVEEPVFVNAKQYHGILRRRQSRARLESQNKVIKSRKPYLHESRHLHAIRRPRGCGGRFLNAKKEDEHHEDSSHEEKSNLSAGKSAMAASSGTS

SEQ ID NO: 1475 - DNA, 896 bp, Arabidopsis thaliana
  G2345,family:CAAT
agatcagatcaaatctctctctccatctccgtctcctcctccaatcatcatttctctctccgtctcccgctctttttcgaattctccttcttcttcagggtttctgagatggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgaggctagtgataagtgccaaagagagaaaaggaagaccatcaatggagatgatttgctttgggctatggccactttaggattcgaagattacatcgatcccctcaaggtttacctgatgcgatatagagagatggagggtgacactaaaggatcaggaaaaggcggggaatcgagtgcaaagagagatggtcaaccaagccaagtgtctcagttctcgcaggttcctcaacaaggctcattctcacagggtccttatggaaactctcaaggttcgaatatgatggttcaaatgccgggcacagagtagtactaggacactattcatcacaatcttccgagactcgactatgcctgttgtgtctgagaatctgagtgatccactttccatagatatggattgtggtatctcagtttttgggagagagaagatttgtatatgattgtgttgtagggagaagagtttggtttgcttatgataagaattgaaaagcaccttttttttcttttgactgttatgtttcttaggttttggtcttaagcagaagctatttaccaaaaaaaaaa

SEQ ID NO: 1476 - protein, 176 aa, Arabidopsis thaliana
  G2345,CAAT domain coordinates 28-117
MAESQTGGGGGGSHESGGDQSPRSLNVREQDRFLPIANISRIMKRGLPLNGKIAKDAKETMQECVSEFISFVTSEASDKCQREKRKTINGDDLLWAMATLGFEDYIDPLKVYLMRYREMEGDTKGSGKGGESSAKRDGQPSQVSQFSQVPQQGSFSQGPYGNSQGSNMMVQMPGTE

SEQ ID NO: 1477 - DNA, 1011 bp, Arabidopsis thaliana
  G2346,family:SBP
atggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcagtgtgtcgccctattctcctccgtccttactatctcttgtgtgctacttgcggccgctatag

SEQ ID NO: 1478 - protein, 336 aa, Arabidopsis thaliana
  G2346,SBP domain coordinates 59-135
MELLMCSGQAESGGSSSTESSSLSGGLRFGQKIYFEDGSGSRSKNRVNTVRKSSTTARCQVEGCRMDLSNVKAYYSRHKVCCIHSKSSKVIVSGLHQRFCQQCSRFHQLSEFDLEKRSCRRRLACHNERRRKPQPTTALFTSHYSRIAPSLYGNPNAAMIKSVLGDPTAWSTARSVMQRPGPWQINPVRETHPHMNVLSHGSSSFTTCPEMINNNSTDSSCALSLLSNSYPIHQQQLQTPTNTWRPSSGFDSMISFSDKVTMAQPPPISTHQPPISTHQQYLSQTWEVIAGEKSNSHYMSPVSQISEPADFQISNGSVSPYSPPSLLSLVCYLRPL

SEQ ID NO: 1479 - DNA, 850 bp, Arabidopsis thaliana
  G2347,family:SBP
agcccatccttcaacattgcttcctaaccagaaatccaccatcatcttcccacgaatacaacttaaagctttaccagaaaatggagggtcagagaacacaacgccggggttacttgaaagacaaggctacagtctccaaccttgttgaagaagaaatggagaatggcatggatggagaagaggaggatggaggagacgaagacaaaaggaagaaggtgatggaaagagttagaggtcctagcactgaccgtgttccatcgcgactgtgccaggtcgataggtgcactgttaatttgactgaggccaagcagtattaccgcagacacagagtatgtgaagtacatgcaaaggcatctgctgcgactgttgcaggggtcaggcaacgcttttgtcaacaatgcagcaggtttcatgagctaccagagtttgatgaagctaaaagaagctgcaggaggcgcttagctggacacaatgagaggaggaggaagatctctggtgacagttttggagaagggtcaggccggagagggtttagcggtcaactgatccagactcaagaaagaaacagggtagacaggaaacttcctatgaccaactcatcattcaagcgaccacagatcagataaaccctcccgctctctctcttctgtcatctacatatgctctatctacactcttattagacaaataatggcatctaacaatgtcaagaaaagttggtcatggtattaaatcctacacggatatataactataaacctctagtcccctctatgctgtcctgtaatgaatatctatccggaaatgtattcgcatagtcttgcgtctaataatgtttattgattttgta

SEQ ID NO: 1480 - protein, 181 aa, Arabidopsis thaliana
  G2347,SBP domain coordinates 60-136
MEGQRTQRRGYLKDKATVSNLVEEEMENGMDGEEEDGGDEDKRKKVMERVRGPSTDRVPSRLCQVDRCTVNLTEAKQYYRRHRVCEVHAKASAATVAGVRQRFCQQCSRFHELPEFDEAKRSCRRRLAGHNERRRKISGDSFGEGSGRRGFSGQLIQTQERNRVDRKLPMTNSSFKRPQIR

SEQ ID NO: 1481 - DNA, 2462 bp, Arabidopsis thaliana
  G2348,family:SBP
cagaaattgaagactctcagatgtcttctctgtcgcaatcgccaccaccgccggagatggatatccaacccccggcattggttaacgatgatccttccacttattcctccgctttatgggattggggagatctccttgacttcgccgcagacgaacgccttctcgtcgatcaaattcatttccctcccgttctctctcctcctctaccgcctctgattccgacgcaaactccggcggaatctgaattagatccttctccggaagaatcgggttctggttcggatcgggttaggaagcgagacccgaggttgatttgttccaatttcattgaaggtatgcttccttgttcgtgtcctgagcttgatcagaaattggaagacgccgagcttccgaagaagaaacgggttcgcggcgggtcgggcgtggctcgatgtcaggttccggattgtgaagcggatattagcgagctcaaagggtaccataagaggcatagggtttgtctccgttgcgctaccgccagctttgttgtgcttgatggagagaataagagatactgtcaacagtgtggaaagtttcatttgctcccggactttgatgaaggaaaacgcagctgtcggagaaagctagagcgtcacaacaacagacggaaaaggaaacctgtagataaaggaggtgttgctgcagaacaacagcaagtgctttcacagaatgataacagcgtcattgatgttgaggatggaaaagatatcacatgctctagtgaccagagagctgaagaagagccttcattgatttttgaagatcggcatattaccactcagggttctgtaccttttacccgaagcatcaacgcagacaactttgtctctgttacaggttcgggtgaagctcaaccagatgaaggaatgaatgacacaaaatttgaacgttcaccttctaatggcgacaacaaaagtgcttactcaactgtgtgtccaactggtcggatctcttttaagctctacgattggaatccagcggagttcccacggagactacgtcatcaaatatttcaatggttggccaacatgcctgttgagctggagggctatatccgcccaggatgtacaattttgactgtctttatagcaatgccagagattatgtgggcgaagttatctaaagatcctgtggcatatctggatgaatttattcttaaacctggaaagatgctgtttggaagaggctcgatgactgtctatttgaacaacatgattttccgtcttattaaaggtggaacaactttaaagagagtcgatgtaaaattagagtcgccgaaacttcagtttgtgtatcctacatgttttgaagctggaaaaccaattgaactcgttgtatgtggacaaaaccttctgcaacctaaatgccggtttctcgtgtctttttctgggaagtacttgccacataactattctgttgtacctgcaccggaccaggatgggaagcgttcttgtaataacaagttctacaagatcaatattgtgaattctgaccctagtctctttggccctgcctttgtcgaggttgaaaatgaatctggcctatcaaatttcatacctctaattattggagatgcagctgtttgttccgaaatgaaactaatagagcagaagttcaatgctacactctttccagagggacaagaagttactgcttgctcttctttgacttgctgttgcagggattttggggagagacagagcacctttagtggcctcttgttagatattgcatggtcggtgaaggtaccctctgcagaacgcactgagcaacctgtgaaccgatgtcagataaaaagatacaacagagtgttgaattatctgatacagaataactcagcgtcgatcttaggaaacgtactgcacaatttggaaactttggtgaagaaaatggagccagacagtcttgttcactgtacctgtgactgcgacgtgaggcttctacatgaaaatatggatttggcgagtgatattcacagaaagcatcaaagccctatagagtcaaaggtgaatcctccttcgtcaggttgctgttgtgtgagtagtcagaaggacataccatcaagaatattaaacttcaataaggatcctgaagcaggattagattgtaaagagagaatacaggcagactgttcaccagatagcggcggaaaagagactgatcctctgttaaacaaagaggttgtcatgaacgtaaatgacataggagactggccaaggaagtcgtgtataaaaacgcactcagctttagcattcaggtcccgtcaaactatgttcttaatcgctacgttcgctgtctgttttgctgtctgtgcggttctctaccatccaaacaaggtcacacagcttgcagtggcaatccgaatgagattggtacacaaaatttgaatataagttcaacggcagagactctcattaacgtgt

SEQ ID NO: 1482 - protein, 801 aa, Arabidopsis thaliana
  G2348,SBP domain coordinates 123-218
MSSLSQSPPPPEMDIQPPALVNDDPSTYSSALWDWGDLLDFAADERLLVDQIHFPPVLSPPLPPLIPTQTPAESELDPSPEESGSGSDRVRKRDPRLICSNFIEGMLPCSCPELDQKLEDAELPKKKRVRGGSGVARCQVPDCEADISELKGYHKRHRVCLRCATASFVVLDGENKRYCQQCGKFHLLPDFDEGKRSCRRKLERHNNRRKRKPVDKGGVAAEQQQVLSQNDNSVIDVEDGKDITCSSDQRAEEEPSLIFEDRHITTQGSVPFTRSINADNFVSVTGSGEAQPDEGMNDTKFERSPSNGDNKSAYSTVCPTGRISFKLYDWNPAEFPRRLRHQIFQWLANMPVELEGYIRPGCTILTVFIAMPEIMWAKLSKDPVAYLDEFILKPGKMLFGRGSMTVYLNNMIFRLIKGGTTLKRVDVKLESPKLQFVYPTCFEAGKPIELVVCGQNLLQPKCRFLVSFSGKYLPHNYSVVPAPDQDGKRSCNNKFYKINIVNSDPSLFGPAFVEVENESGLSNFIPLIIGDAAVCSEMKLIEQKFNATLFPEGQEVTACSSLTCCCRDFGERQSTFSGLLLDIAWSVKVPSAERTEQPVNRCQIKRYNRVLNYLIQNNSASILGNVLHNLETLVKKMEPDSLVHCTCDCDVRLLHENMDLASDIHRKHQSPIESKVNPPSSGCCCVSSQKDIPSRILNFNKDPEAGLDCKERIQADCSPDSGGKETDPLLNKEVVMNVNDIGDWPRKSCIKTHSALAFRSRQTMFLIATFAVCFAVCAVLYHPNKVTQLAVAIRMRLVHKI

SEQ ID NO: 1483 - DNA, 1077 bp, Arabidopsis thaliana
  G2371,family:ABI3/VP-1
ccaaaccaacacctgcaaatcctctctctctctctcactccaagaaaccaaaaaaaaagatgtcagtcaaccattaccacaacactctctcgttgcatcatcaccaccaaaacgacgtagctatagcacaacgagagtctttgttcgagaaatcactcacaccaagcgacgtcggaaagctaaaccgcttagtcataccaaaacaacacgccgagaaatacttccctctcaataataataataataatggcggcagcggagatgacgtggcgacgacggagaaagggatgcttcttagcttcgaggatgagtcaggcaagtgttggaaattcagatactcttattggaacagtagccaaagctacgtgttgaccaaaggatggagcaggtacgtcaaagacaaacacctcgacgcaggcgacgttgttttctttcaacgtcaccgttttgatctccatagactcttcattggctggcggagacgcggtgaagcttcttcctctcccgctgtctccgttgtgtctcaagaagctctagttaatacgacggcgtattggagcggcttgactacaccttatcgtcaagtacacgcgtcaactacttaccctaatattcaccaagagtattcacactatggcgccgtcgttgatcatgctcagtcgataccaccggtggtcgcaggtagctcgaggacggtgaggctttttggcgtgaacctcgaatgtcatggtgatgccgtcgagccaccaccgcgtcctgatgtctataatgaccaacacatttactattactcaactcctcatcccatgaatatatcatttgctggggaagcattggagcaggtaggagatggacgaggttgatgactgacattcaaaaagaagtgacaactttctagatttttaactttagaatttagattatgggcccatacttggcccaattgtcatagagaaaaaatggacaagaattaatattattagtagcttcgttatgtatttagtatttaactaatttgaaaataaaaataaaagatgagattttgtttctaaaaaaaaaaaaaaaaaaaaaaaaaaa

SEQ ID NO: 1484 - protein, 267 aa, Arabidopsis thaliana
  G2371,ABI3/VP-1 domain coordinates 25-127
MSVNHYHNTLSLHHHHQNDVAIAQRESLFEKSLTPSDVGKLNRLVIPKQHAEKYFPLNNNNNNGGSGDDVATTEKGMLLSFEDESGKCWKFRYSYWNSSQSYVLTKGWSRYVKDKHLDAGDVVFFQRHRFDLHRLFIGWRRRGEASSSPAVSVVSQEALVNTTAYWSGLTTPYRQVHASTTYPNIHQEYSHYGAVVDHAQSIPPVVAGSSRTVRLFGVNLECHGDAVEPPPRPDVYNDQHIYYYSTPHPMNISFAGEALEQVGDGRG

SEQ ID NO: 1485 - DNA, 1791 bp, Arabidopsis thaliana
  G2372,family:ARF
atgtcaccgccgtcggcaaccgccggtgacatcaaccaccgtgaagtagacccgacgatctggcgcgcttgtgctggagcctccgtccagatccctgtccttcactctagggtttactactttccacaaggtcacgttgagcactgttgccctctcctctctactcttccttcctccacctcgccggttccatgtatcatcacttcaattcagttgctcgccgatccggtcaccgacgaggtctttgctcaccttattcttcaaccgatgacgcagcagcagtttactccgactaattattcacgattcggcagattcgatggcgatgttgatgataacaacaaggtgactaccttcgccaaaattctcacgccttctgatgctaacaatggaggtggcttctccgttcctcgtttctgtgctgattccgtcttccctctgcttaattttcaaatcgatccaccggttcagaagctctacgtcactgatatccatggagctgtttgggatttcaggcatatctatcgcggtacaccgaggcgtcacttgctaacaacgggatggagtaagttcgtcaatagcaagaagctcatcgctggagattcggtggtgtttatgagaaaatctgcagatgagatgttcatcggcgttaggagaactccgatctcaagcagcgacggaggaagtagctattacggaggagatgagtataacggttactacagtcagagtagcgttgccaaggaagatgatgggagtccgaagaagacgtttaggagatctgggaatggtaagttgactgctgaggctgtgacggatgcgatcaatagagcgtctcagggattaccatttgaggtggtgttttatccggctgctggatggtctgagtttgttgtgagagctgaagatgttgagtcttcaatgtctatgtattggactcctgggactcgagtcaagatggctatggagactgaagattcttctcggatcacatggtttcaaggcatcgtttcctctacttatcaggagaccggtccatggcgtggatctccatggaagcagcttcagatcacatgggatgaacctgagattctgcaaaacgtgaagagggtgaatccatggcaagtggaaattgctgcacatgcaactcaactgcatacccctttccctccagcaaagaggttgaagtatccacaacccggaggagggttcttgagtggagatgatggagaaatcctttatcctcaaagtggactgtctagtgcagcagcacctgatccaagtccttctatgttctcgtattctacatttcctgctggcatgcagggagccaggcaatatgattttgggtctttcaatccaaccggattcattggaggaaatcctccccagctattcaccaataacttcttaagtccgcttcctgatttgggaaaagtgtcgactgagatgatgaactttggcagtccgccatcagataacttatcgcctaatagcaacaccactaatctgtcctctggaaatgacctggttggaaaccgaggccccctttcaaagaaagttaactcgattcagttgtttggcaagatcattaccgtggaggagcattctgagagcggtcctgcagagtctggcttgtgtgaagaggatggcagcaaagagtccagcgacaatgagacacagttgtccttatcacatgctcctccaagcgtgcctaaacattccaacagcaacgcaggttctagctcccaaggtatattccgatctctctcaagtacaataatcaattga

SEQ ID NO: 1486 - protein, 596 aa, Arabidopsis thaliana
  G2372,ARF domain coordinates 18-378
MSPPSATAGDINHREVDPTIWRACAGASVQIPVLHSRVYYFPQGHVEHCCPLLSTLPSSTSPVPCIITSIQLLADPVTDEVFAHLILQPMTQQQFTPTNYSRFGRFDGDVDDNNKVTTFAKILTPSDANNGGGFSVPRFCADSVFPLLNFQIDPPVQKLYVTDIHGAVWDFRHIYRGTPRRHLLTTGWSKFVNSKKLIAGDSVVFMRKSADEMFIGVRRTPISSSDGGSSYYGGDEYNGYYSQSSVAKEDDGSPKKTFRRSGNGKLTAEAVTDAINRASQGLPFEVVFYPAAGWSEFVVRAEDVESSMSMYWTPGTRVKMAMETEDSSRITWFQGIVSSTYQETGPWRGSPWKQLQITWDEPEILQNVKRVNPWQVEIAAHATQLHTPFPPAKRLKYPQPGGGFLSGDDGEILYPQSGLSSAAAPDPSPSMFSYSTFPAGMQGARQYDFGSFNPTGFIGGNPPQLFTNNFLSPLPDLGKVSTEMMNFGSPPSDNLSPNSNTTNLSSGNDLVGNRGPLSKKVNSIQLFGKIITVEEHSESGPAESGLCEEDGSKESSDNETQLSLSHAPPSVPKHSNSNAGSSSQGIFRSLSSTIIN

SEQ ID NO: 1487 - DNA, 1263 bp, Arabidopsis thaliana
  G2373,family:TH
gcaaaatcctcagatcgtcttaccttctccgaatcgatcgatttttcatggaggacgacgacgagattcagtcaattccatctccgggagattcttccctttcaccacaagctcctccttctccgccgattttgccaacaaacgacgtgacggtggccgtcgtgaagaaaccacaaccggggctttcttctcaatctccgtccatgaacgctttagcgttagtggttcatactccttctgtaaccggtggtggtggtagcggaaacagaaacggacgaggaggaggaggaggaagcggtggtggtggaggaggaagagatgattgttggagcgaagaagctacaaaggttctaatcgaagcttggggagatcgattctctgaaccaggtaaaggaactttgaagcaacaacattggaaagaagtagctgagattgtgaacaagagtcgtcaatgcaaataccctaaaactgatattcagtgtaagaacagaattgatacggtgaagaagaagtataagcaagagaaagctaagattgcttctggtgatggacctagtaaatgggttttcttcaagaagcttgagagtttgattggtggtactacaacattcattgcttcttcaaaagcttcagagaaggctcctatgggaggagctcttgggaatagccgttcgagtatgtttaaacggcaaactaaaggtaatcagattgtgcagcaacaacaagagaagagaggctctgattcgatgcggtggcattttaggaaacgtagtgcttctgagactgagtctgagtctgatcctgaacctgaggcttctcctgaggaatctgctgagagtctcccacctttgcaaccgattcaaccgctttcgtttcatatgccaaagcggttgaaggtggataagagtggaggtggagggagtggagttggagatgtggcgagggcgatacttggatttacggaagcttatgagaaggcggaaactgctaagcttaagttaatggcggaactggaaaaggagaggatgaaatttgctaaagagatggagttgcagagaatgcagttcttgaaaactcaattggagataacacagaacaatcaagaagaggaagagaggagcaggcagcgaggagaaaggaggatcgttgatgatgatgatgatcgcaatggcaagaataacggcaatgtaagtagctgacaattgaacacacaaatgttcctatgatatttgctatgataagctggattttaggttttgatgg

SEQ ID NO: 1488 - protein, 383 aa, Arabidopsis thaliana
  G2373,TH domain coordinates 290-350
MEDDDEIQSIPSPGDSSLSPQAPPSPPILPTNDVTVAVVKKPQPGLSSQSPSMNALALVVHTPSVTGGGGSGNRNGRGGGGGSGGGGGGRDDCWSEEATKVLIEAWGDRFSEPGKGTLKQQHWKEVAEIVNKSRQCKYPKTDIQCKNRIDTVKKKYKQEKAKIASGDGPSKWVFFKKLESLIGGTTTFIASSKASEKAPMGGALGNSRSSMFKRQTKGNQIVQQQQEKRGSDSMRWHFRKRSASETESESDPEPEASPEESAESLPPLQPIQPLSFHMPKRLKVDKSGGGGSGVGDVARAILGFTEAYEKAETAKLKLMAELEKERMKFAKEMELQRMQFLKTQLEITQNNQEEEERSRQRGERRIVDDDDDRNGKNNGNVSS

SEQ ID NO: 1489 - DNA, 1231 bp, Arabidopsis thaliana
  G2375,family:TH
ctcttctttttttcaatgaaacctctcttcatttataagtaacccaacaaaaaaataaaattatctccctcttatttcttctcttcacgtcacaaagacaattcgattccaaataatggaccgacgtaaccctttccaacatcaccaccaccaccatcagcttcatcatcacttgatccaacagcaacagcttcctccgccgccgctgagcaccacggcgacgatggatcccggcggaggaggaggaggtggggagagaatcccacagtggagcatagaggagacaaaggagcttttggctataagagaagaacttgatcaaactttcatggagaccaaacgtaataagcttctttgggaagtcgtggctgctaagatggccgacaagggttttgtccgaagcgcagaacaatgtaagagcaagtggaagaacctcgtcactagatacaaggcgtgtgagaccactgagccagatgctattaggcagcagttcccattctacaatgagattcagtcgatttttgaagcaagaatgcaaagaatgctgtggtcagaagccacagaaccaagcacttcctcgaagagaaaacatcatcaattttcatctgatgatgaagaagaagaagttgacgaaccaaatcaagatatcaacgaggaattattgtctttagtagagacacagaaaagagagacagaagtgattactactagtacttcgaccaatccaagaaaacgtgcaaaaaaaggaaaaggcgttgcgagtggtacgaaagctgaaactgcgggtaatacactaaaagatatattggaggagtttatgaggcaaacggtgaagatggaaaaggaatggagagatgcatgggagatgaaggagatagagagggagaagagagagaaagagtggcggaggagaatggcggagctagaggaggaaagagccgccacagaaaggaggtggatggagagagaggaagagagacggttgagagaagaagctagggctcagaagagagattctctcatcgatgctttgcttaataggcttaatagagatcataatgatgatcatcataatcaaggtttctaagttctcattatttgtgttaagcataagttaattagctagttaatttgttaggcaaatcaatttagataatatatctaaattaatgtttgttttataatatttatatgaactattgaaatttccaaaacaaaaaaaaaaaaaaaa

SEQ ID NO: 1490 - protein, 323 aa, Arabidopsis thaliana
  G2375,TH domain coordinates 51-148
MDRRNPFQHHHHHHQLHHHLIQQQQLPPPPLSTTATMDPGGGGGGGERIPQWSIEETKELLAIREELDQTFMETKRNKLLWEVVAAKMADKGFVRSAEQCKSKWKNLVTRYKACETTEPDAIRQQFPFYNEIQSIFEARMQRMLWSEATEPSTSSKRKHHQFSSDDEEEEVDEPNQDINEELLSLVETQKRETEVITTSTSTNPRKRAKKGKGVASGTKAETAGNTLKDILEEFMRQTVKMEKEWRDAWEMKEIEREKREKEWRRRMAELEEERAATERRWMEREEERRLREEARAQKRDSLIDALLNRLNRDHNDDHHNQGF

SEQ ID NO: 1491 - DNA, 799 bp, Arabidopsis thaliana
  G2379,family:TH
cgccgtcactctcctcccggtgccgcacattagcaacactactcccgacgaatggagacgacgacgccgcagtcaaaatcaagtgtgtcccaccgaccgccgttgggaagagaagactggtggagtgaggaagcgacggcgacgctggtagaagcctggggcaatcgttacgtcaagctgaaccacggaaatctccggcagaatgactggaaagacgtcgccgacgccgttaactctagacacggtgataacagccgtaagaagaccgacttacagtgtaagaaccgggtcgatactttgaagaagaagtacaaaacagagaaagctaaactctcgccgtcgacttggcgtttctataaccgcctcgatgttctaatcggtcccgttgtgaagaaatcggctggcggagttgtcaaatcagcgccttttaagaatcatctgaatccaactggatcgaactctactggaagctctcttgaagatgatgatgaggatgatgatgaggttggtgattgggaattcgttgctaggaagcatcctcgtgtggaagaggtagatctgagtgaaggatcaacgtgtagggaactagctacggcgattctcaagtttggagaagtttacgagagaattgaagggaagaagcaacagatgatgattgagttggagaagcagagaatggaagtgacaaaggaggtagagttaaaacgaatgaacatgttgatggagatgcagttagagattgagaaatcaaagcaccggaaacgcgcaagtgcttcaggtaagaagaactcacattagg

SEQ ID NO: 1492 - protein, 248 aa, Arabidopsis thaliana
  G2379,TH domain coordinates 19-110,173-232
METTTPQSKSSVSHRPPLGREDWWSEEATATLVEAWGNRYVKLNHGNLRQNDWKDVADAVNSRHGDNSRKKTDLQCKNRVDTLKKKYKTEKAKLSPSTWRFYNRLDVLIGPVVKKSAGGVVKSAPFKNHLNPTGSNSTGSSLEDDDEDDDEVGDWEFVARKHPRVEEVDLSEGSTCRELATAILKFGEVYERIEGKKQQMMIELEKQRMEVTKEVELKRMNMLMEMQLEIEKSKHRKRASASGKKNSH

SEQ ID NO: 1493 - DNA, 1330 bp, Arabidopsis thaliana
  G2382,family:TH
ccctccaagatattcctctattaggtgcaaaaatcaggtaaatctctatctgtccgatttgaaaccctagatctgcctttcttctctcttcttttgcttttctgggttttgctcaaagatgggtgacagcgaagatgaaacaggatacccaaaaaagttttactctttgaatcggcaaaaccatccaatgtatagtagaccaatacctaagcgtcacgcgtattacaatgaagaagaagacgaagatgaagtcgaaggagaagaggaagatccacaaggaggatacattcgtggaaatgagaggtttcagaagagacagaaaccaaacaaagtagtttctgggtttgaatttgctggtcctagtgatgctaaagttgcgtatgattggagagagcaagaagcttttgtgttgcttgaagtttggggagataggtttttgcaattgggtagaaggagtttgaggaacgaggattggaatgaagtagctgagaaagtgagtgaggagctaaggatggagaaatctgagacgcaatgtaggagaatgattgatgacttgaagaggaagtatagaaaagagaagattaaggttgagaaatcaggtttaggttcaagtaaatggtcgtttttcaataagttggatatgttgctttgtgtttcgcccaagtcggatttaggtttagcttgtggtgttgattcaggtgagtttgtgtttatgaacactaaggtttatttagataagtctaatgggtttgatgagatgatggatagtcctggtgattctgaagaggaggaggatgaggatgatgaggttgagtacgagaggaagaaggttaatgacgctgcttcgtataagatgttggcggattctgttgagaggtttgggaaggtttatgagaagatggagaagagtaagaaagagcaaatgaaggagttggagaagatgagagctgattttcagagagatttggagttgcagaagaagcagattgttgatagagctcagagtgagattgctaggttacgtgaagaggaggagaatcatcatggtggtggtgatgatgatgagagtgaagatgaagaaatggagaatgattctgatgttaatctcagtgatgagtaagttataaactatgtaggtttgtgttgtttgtagatgcaacaaaatatgttctgtttttttttttggttttagggaattcagaacttaagtcttataagttttgtaatttgtgtttggtctttgcaactttagtcgaggttatttgcagtttatcttgaaacttaaattaatgcataaacatatttccttcttaaaaaaaaaaaaaaaaaa

SEQ ID NO: 1494 - protein, 333 aa, Arabidopsis thaliana
  G2382,TH domain coordinates 90-177,246-333
MGDSEDETGYPKKFYSLNRQNHPMYSRPIPKRHAYYNEEEDEDEVEGEEEDPQGGYIRGNERFQKRQKPNKVVSGFEFAGPSDAKVAYDWREQEAFVLLEVWGDRFLQLGRRSLRNEDWNEVAEKVSEELRMEKSETQCRRMIDDLKRKYRKEKIKVEKSGLGSSKWSFFNKLDMLLCVSPKSDLGLACGVDSGEFVFMNTKVYLDKSNGFDEMMDSPGDSEEEEDEDDEVEYERKKVNDAASYKMLADSVERFGKVYEKMEKSKKEQMKELEKMRADFQRDLELQKKQIVDRAQSEIARLREEEENHHGGGDDDESEDEEMENDSDVNLSDE

SEQ ID NO: 1495 - DNA, 1050 bp, Arabidopsis thaliana
  G2383,family:TEO
gacctctttgatcccttcattccccatcaaacaaccatgtttccttctttcattactcacattcaaagccctaattctcaccatcactactcttcgccttcttttcctttctcttccgattttcttgagagttttgatgaatccttcttgataaaccaattcttgttacagcagcaagatgtagcagcaaatgttgttgaatctccttggaaattttgcaagaagcttgagcttaagaagaagaatgagaagtgtgttgatggaagcacctcacaagaggttcaatggagaaggacggtcaaaaaaagggacaggcatagtaagatctgcacggctcaaggtcctagagaccggaggatgaggctgtctcttcagattgctcgcaagtttttcgatcttcaagacatgttgggtttcgacaaggcgagcaagacgattgaatggcttttctccaaatcaaagacttccatcaaacaacttaaagaaagagtggctgcatcggaaggaggaggaaaggatgaacatctccaggttgatgaaaaggaaaaggatgagacactgaagttgagagtctcaaagagaagaacaaagactatggagagctcttttaagactaaagagtcgagagagagagctagaaagcgagcaagagagagaacaatggcaaagatgaagatgagattatttgagacctcggaaacaatttcagatcctcatcaagaaactagagagatcaagataaccaatggtgtacaattactagaaaaggaaaataaagaacaagaatggagtaatactaatgatgttcacatggtagagtatcaaatggattctgtgagcatcatagagaagtttcttggactaaccagtgactctagctcctcttccatttttggtgactccgaggaatgttacacaagtcttagttcagtaagaggtacaatttcagcagcaggtaacagcaatgtgttaactaaaaaccctaattgagtaatgcagttttgattaatattagctttttggtaattccaggaatgtcgacaccaaggg

SEQ ID NO: 1496 - protein, 317 aa, Arabidopsis thaliana
  G2383,TEO domain coordinates 89-149
MFPSFITHIQSPNSHHHYSSPSFPFSSDFLESFDESFLINQFLLQQQDVAANVVESPWKFCKKLELKKKNEKCVDGSTSQEVQWRRTVKKRDRHSKICTAQGPRDRRMRLSLQIARKFFDLQDMLGFDKASKTIEWLFSKSKTSIKQLKERVAASEGGGKDEHLQVDEKEKDETLKLRVSKRRTKTMESSFKTKESRERARKRARERTMAKMKMRLFETSETISDPHQETREIKITNGVQLLEKENKEQEWSNTNDVHMVEYQMDSVSIIEKFLGLTSDSSSSSIFGDSEECYTSLSSVRGTISAAGNSNVLTKNPN

SEQ ID NO: 1497 - DNA, 1370 bp, Arabidopsis thaliana
  G2394,family:RING/C3H2C3
gcggttgtgtgttacgagagctagagttgaatttgctttggtcaacacaatggggacttgtggttgctgacttttgtgattttcagttttctacttggatttagatggatgtttcttccattgtgcgaaatacaaccctaactgatcaagatcctttgttaatggaccacggtaaccgcgagcacatcgttgacattacaagcaatgacgaggaggactcttcatcaagatcttctctcgatgagcttactcctcaaggtaactcacatcaaggtgaagagacagtattatcatcatcaaatgctacacaacaacacccaactcatccatctcctcctcagcaaagaccaacttcttctaggagaggagataacgggaatggtcgccgtactaggagtccattgaattctggcctctggatctcagttgagttagttgtcactgtcgctcagattgttgcagccattgtagttatggttctggctaaagatgaacatcctgaagcgccattatttacttgggttattggatatacttgtggctgtctagccactctccctattctctattggcgttttcgcacttataatcgagctacagggcaagactcttcacaacgtgctacctcttctcaaggcaatagtgagtccacaccatatacagcagtctcagttgctcaagcagcagatgaagaaaatagcactggcgtgagtgcagcacctagaaacaatcaagttggggaaagcttaagaacaaggctcaacgggctagtggaccacttcaagatggcgattgattgtttctttgcggtgtggtttgttgtggggaatgtatggatatttggaggtcactcatctccttctgattctcctaaactgtacaggttatgcatagcgttccttactttcagttgcattggatatgcaatgccattcatactatgtgcaaccatatgttgttgtttgccttgcttaatctcggttctcggatttcgagagaacttctcacaaactagaggagccactgccgaggccatcaacgcattgcctgtctacaggttcaaatcaaaaagtagaaatgatttggagttttcagaagaaggtgaaggtggatttcttctcttggggtctcagaagaaacgtcttatatcaggcgaggatgccagctgttgcatctgcttgactagatatggagacgacgaacaagttagagagctgccatgctcacatgtcttccatgtagactgtgtagacaaatggcttaaaatcaatgcgacttgccctctctgcaaaaatgaggttggagaaagcagcagtgcttcctcatagacaaaagctgagttgatcgcaactgtttggaatttgggatcc

SEQ ID NO: 1498 - protein, 407 aa, Arabidopsis thaliana
  G2394,RING/C3H2C3 domain coordinates 355-395
MDVSSIVRNTTLTDQDPLLMDHGNREHIVDITSNDEEDSSSRSSLDELTPQGNSHQGEETVLSSSNATQQHPTHPSPPQQRPTSSRRGDNGNGRRTRSPLNSGLWISVELVVTVAQIVAAIVVMVLAKDEHPEAPLFTWVIGYTCGCLATLPILYWRFRTYNRATGQDSSQRATSSQGNSESTPYTAVSVAQAADEENSTGVSAAPRNNQVGESLRTRLNGLVDHFKMAIDCFFAVWFVVGNVWIFGGHSSPSDSPKLYRLCIAFLTFSCIGYAMPFILCATICCCLPCLISVLGFRENFSQTRGATAEAINALPVYRFKSKSRNDLEFSEEGEGGFLLLGSQKKRLISGEDASCCICLTRYGDDEQVRELPCSHVFHVDCVDKWLKINATCPLCKNEVGESSSASS

SEQ ID NO: 1499 - DNA, 1154 bp, Arabidopsis thaliana
  G2404,family:RING/C3H2C3
aagaacacaatgccagtttctgcagagccttcttcatcttcttcaacaacaatcggtcaacacatgagactccaacgacctaggaatcatcgaaatctcccacccatttccaccgccgacgaacctctaatccccaaacctagccgcgtctctaaatccgccatgtcttccttcttcctcttgccagaaactactaagaagaaacccaacggaacggcgtcgtttcgtggtctaggctgcacaacctccgcatctcagcaagtttcagtcccggcagtgattcgctcctccgcggattgggatgctagtaatttcaaaattaagaagacgaagaagaagaacaagaacaagggtagtagtagctacaatggtggttcgattaagatcttgagcgaagctagtactagtagtagcgtcgcttgcgcagcgattcctgatgtttggtgtggtcctggagttgggttttcaacggatgctgtcgtcggaggctccattgacacagttgtttcagatcctccgagaaggaatattccggtgagacgcaaaatcgatggagataaaaccaatagtaacagtaataatcatagagagggttcttcttctcttcttcctagacgatctctcaatcaagagtctaatccttattttgattctgattcgagttttttgacatcgcgggctgagcagactgatagatatcatcgtcatctaagactgccttaccctgatggactcgctgagatgatgatgatgcagaatggttttgtgatgggaggagtattaagctcattcgatcaattccgtgacatgaggctcaatgtcgataacatgacatacgagcaacttttggagcttggtgaaagaattgggcatgtgaacactggacttactgaaaaacagatcaaaagttgtcttcggaaagtcaaaccatgccggcaagatacaacagttgctgatagaaagtgcatcatctgtcaagacgagtatgaggcgaaggacgaggtaggggaattacgatgtgggcacaggttccatatcgactgtgtgaatcaatggcttgtgaggaagaactcttgtccggtctgtaaaacgatggcgtacaataagtcttagttagatattatctcttcctgtgatgtgattcttgatttcgg

SEQ ID NO: 1500 - protein, 367 aa, Arabidopsis thaliana
  G2404,RING/C3H2C3 domain coordinates 319-359
MPVSAEPSSSSSTTIGQHMRLQRPRNHRNLPPISTADEPLIPKPSRVSKSAMSSFFLLPETTKKKPNGTASFRGLGCTTSASQQVSVPAVIRSSADWDASNFKIKKTKKKNKNKGSSSYNGGSIKILSEASTSSSVACAAIPDVWCGPGVGFSTDAVVGGSIDTVVSDPPRRNIPVRRKIDGDKTNSNSNNHREGSSSLLPRRSLNQESNPYFDSDSSFLTSRAEQTDRYHRHLRLPYPDGLAEMMMMQNGFVMGGVLSSFDQFRDMRLNVDNMTYEQLLELGERIGHVNTGLTEKQIKSCLRKVKPCRQDTTVADRKCIICQDEYEAKDEVGELRCGHRFHIDCVNQWLVRKNSCPVCKTMAYNKS

SEQ ID NO: 1501 - DNA, 1409 bp, Arabidopsis thaliana
  G2417,family:GARP
cataccggtggaagattctgctttactacgctctccgcttcttcttctcctcgattcgattctcctcatgggtttatcatgaatttttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatgaagcaactcctaaaggtgtcctgaagcatatgaaagtcgaaggtttgactatttttcatgtcaaaagtcatttgcagaaatatagaacagctaaatatataccagtaccatcagaaggttcgccggaggcaaggttgacaccgcttgagcaaattacatctgatgatacgaaacgtgggatagatatcactgagactctgcgaattcagatggaacatcagaagaaactgcatgagcagcttgagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcaggc

SEQ ID NO: 1502 - protein, 397 aa, Arabidopsis thaliana
  G2417,GARP domain coordinates 235-285
MIPNDDDDANSMKNYPLNDDDANSMKNYPLNDDDANSMENYPLRSIPTELSHTCSLIPPSLPNPSEAAADMSFNSELNQIMARPCDMLPANGGAVGHNPFLEPGFNCPETTDWIPSPLPHIYFPSGSPNLIMEDGVIDEIHKQSDLPLWYDDLITTDEDPLMSSILGDLLLDTNFNSASKVQQPSMQSQIQQPQAVLQQPSSCVELRPLDRTVSSNSNNNSNSNNAAAAAKGRMRWTPELHEVFVDAVNQLGGSNEATPKGVLKHMKVEGLTIFHVKSHLQKYRTAKYIPVPSEGSPEARLTPLEQITSDDTKRGIDITETLRIQMEHQKKLHEQLESLRTMQLRIEEQGKALLMMIEKQNMGFGGPEQGEKTSAKTPENGSEESESPRPKRPRNEE

SEQ ID NO: 1503 - DNA, 972 bp, Arabidopsis thaliana
  G2423,family:MYB-(R1)R2R3
atggatgaaaaaggaagaagcttgaagaacaacaacatggaagacgagatggacctaaagagaggtccgtggactgctgaagaagattttaagctcatgaattacattgctactaatggagaaggtcgctggaactctctttctcgttgcgccggcctccaacgcaccggtaaaagctgtagactaaggtggttaaactatctccgccctgacgtccgccgtggaaacattacacttgaagaacaactcttgatcctcgaacttcattcccgttggggaaatagatggtcaaaaatcgcacaatatttaccgggaagaacggacaacgagatcaagaactactggaggacgcgggtgcaaaagcatgcgaaacagttgaaatgtgatgtgaatagccaacaattcaaagacacaatgaagtacttgtggatgcctcgactagtcgagaggattcagtcagcctcggcctcatccgcagcagcagccaccaccacaaccaccaccaccacaggatcagccggcacgtcatcttgcatcacaacctctaacaatcaattcatgaattacgactacaacaacaacaacatgggacaacagtttggtgtaatgagcaacaatgattatatcacgcctgaaaattccagcgtggcagtgtctccggcgtcagacttaacggagtactacagcgctccaaaccctaacccggaatactattcgggtcaaatggggaatagttattatccagatcagaatttagtgagttcacaattattaccggataattatttcgactatagtggattattagacgaagatctaacggctatgcaagagcagagtaacctcagctggtttgaaaacattaatggtgctgcttcttcttcagacagtttatggaacattggagaaactgatgaagaattctggttcttacagcagcaacaacagttcaacaataatggtagcttctga

SEQ ID NO: 1504 - protein, 323 aa, Arabidopsis thaliana
  G2423,MYB-(R1)R2R3 domain coordinates 20-122
MDEKGRSLKNNNMEDEMDLKRGPWTAEEDFKLMNYIATNGEGRWNSLSRCAGLQRTGKSCRLRWLNYLRPDVRRGNITLEEQLLILELHSRWGNRWSKIAQYLPGRTDNEIKNYWRTRVQKHAKQLKCDVNSQQFKDTMKYLWMPRLVERIQSASASSAAAATTTTTTTTGSAGTSSCITTSNNQFMNYDYNNNNMGQQFGVMSNNDYITPENSSVAVSPASDLTEYYSAPNPNPEYYSGQMGNSYYPDQNLVSSQLLPDNYFDYSGLLDEDLTAMQEQSNLSWFENINGAASSSDSLWNIGETDEEFWFLQQQQQFNNNGSF

SEQ ID NO: 1505 - DNA, 816 bp, Arabidopsis thaliana
  G2425,family:MYB-(R1)R2R3
atggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaagaagaagaaatcatcaaataccatgctcttcttggaaacaggtgggcagcaatagctaagcaaatgccaaacagaacagataatgacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacggtgtgtacgtatctgatttctacgatgagactgaacaccttgacctgttccttctttga

SEQ ID NO: 1506 - protein, 271 aa, Arabidopsis thaliana
  G2425,MYB-(R1)R2R3 domain coordinates 12-119
MGRTTWFDVDGLRKGEWTAEEDRKLVVYINEHGLGEWGSLPKRAGLQRCGKSCRLRWLNYLRPGIKRGKFTPQEEEEIIKYHALLGNRWAAIAKQMPNRTDNDIKNHWNSCLKKRLAKKGIDPMTHEPTTTTSLTVDVTSSSTTSSPTPSPTSSSFSSCSSTGSARFLNKLAAGISSRKHGLESIKTVILAEQPREAVDEEKMMTINMKEKELISCYMEIDETMSIDELPCDDSTSGFVAFDDYSLIDPYRDGVYVSDFYDETEHLDLFLL

SEQ ID NO: 1507 - DNA, 1997 bp, Arabidopsis thaliana
  G2430,family:GARP
aacttcaacatacacataatctctcacttaaaaatatctctctctctctctctacaaaatcaattccaatgttggtgggaaagataagtggatatgaagataatactcgctctttggagcgagaaacatctgaaatcacttctcttctcagccaatttccggggaatactaatgtccttgttgttgacaccaatttcaccactctactcaacatgaaacaaatcatgaaacaatacgcttatcaagtgtctattgagacagatgcagaaaaagctcttgcgtttttgacaagctgcaaacatgaaatcaatattgtgatttgggattttcatatgcctggaattgatggacttcaagctctcaagagcattacttcaaagttggatttacctgtagtgattatgtctgatgataatcaaacggaatctgtgatgaaagcaacattttacggtgcttgtgactatgttgtgaaaccggttaaagaagaggtaatggccaatatatggcaacacattgtacggaagaggctgatctttaaaccggatgttgctccaccggttcaatcagatccggctcgctctgaccgtttagaccaagtcaaagctgatttcaagatcgtagaagatgaaccaataatcaatgagacaccgctgatcacatggaccgaagaaattcaaccggttcagtcagatctggttcaagccaacaagttcgaccaagtgaatggctattccccaatcatgaaccaagataacatgttcaacaaagcaccacctaaaccgcgaatgacgtggacagaagttattcaaccggttcaatcaaatctggttcaaacaaaagagttcggccaactcaatgactattcccaaatcatgaaccaagatagcatgtacaacaaagcagcaaccaaaccacaattgacgtggaccgaagaaattcaaccggttcaatcaggtctggttcaagccaacgagttcagcaaagtgaatggatattcccaaagcatgaaccaagatagcatgttcaacaaatcagcaaccaacccgcgattgacatggaacgaattacttcaaccggttcaatcagatctggttcaatccaatgagtttagccaattcagtgactattctcaaatcatgaacgaagataacatgttcaacaaagcagcaaagaaaccgcggatgacatggagtgaagtatttcaaccggttcaatcacatctggttccgactgacggtttagaccgagaccactttgattccataaccataaacggaggtaacggcatacaaaacatggaaaagaaacaaggaaaaaaaccacggaagccgcggatgacgtggaccgaagagcttcaccaaaaatttctggaagccatcgaaataattggtggtatcgaaaaagctaacccaaaggtacttgtcgaatgcttgcaagaaatgaggatagaaggaattactagaagcaatgtggcaagtcatcttcagaaacaccgtatcaatcttgaagaaaaccaaattcctcaacaaacacaagggaatggttgggccactgcgtatggtacactagctccctctctccaaggttcagacaatgtcaacacaacaataccatcgtaccttatgaatggtccagccactttgaaccaaatccagcagaatcaatatcaaaatggtttcttgacaatgaacaacaaccagatcataaccaatcctccgcctcctttgccctatttggaccatcatcaccaacagcaacatcagtcttctcctcaatttaattacctgatgaacaatgaagaacttcttcaagcctctggcctctctgcgacagatcttgaactcacttatccaagtttaccatatgatccacaagagtatctaatcaatggctacaattataattagtcatatagcccttctctttacttaaggcagtctatgtatgacaaataatatgcgacttcccttgtgagtcacaatattgtttcattattc

SEQ ID NO: 1508 - protein, 612 aa, Arabidopsis thaliana
  G2430,GARP domain coordinates 425-478
MLVGKISGYEDNTRSLERETSEITSLLSQFPGNTNVLVVDTNFTTLLNMKQIMKQYAYQVSIETDAEKALAFLTSCKHEINIVIWDFHMPGIDGLQALKSITSKLDLPVVIMSDDNQTESVMKATFYGACDYVVKPVKEEVMANIWQHIVRKRLIFKPDVAPPVQSDPARSDRLDQVKADFKIVEDEPIINETPLITWTEEIQPVQSDLVQANKFDQVNGYSPIMNQDNMFNKAPPKPRMTWTEVIQPVQSNLVQTKEFGQLNDYSQIMNQDSMYNKAATKPQLTWTEEIQPVQSGLVQANEFSKVNGYSQSMNQDSMFNKSATNPRLTWNELLQPVQSDLVQSNEFSQFSDYSQIMNEDNMFNKAAKKPRMTWSEVFQPVQSHLVPTDGLDRDHFDSITINGGNGIQNMEKKQGKKPRKPRMTWTEELHQKFLEAIEIIGGIEKANPKVLVECLQEMRIEGITRSNVASHLQKHRINLEENQIPQQTQGNGWATAYGTLAPSLQGSDNVNTTIPSYLMNGPATLNQIQQNQYQNGFLTMNNNQIITNPPPPLPYLDHHHQQQHQSSPQFNYLMNNEELLQASGLSATDLELTYPSLPYDPQEYLINGYNYN

SEQ ID NO: 1509 - DNA, 528 bp, Arabidopsis thaliana
  G2432,family:Z-Dof
atggcgacccaagattctcaagggattaaactctttggcaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaa

SEQ ID NO: 1510 - protein, 175 aa, Arabidopsis thaliana
  G2432,Z-Dof domain coordinates 64-106
MATQDSQGIKLFGKTITFNANITQTIKKEEQQQQQQPELQATTAVRSPSSDLTAEKRPDKIIPCPRCKSMETKFCYFNNYNVNQPRHFCKGCQRYWTAGGALRNVPVGAGRRKSKPPGRVGGFAELLGAATGAVDQVELDALLVEEWRAATASHGGFRHDFPVKRLRCYTDGQSC

SEQ ID NO: 1511 - DNA, 1044 bp, Arabidopsis thaliana
  G2436,family:Z-CO-like
atgttgaaagaagagagtaatgagagtggtacttgggcacgagcatgtgacacttgtcgttcagccgcctgcactgtctactgtgaagccgactctgcctacttgtgcaccacctgtgatgctcgagttcacgcagccaaccgtgttgcttctcgccatgaacgtgttcgtgtctgtcagtcatgtgagtctgccccagctgcgtttttgtgtaaagcagacgctgcgtctctttgtacagcttgtgatgcagagattcattccgcaaacccactagctagacgtcatcagcgagttccgattcttccattatctgcaaactcttgcagctccatggccccaagtgagactgatgctgataacgatgaggatgatcgagaggttgcttcgtggttactccctaatccagggaaaaacatcggtaatcagaataatgggttcttgtttggtgttgagtaccttgatcttgtggattacagctccagcatggacaaccaattcgaagataatcagtacactcactaccagaggagctttggaggagatggagttgtgccgcttcaagttgaagaatcaacaagtcacctgcaacaaagccaacaaaactttcagttgggtatcaactatggattctcctcaggagctcactacaacaacaactccttaaaggacctaaaccatagcgcatccgtttcatcaatggacatcagtgttgtgccagagtcaactgcaagtgacataacagtccaacacccaagaactactaaagagacgatagaccaactatctggtcctcctactcaggtggtgcaacagcttactccaatggagagggaggctagggtcctgagatacagagagaagaagaagacaaggaaatttgacaagacaataagatatgcttcaagaaaggcatatgcagagataagaccacggatcaagggcagattcgcaaagaggatagaaactgaagctgaggctgaagaaatcttctcaacatcgctaatgtctgagactggatatggaattgtcccttccttctaa

SEQ ID NO: 1512 - protein, 347 aa, Arabidopsis thaliana
  G2436,Z-CO-like domain coordinates 16-111
MLKEESNESGTWARACDTCRSAACTVYCEADSAYLCTTCDARVHAANRVASRHERVRVCQSCESAPAAFLCKADAASLCTACDAEIHSANPLARRHQRVPILPLSANSCSSMAPSETDADNDEDDREVASWLLPNPGKNIGNQNNGFLFGVEYLDLVDYSSSMDNQFEDNQYTHYQRSFGGDGVVPLQVEESTSHLQQSQQNFQLGINYGFSSGAHYNNNSLKDLNHSASVSSMDISVVPESTASDITVQHPRTTKETIDQLSGPPTQVVQQLTPMEREARVLRYREKKKTRKFDKTIRYASRKAYAEIRPRIKGRFAKRIETEAEAEEIFSTSLMSETGYGIVPSF

SEQ ID NO: 1513 - DNA, 1122 bp, Arabidopsis thaliana
  G2443,family:Z-CO-like
atgttgaaacaagagagtaacgacataggtagtggagagaacaacagggcacgaccctgtgacacatgccggtcaaacgcctgcaccgtgtattgccatgcagattctgcctacttgtgcatgagctgtgatgctcaagttcactctgccaatcgcgttgcttcccgccataaacgtgtccgggtctgcgagtcatgtgagcgtgctccggctgcttttttgtgtgaggcagatgatgcctctctatgcacagcctgtgattcagaggttcattctgcaaacccacttgctagacgccatcagcgagttccaattctaccaatttctggaaactctttcagctccatgaccactactcaccaccaaagcgagaaaacaatgaccgatccagagaagagactggtggtggatcaagaggaaggtgaagaaggtgataaggatgccaaggaggttgcttcgtggctgttccctaattcagacaaaaataacaataaccaaaacaatgggttattgtttagtgatgagtatctaaaccttgtggattacaactcgagtatggactacaaattcacaggtgaatacagtcaacaccaacaaaactgcagcgtaccacagacgagctacgggggagatagagttgttccgcttaaacttgaagaatcaaggggccaccagtgccataaccaacagaattttcagttcaatatcaaatatggctcctcagggactcactacaacgacaatggttccattaaccataacgcatacatttcatccatggaaactggtgttgtgccggagtcaacagcatgtgtcacaacagcttcacacccaagaacgcccaaagggacagtagagcaacaacctgaccctgcaagccagatgataacagtaacacaactcagtccaatggacagagaagccagggtcctgagatacagagagaagaggaagacaaggaaatttgagaagacaataaggtatgcttcgaggaaggcatatgcagagataagaccgcgggtcaatggccggttcgcaaagagagaaatcgaagccgaggagcaagggttcaacacgatgctaatgtacaacacaggatatgggattgttccttcattctga

SEQ ID NO: 1514 - protein, 373 aa, Arabidopsis thaliana
  G2443,Z-CO-like domain coordinates 20-86
MLKQESNDIGSGENNRARPCDTCRSNACTVYCHADSAYLCMSCDAQVHSANRVASRHKRVRVCESCERAPAAFLCEADDASLCTACDSEVHSANPLARRHQRVPILPISGNSFSSMTTTHHQSEKTMTDPEKRLVVDQEEGEEGDKDAKEVASWLFPNSDKNNNNQNNGLLFSDEYLNLVDYNSSMDYKFTGEYSQHQQNCSVPQTSYGGDRVVPLKLEESRGHQCHNQQNFQFNIKYGSSGTHYNDNGSINHNAYISSMETGVVPESTACVTTASHPRTPKGTVEQQPDPASQMITVTQLSPMDREARVLRYREKRKTRKFEKTIRYASRKAYAEIRPRVNGRFAKREIEAEEQGFNTMLMYNTGYGIVPSF

SEQ ID NO: 1515 - DNA, 804 bp, Arabidopsis thaliana
  G2452,family:MYB-related
atgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaa

SEQ ID NO: 1516 - protein, 267 aa, Arabidopsis thaliana
  G2452,MYB-related domain coordinates 28-79,146-194
MSSSTMYRGVNMFSPANTNWIFQEVREATWTAEENKRFEKALAYLDDKDNLESWSKIADLIPGKTVADVIKRYKELEDDVSDIEAGLIPIPGYGGDASSAANSDYFFGLENSSYGYDYVVGGKRSSPAMTDCFRSPMPEKERKKGVPWTEDEHLRFLMGLKKYGKGDWRNIAKSFVTTRTPTQVASHAQKYFLRQLTDGKDKRRSSIHDITTVNIPDADASATATTADVALSPTPANSFDVFLQPNPHYSFASASASSYYNAFPQWS

SEQ ID NO: 1517 - DNA, 789 bp, Arabidopsis thaliana
  G2453,family:YABBY
atgaatattaacaaaacctatctctctgtctatatatacacacacacacacacacatatatctcctatcattcatcgtacacacacactctctatgacaaagctccccaacatgacgacaacactcaaccatctatttgatctgccggggcagatttgccatgtccagtgtggtttttgcaccactattttgctggtgagtgtaccgtttacaagcttgtcaatggtggtgactgtgagatgtgggcattgcacaagccttctctctgtcaatttgatgaaggcttccttcattcctctccatctccttgcttctctctcccatcttgatgagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaaccacctgagaagcgacaaagagctccttcagcttacaattgcttcatcaaggaagagatcaggaggttaaaggctcagaatccaagcatggctcacaaggaagctttcagcttagctgccaaaaattgggcccattttcctccagctcacaacaagagagctgcttcagatcaatgtttttgtgaggaagataacaatgcgatactaccatgcaatgtttttgaggaccatgaagaaagcaataatgggttccgagagagaaaggctcagaggcattccatttggggaaaatctccatttgagtaa

SEQ ID NO: 1518 - protein, 262 aa, Arabidopsis thaliana
  G2453,YABBY domain coordinates 52-91,161-207
MNINKTYLSVYIYTHTHTHISPIIHRTHTLSMTKLPNMTTTLNHLFDLPGQICHVQCGFCTTILLVSVPFTSLSMVVTVRCGHCTSLLSVNLMKASFIPLHLLASLSHLDETGKEEVAATDGVEEEAWKVNQEKENSPTTLVSSSDNEDEDVSRVYQVVNKPPEKRQRAPSAYNCFIKEEIRRLKAQNPSMAHKEAFSLAAKNWAHFPPAHNKRAASDQCFCEEDNNAILPCNVFEDHEESNNGFRERKAQRHSIWGKSPFE

SEQ ID NO: 1519 - DNA, 758 bp, Arabidopsis thaliana
  G2455,family:YABBY
tcattgggataactaaaagtttcaagaagagaaacatatcattgaagagagaacccacacaaaaaaaaatgtctgtagatttctcatctgagcgtgtttgctatgtccactgcagcttctgcaccacgattttagcggtaagtgtaccatacgcaagtttgttcacacttgtgacggtgagatgtggccattgtaccaatttgctatccctcaacattggagtttcacttcatcaaacctcagctcctcccattcaccaagatcttcagcctcatagacagcacacaacctctctggtgacaaggaaagattgtgcatcgtcttctaggagcaccaacaatttatcggaaaacattgatcgtgaggctcctagaatgcctcctattcgcccaccggagaaaagacaacgtgttccttcggcctacaacagattcatcaaggaggaaatccaaaggattaaggcttgcaatccagagattagccaccgtgaggcatttagcactgctgctaaaaattgggcacattttcctcacattcactttggattaaagctggatggcaacaagaaaggcaagcaattagaccagtcagttgcaggccaaaagtctaatggctattactaaagcctttatatatatacacacatatatacacttatacgtatatatatgtgtatagatatatatgcgtgtgtatgatttatgtttatctttgtacgtacgcattaatgaatgtgtaagcagagagctgatgatgga

SEQ ID NO: 1520 - protein, 184 aa, Arabidopsis thaliana
  G2455,YABBY domain coordinates 10-48,107-154
MSVDFSSERVCYVHCSFCTTILAVSVPYASLFTLVTVRCGHCTNLLSLNIGVSLHQTSAPPIHQDLQPHRQHTTSLVTRKDCASSSRSTNNLSENIDREAPRMPPIRPPEKRQRVPSAYNRFIKEEIQRIKACNPEISHREAFSTAAKNWAHFPHIHFGLKLDGNKKGKQLDQSVAGQKSNGYY

SEQ ID NO: 1521 - DNA, 890 bp, Arabidopsis thaliana
  G2456,family:YABBY
ctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaacgcggccgc

SEQ ID NO: 1522 - protein, 240 aa, Arabidopsis thaliana
  G2456,YABBY domain coordinates 25-63,148-195
MSSMSMSSSSAPAFPPDHFSSTDQLCYVHCSFCDTVLAVSVPPSSLFKTVTVRCGHCSNLLSVTVSMRALLLPSVSNLGHSFLPPPPPPPPPNLLEEMRSGGQNINMNMMMSHHASAHHPNEHLVMATRNGRSVDHLQEMPRPPPANRPPEKRQRVPSAYNRFIKEEIQRIKAGNPDISHREAFSAAAKNWAHFPHIHFGLMADHPPTKKANVRQQEGEDGMMGREGFYGSAANVGVAHN

SEQ ID NO: 1523 - DNA, 590 bp, Arabidopsis thaliana
  G2457,family:YABBY
caatccattcgctaaagaccatgaacctagaagagaaaccaaccatgacggcttcaagggcttcccctcaagccgaacatctctactacgtccggtgtagcatctgcaacaccatcctcgcggttgggataccattgaagagaatgcttgacacggtaacggtgaaatgcggccattgtggtaacctctcgtttctcaccacaactcctcctcttcaaggccatgttagcctcacccttcagatgcagagctttggtggaagtgactataagaagggaagctcttcttcttcctcttcctccacctccagcgaccagcccccatctccctcacctccctttgtcgtcaaacctcctgagaagaagcagaggctcccatctgcatacaaccgcttcatgagggatgagatccaacgcatcaaaagtgccaatccggaaataccacaccgtgaagctttcagtgctgctgccaaaaattgggctaagtacatacccaactctcctacttccattacttccggaggccacaacatgatccatggcttgggattcggtgagaagaagtgaacaaaactcaggggaaaagaagcc

SEQ ID NO: 1524 - protein, 181 aa, Arabidopsis thaliana
  G2457,YABBY domain coordinates 21-59,110-157
MNLEEKPTMTASRASPQAEHLYYVRCSICNTILAVGIPLKRMLDTVTVKCGHCGNLSFLTTTPPLQGHVSLTLQMQSFGGSDYKKGSSSSSSSSTSSDQPPSPSPPFVVKPPEKKQRLPSAYNRFMRDEIQRIKSANPEIPHREAFSAAAKNWAKYIPNSPTSITSGGHNMIHGLGFGEKK

SEQ ID NO: 1525 - DNA, 561 bp, Arabidopsis thaliana
  G2459,family:YABBY
catcttgtttggtcctatttctcagatcgatcatggctaactctgtgatggcaaccgaacagctctgctacatcccttgcaacttttgcaacataattcttgcggtgaatgtcccatgcagcagcctgttcgacatcgtgaccgtccgatgcggtcactgcaccaatctgtggtctgtaaacatggcagctgctcttcagtcgctttcacgccctaatttccaggcaacaaactatgcagtaccagagtatggatcctcctcaagaagccacacaaaaatcccttcaagaatttcaactcgtaccataactgagcaacggattgtaaaccgtcctccggagaagcggcagcgagtaccttctgcgtacaatcaattcataaaagaggaaattcagaggattaaggcgaataatccagacataagccacagagaagcattcagcactgctgccaagaattgggcacactttcctcatattcactttggtctaatgctggagagtaacaagcaagctaagatagcctaataattctcgagattaatggtaatataagtgttgg

SEQ ID NO: 1526 - protein, 164 aa, Arabidopsis thaliana
  G2459,YABBY domain coordinates 11-49,100-147
MANSVMATEQLCYIPCNFCNIILAVNVPCSSLFDIVTVRCGHCTNLWSVNMAAALQSLSRPNFQATNYAVPEYGSSSRSHTKIPSRISTRTITEQRIVNRPPEKRQRVPSAYNQFIKEEIQRIKANNPDISHREAFSTAAKNWAHFPHIHFGLMLESNKQAKIA

SEQ ID NO: 1527 - DNA, 1223 bp, Arabidopsis thaliana
  G2465,family:GARP
caatattctttctccattgagattaagcttctttctcgctgtcgtctctctatagatcttggttcttagtcccttttgaataataatgatggtggagatggattacgctaagaaaatgcagaaatgtcatgaatacgttgaagcacttgaagaagaacagaagaaaatccaagtctttcaacgcgagcttcctttatgtttagagcttgtcactcaagcgatcgaagcttgtcggaaggagttatctggtacgacgacaactacatcagaacagtgttcagaacagaccacaagtgtttgtggtggtcctgtctttgaagagtttattcctatcaagaaaattagttccttgtgtgaagaagtacaagaagaagaagaagaagatggtgaacatgaatcttctccagaacttgtgaataataagaaatcagattggcttagatctgttcagctatggaatcattcaccggatctaaatccaaaagaggagcgtgtagctaagaaagcgaaagtggtggaggtgaaaccaaaaagcggtgcgtttcagccgtttcaaaagcgcgttttggagactgatttgcaaccggcggtgaaagtagctagttcgatgccagcgacgacgacgagttctacgacggaaacttgtggtggtaaaagtgatttgattaaagctggagatgaggaaagacggatagagcagcagcaatcgcagtcgcatacgcatagaaaacaaaggcggtgctggtcgccggaattacaccgtcgattcctaaacgcgcttcagcagcttggaggatctcatgttgctacaccaaagcaaatcagggatcacatgaaggttgatggattaacaaacgacgaagttaaaagccatttacagaaatatagacttcacacaagaaggccagcagcaacatccgtggcggcacaaagtaccgggaatcagcaacaaccacaatttgtggtggttggaggcatatgggtaccatcgtcacaagattttccaccaccgtccgatgtagccaacaagggtggtgtatatgctccggttgcggtggcgcaatctccaaaacgttcgttggagagaagttgcaactcgccggcggcatcttcctctacaaatacaaatacttctactcctgtgtcataatctgatagtcatactataatcatctcctgatgttgattttggtgtaggtttgaaaatgtttatgtgaatgtaa

SEQ ID NO: 1528 - protein, 354 aa, Arabidopsis thaliana
  G2465,GARP domain coordinates 219-269
MMVEMDYAKKMQKCHEYVEALEEEQKKIQVFQRELPLCLELVTQAIEACRKELSGTTTTTSEQCSEQTTSVCGGPVFEEFIPIKKISSLCEEVQEEEEEDGEHESSPELVNNKKSDWLRSVQLWNHSPDLNPKEERVAKKAKVVEVKPKSGAFQPFQKRVLETDLQPAVKVASSMPATTTSSTTETCGGKSDLIKAGDEERRIEQQQSQSHTHRKQRRCWSPELHRRFLNALQQLGGSHVATPKQIRDHMKVDGLTNDEVKSHLQKYRLHTRRPAATSVAAQSTGNQQQPQFVVVGGIWVPSSQDFPPPSDVANKGGVYAPVAVAQSPKRSLERSCNSPAASSSTNTNTSTPVS

SEQ ID NO: 1529 - DNA, 849 bp, Arabidopsis thaliana
  G2467,family:HS
atggacccgtcgtcaagctccagagcacggtcaatgccaccgccggtgcctatggagggattgcaggaagcagggccttctccttttctaacaaagacgttcgagatggttggtgatccaaacacaaaccacattgtgtcttggaacaggggaggcatcagttttgtcgtgtgggatccacattccttctcggccactattctgcctctatacttcaagcacaacaacttctccagctttgtcagacaacttaacacttatggattcagaaagatcgaggcagagagatgggagtttatgaatgaaggtttcttgatgggtcagagggaccttctcaaaagcatcaagcgacgaacctcctcttcttcccctccttcgcttaactactctcagtctcagcccgaggctcatgacccaggcgtcgagcttccgcagctccgagaagagaggcatgtcctaatgatggagatctcgacgctcagacaggaggagcaaagagcgagaggctacgtccaagccatggagcagaggattaatggagcagagaagaaacagaggcatatgatgtccttcttgaggcgtgcggtggagaatccttcccttctgcagcagattttcgagcagaagagagaccgagaggaggccgcgatgattgatcaggctggcttgatcaaaatggaagaggtggagcacctgtcggagctggaggctctggcgcttgagatgcaaggatatggacggcaacggactgatggtgtggagagggagcttgacgacgggttttgggaagagttactcatgaacaatgaaaactccgacgaagaagaggcgaatgtgaagcaagattag

SEQ ID NO: 1530 - protein, 282 aa, Arabidopsis thaliana
  G2467,HS domain coordinates 28-119
MDPSSSSRARSMPPPVPMEGLQEAGPSPFLTKTFEMVGDPNTNHIVSWNRGGISFVVWDPHSFSATILPLYFKHNNFSSFVRQLNTYGFRKIEAERWEFMNEGFLMGQRDLLKSIKRRTSSSSPPSLNYSQSQPEAHDPGVELPQLREERHVLMMEISTLRQEEQRARGYVQAMEQRINGAEKKQRHMMSFLRRAVENPSLLQQIFEQKRDREEAAMIDQAGLIKMEEVEHLSELEALALEMQGYGRQRTDGVERELDDGFWEELLMNNENSDEEEANVKQD

SEQ ID NO: 1531 - DNA, 3855 bp, Arabidopsis thaliana
  G2492,family:ENBP
atgatatatcataggtaattaggtatcatatctcatggagataaacgggtaaataaatataatcttatttgctaaataaaaaataatcaagtttaagttttaacatcttcatatacaatctggtttctgtgatctccctgtattagcaaaaaaaaaacatgatttaaaaaagaatttggaaagaaaagaaaagagcgggaaataaatccaaagatttgaccaagttaaaccaaaacttttttactatctgagaaaaccattcagtttccccaaaataaaataaaaaatcagccttaaatcccgtgtctagggttttctttcgtagctgattgggggctgcaagagtttcgccgaggacgattgagaattttgattttcgaaaaatggattctgtggaggaagaaggtgttgttagggttgaagaagagaacggacgcggtggtctccgtaggcatcggagggtttctacgaagctggcgaattacgtagatcctccgactgacgacgaagaagatggaggacccaagcgaaagggcaaaaggggtggaaatagggctccgaaaaagacaccgaagaaagacgaggagatgcaaaagaacgaaattgatgaagcaaaccgagtcactggtctggtgaaggaaaaaagagccgcgactaagattctgaatcgcaaagactccattattgaagtaggagaagcttctggaagcatgcccaaggaagtaaagggaattaggattgggaaaaggaagggagaaatcgatggtgagattccaactaagccgggcaagaagccaaagactacagtagacccgagaatcattggttacagaccggacaatatgtgccatcaatgtcaaaagagcgataggattgttgaacggtgtcagacctgcaatagtaagcgttattgtcatccatgcttggacacttggtacccccttatagcaaaagaagatgttgccaagaaatgcatgttctgctctagtacttgcaattgcagagcatgcttgcgtctagatactaaattgaaagggataaattcgaacctcatagtcagcgaggaagaaaaggtccaagcctctaagtttattctgcagagccttctcccacatctgaaaggaataaatgatgaacaagttgctgagaaggaagttgaggccaaaatatacggactgaagtttgaagaggtgaggccccaagacgctaaagctttccctgatgaaagactatactgtgatatctgcaagacttctatctatgatctccataggaattgcaagtcctgtagttttgatatctgccttagctgttgccttgagatccgcaatggaaaggctctggcatgtaaggaggatgtgtcttggaattatattaaccgaggtttagagtatgaacatggacaagaaggaaaagtgattgaaaagccggcgaataagctagatgataagttgaaagataagctggatggtaagccggatgataagccgaagggtaagccaaagggtaggccaaagggtaagccggatgataagccgaagggtaaactgaagggtaagcaggatgataaaccggatgataagccagatgagaagccggttaatacagaccatatgaagtacccttctctgtggaaagcaaatgaagctgggatcattacttgttgttgtggtgctggggagttagtgctgaaacgactacttccggatggttggatatctgagttggtcaacagagttgaaaaaactgctgaagctggcgagcttttgaatttacctgaaacggttttggagcgatgcccttgttctaactctgacagacatattgacatagacagctgtaatttgttaaaagctgcttgtcgagaaggttcagaagacaattatctttactctccaagtgtatgggatgttcaacaagatgatttgaagcattttcagcaccattgggtaaaaggcgagcctgtgattgtgagaaatgtgcttgaagctacatctggtttaagctgggaaccaatggtaatgcatcgtgcctgccgccagataagccatgtccagcatggatcacttaaggatgttgttgctgttgattgtttggacttctgtgaggtaaaagttaatcttcatgaattttttactggatacacggatggccgatatgatcgaatgggttggccactagttctgaaactgaaagattggcctccagctaaagtcttcaaagataacttgccacgtcatgctgaggagttcttatgtagtttgcctttgaagcattacactcatccggttaatggacctttgaatctcgctgtcaagcttccccaaaattgcttgaagccagacatgggaccaaagacgtacgttgcttctggatttgctcaagaattaggccgtggagattctgttactaagctccactgcgacatgtctgatgcggtgaatattttgacgcacatatctgaagtgcccaatatgcaacctggaattggaaatctgaaaaagaagcatgccgaacaagatctcaaggagctgtatagctcagtagctaacaaggaggaaatgatggagattcttgaaaattccagacaacaagtccaaaatgttgaaactgatgatggagctctttgggacattttccgtagagaagatattcctaaattagaaagttacattgagaaacatcacaaggagttcagacatctctactgctgtcctgtgtctcaggttgttcatcctatacatgaccagaacttctatctgacgcggtatcatataatgaagctgaaagaagaatatggcattgaaccttggaccttcaatcggaagcttggtgatgctgttttgatacctgtaggttgccctcatcaagttagaaatttgaagtcctgcaataaggtagcgcttgacttcgtctcacctgaaaatgtcagcgagtgtttacgcttgacaaaacagtatcgtctacttccaccaaatcattttgcaaaagaagacaagttaggggttaagaagatgatagtccatgcagttgataaagctctcagagacttaagtggagagaagtctccagaacctgaagagaagaaacaaaatatgagagggccgaagaagggggcagccaaggcagttgccaaggctctcaaagacttatctccaagtgaaaagaagtcttcggaagcagctgaagaggagatatcaaatgggatagtcaatgcaatcgataagggtctcaaagacttacctccaagtgaagagaagtcttccgaagccaaagtggagatatcaaatgggatagtcagtgcaatggataaggatctcgaacacatatcttcaagcgaaaagaagtctacggaagaggaaggggtgaaaagaccaaatattgtgaggacatatgagcggagaaaaaagctgggaagtgaagtaaccaacgcatacattgacagattagaaatggagaagatgtagtagtagtagtagttttcaattaacatcatcttttgttatagctttagcaaactcttttgctactttcatatctctaagttaaacagagtagtactaagggatagactaagaagatacttagttatatctatgtttggcatattttgtattctctcctcaatcatctacaaactctgtgaatttactcgagtctaagaagtatttaacttcattcctgtagaaaaatagctatcaacataacagtaacaggtatagaaattgtttgttaagttactctatatgcaacctattcttaacgaaacaaattgcttatttttgtttcaagttgtctaagttataagtggagaagaaagattctttaacttacatagctagctaggccttaaag

SEQ ID NO: 1532 - protein, 1027 aa, Arabidopsis thaliana
  G2492,ENBP domain coordinates 197-211,616-860
MDSVEEEGVVRVEEENGRGGLRRHRRVSTKLANYVDPPTDDEEDGGPKRKGKRGGNRAPKKTPKKDEEMQKNEIDEANRVTGLVKEKRAATKILNRKDSIIEVGEASGSMPKEVKGIRIGKRKGEIDGEIPTKPGKKPKTTVDPRIIGYRPDNMCHQCQKSDRIVERCQTCNSKRYCHPCLDTWYPLIAKEDVAKKCMFCSSTCNCRACLRLDTKLKGINSNLIVSEEEKVQASKFILQSLLPHLKGINDEQVAEKEVEAKIYGLKFEEVRPQDAKAFPDERLYCDICKTSIYDLHRNCKSCSFDICLSCCLEIRNGKALACKEDVSWNYINRGLEYEHGQEGKVIEKPANKLDDKLKDKLDGKPDDKPKGKPKGRPKGKPDDKPKGKLKGKQDDKPDDKPDEKPVNTDHMKYPSLWKANEAGIITCCCGAGELVLKRLLPDGWISELVNRVEKTAEAGELLNLPETVLERCPCSNSDRHIDIDSCNLLKAACREGSEDNYLYSPSVWDVQQDDLKHFQHHWVKGEPVIVRNVLEATSGLSWEPMVMHRACRQISHVQHGSLKDVVAVDCLDFCEVKVNLHEFFTGYTDGRYDRMGWPLVLKLKDWPPAKVFKDNLPRHAEEFLCSLPLKHYTHPVNGPLNLAVKLPQNCLKPDMGPKTYVASGFAQELGRGDSVTKLHCDMSDAVNILTHISEVPNMQPGIGNLKKKHAEQDLKELYSSVANKEEMMEILENSRQQVQNVETDDGALWDIFRREDIPKLESYIEKHHKEFRHLYCCPVSQVVHPIHDQNFYLTRYHIMKLKEEYGIEPWTFNRKLGDAVLIPVGCPHQVRNLKSCNKVALDFVSPENVSECLRLTKQYRLLPPNHFAKEDKLGVKKMIVHAVDKALRDLSGEKSPEPEEKKQNMRGPKKGAAKAVAKALKDLSPSEKKSSEAAEEEISNGIVNAIDKGLKDLPPSEEKSSEAKVEISNGIVSAMDKDLEHISSSEKKSTEEEGVKRPNIVRTYERRKKLGSEVTNAYIDRLEMEKM

SEQ ID NO: 1533 - DNA, 1026 bp, Arabidopsis thaliana
  G2505,family:NAC
atgggttcttcgtcgaacggaggagtgccacctggtttccggtttcatccgacggacgaagagcttctccattactacttgaagaagaaaatctcttaccaaaagtttgagatggaagtcatcagagaggttgacttaaacaagcttgagccttgggatttgcaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgaagatggatgggtggtatgtagagtgtttatgaagaaaaatttgttcaaggtagtaaatgaaggtagctcaagcattaactcattggaccaacacaaccatgacgcatctaacaacaaccatgcacttcaagctcgtagctttatgcaccgagacagtccataccagctagtacgtaaccacggagccatgacattcgaacttaacaagcctgaccttgctcttcatcaatacccaccaatcttccacaagccaccttcacttggatttgactactcttcaggacttgcaagggacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcgtcctctgtggttcagccagttcccgcgacgaaccagctaacattgcgtagtgagatggatttctggggttattctaaatag

SEQ ID NO: 1534 - protein, 341 aa, Arabidopsis thaliana
  G2505,NAC domain coordinates 9-137
MGSSSNGGVPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRLEDADDPQANPSEDGWVVCRVFMKKNLFKVVNEGSSSINSLDQHNHDASNNNHALQARSFMHRDSPYQLVRNHGAMTFELNKPDLALHQYPPIFHKPPSLGFDYSSGLARDSESAASEGLQYQQACEPGLDVGTCETVASHNHQQGLGEWAMMDRLVTCHMGNEDSSRGITYEDGNNNSSSVVQPVPATNQLTLRSEMDFWGYSK

SEQ ID NO: 1535 - DNA, 1000 bp, Arabidopsis thaliana
  G2509,family:AP2
atatattccctctttcattctccttcttcgtcttttctttgtttctcatattcaagacatcctcaattccaaatcttaaaccctaaatttacagacacaatcgagatcacctgaaaaaagaggtttaaagattttagcaaagatggcgaattcaggaaattatggaaagaggccctttcgaggcgatgaatcggatgaaaagaaagaagccgatgatgatgagaacatattccctttcttctctgcccgatcccaatatgacatgcgtgccatggtctcagccttgactcaagtcattggaaaccaaagcagctctcatgataataaccaacatcaacctgttgtgtataatcaacaagatcctaacccaccggctcctccaactcaagatcaagggctattgaggaagaggcactatagaggggtaagacaacgaccatggggaaagtgggcagctgaaattcgggatccgcaaaaggcagcacgggtgtggctcgggacatttgagactgctgaagctgcggctttagcttatgataacgcagctcttaagttcaaaggaagcaaagccaaactcaatttccctgagagagctcaactagcaagtaacactagtacaactaccggtccaccaaactattattcttctaataatcaaatttactactcaaatccgcagactaatccgcaaaccataccttattttaaccaatactactataaccaatatcttcatcaaggggggaatagtaacgatgcattaagttatagcttggccggtggagaaaccggaggctcaatgtataatcatcagacgttatctactacaaattcttcatcttctggtggatcttcaaggcaacaagatgatgaacaagattacgccagatatttgcgttttggggattcttcacctcctaattctggtttttgagatcttcaataaactgataataaaggatttgggtcacttgttatgaggggatcatatgttttctaa

SEQ ID NO: 1536 - protein, 263 aa, Arabidopsis thaliana
  G2509,AP2 domain coordinates 89-156
MANSGNYGKRPFRGDESDEKKEADDDENIFPFFSARSQYDMRAMVSALTQVIGNQSSSHDNNQHQPVVYNQQDPNPPAPPTQDQGLLRKRHYRGVRQRPWGKWAAEIRDPQKAARVWLGTFETAEAAALAYDNAALKFKGSKAKLNFPERAQLASNTSTTTGPPNYYSSNNQIYYSNPQTNPQTIPYFNQYYYNQYLHQGGNSNDALSYSLAGGETGGSMYNHQTLSTTNSSSSGGSSRQQDDEQDYARYLRFGDSSPPNSGF

SEQ ID NO: 1537 - DNA, 867 bp, Arabidopsis thaliana
  G2510,family:AP2
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcgttatacgtgtacgttgtatcgttattgtgttggctcacttaatttaatgcatatgcatgtatattttcatttatttgtttctagtttattgttttacgcgattaataattagatacctgtttctcaagttagttatcaggtttgtacgcatctacaaaaatacgtataagtgtatgttcttatatacagtttttgtttgcataagtattgctacttattctaaaaaaaaaaaaaaaaaaaaaaaaa

SEQ ID NO: 1538 - protein, 192 aa, Arabidopsis thaliana
  G2510,AP2 domain coordinates 42-109
MSPQRMKLSSPPVTNNEPTATASAVKSCGGGGKETSSSTTRHPVYHGVRKRRWGKWVSEIREPRKKSRIWLGSFPVPEMAAKAYDVAAFCLKGRKAQLNFPEEIEDLPRPSTCTPRDIQVAAAKAANAVKIIKMGDDDVAGIDDGDDFWEGIELPELMMSGGGWSPEPFVAGDDATWLVDGDLYQYQFMACL

SEQ ID NO: 1539 - DNA, 832 bp, Arabidopsis thaliana
  G2512,family:AP2
aacttagtgccacttagacacaataagaaaaccgttaacaagaagaaaaaaaaaagatcgaaaatggaatatcaaactaacttcttaagtggagagttttccccggagaactcttcttcaagctcatggagctcacaagaatcattcttgtgggaagagagtttcttacatcaatcatttgaccaatccttccttttatctagccctactgataactactgtgatgacttctttgcatttgaatcatcaatcataaaagaagaaggaaaagaagccaccgtggcggccgaggaggaggagaagtcatacagaggagtgaggaaacggccgtgggggaaattcgcggccgagataagagactcaacgaggaaagggataagagtgtggcttgggacattcgacaccgcggaggcggcggctctcgcttatgatcaggcggctttcgctttgaaaggcagcctcgcagtactcaatttccccgcggatgtcgttgaagaatctctccggaagatggagaatgtgaatctcaatgatggagagtctccggtgatagccttgaagagaaaacactccatgagaaaccgtcctagaggaaagaagaaatcttcttcttcttcgacgttgacatcttctccttcttcctcctcctcctattcatcttcttcgtcttcttcttctttgtcgtcaagaagtagaaaacagagtgttgttatgacgcaagaaagtaatacaacacttgtggttcttgaggatttaggtgctgaatacttagaagagcttatgagatcatgttcttgataatctctgcttctacaatttttatgtaatttga

SEQ ID NO: 1540 - protein, 244 aa, Arabidopsis thaliana
  G2512,AP2 domain coordinates 79-147
MEYQTNFLSGEFSPENSSSSSWSSQESFLWEESFLHQSFDQSFLLSSPTDNYCDDFFAFESSIIKEEGKEATVAAEEEEKSYRGVRKRPWGKFAAEIRDSTRKGIRVWLGTFDTAEAAALAYDQAAFALKGSLAVLNFPADVVEESLRKMENVNLNDGESPVIALKRKHSMRNRPRGKKKSSSSSTLTSSPSSSSSYSSSSSSSSLSSRSRKQSVVMTQESNTTLVVLEDLGAEYLEELMRSCS

SEQ ID NO: 1541 - DNA, 841 bp, Arabidopsis thaliana
  G2513,family:AP2
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctataaaattataaaatt

SEQ ID NO: 1542 - protein, 209 aa, Arabidopsis thaliana
  G2513,AP2 domain coordinates 27-94
MNNDDIILAEMRPKKRAGRRVFKETRHPVYRGIRRRNGDKWVCEVREPTHQRRIWLGTYPTADMAARAHDVAVLALRGRSACLNFADSAWRLPVPESNDPDVIRRVAAEAAEMFRPVDLESGITVLPCAGDDVDLGFGSGSGSGSGSEERNSSSYGFGDYEEVSTTMMRLAEGPLMSPPRSYMEDMTPTNVYTEEEMCYEDMSLWSYRY

SEQ ID NO: 1543 - DNA, 690 bp, Arabidopsis thaliana
  G2514,family:AP2
aaaacttcttcatcttctttaattagtttgccacctcgcacgtgtgacaaatccttcttcgccacgtgtgaaaacccttctccggcttgctactaatatacgactaatagtatgaatagttcaatggcttctgccggcttaggtagccggagaaaggatccggtgtacagaggaatccggtgccgaagtgggaaatgggtctccgagattcgtgagccgaggaaaaccacgagaatctggcttggaacttaccccatggcagagatggcagcagccgcctatgatgtggctgctatggctcttaaaggaagagaagctgtcttgaacttccctggatccgtcgggtcatacccggttcctgaatcaacatccgcagcagatatacgagccgctgcggcagccgcagcagcaatgaagggatgtgaggaaggggaggaggagaaaaaggcaaaggagaagaagagtagtagttcgaagtcgagagcgcgtgagtgccacgtagataatgatgttggatcttcgtcgtggtgtgggacagagttcatggacgaagaagaagtcttgaatatgcctaatctgctggctaatatggcagaagggatgatggttgcgccgccgtcgtggatgggttctcggccgtcggatgactctccggagaattcaaatgatgaggacttgtggggctattga

SEQ ID NO: 1544 - protein, 192 aa, Arabidopsis thaliana
  G2514,AP2 domain coordinates 16-82
MNSSMASAGLGSRRKDPVYRGIRCRSGKWVSEIREPRKTTRIWLGTYPMAEMAAAAYDVAAMALKGREAVLNFPGSVGSYPVPESTSAADIRAAAAAAAAMKGCEEGEEEKKAKEKKSSSSKSRARECHVDNDVGSSSWCGTEFMDEEEVLNMPNLLANMAEGMMVAPPSWMGSRPSDDSPENSNDEDLWGY

SEQ ID NO: 1545 - DNA, 786 bp, Arabidopsis thaliana
  G2515,family:MADS
atgggaagaggaagggttcagctacggcggatcgagaataagataaggagacaagtgacattttcaaagcgaaggaccggtttggtaaagaaagctcaagagatctcagtgttatgtgatgctgaagttgctttgattgttttctcccccaaaggcaaactctttgagtactctgctggttccagcatggagagaattcttgatcgatatgagaggtctgcctacgccggtcaagatattcctacaccaaatttggattcacagggagagtgctcaacagaatgttcaaagctcttgaggatgattgatgtcctgcaaagaagcctgaggcacttaagaggagaagaggtggatggtctaagtatcagagaccttcaaggtgtggagatgcaacttgatactgccctcaagaaaactcgctctagaaagaaccagctcatggtagagtccatagcacagcttcagaaaaaggagaaggaactaaaagaactgaagaaacagctaacaaagaaggctggtgaaagggaagactttcaaacgcaaaacctcagccatgacttagcctccttggcaacaccgccatttgaatcaccccatgagcttcgccggacaatatctcctcctcctcctcctttatcttcgggggatacatcacaaagggatggagttggagaagtagctgccggaaccctaattcgaaggacgaatgcaacgttgcctcattggatgccccagctcaccggagaatagaggtccgaaacaatcttggttttttaaatttttctg

SEQ ID NO: 1546 - protein, 249 aa, Arabidopsis thaliana
  G2515,MADS domain coordinates 1-57
MGRGRVQLRRIENKIRRQVTFSKRRTGLVKKAQEISVLCDAEVALIVFSPKGKLFEYSAGSSMERILDRYERSAYAGQDIPTPNLDSQGECSTECSKLLRMIDVLQRSLRHLRGEEVDGLSIRDLQGVEMQLDTALKKTRSRKNQLMVESIAQLQKKEKELKELKKQLTKKAGEREDFQTQNLSHDLASLATPPFESPHELRRTISPPPPPLSSGDTSQRDGVGEVAAGTLIRRTNATLPHWMPQLTGE

SEQ ID NO: 1547 - DNA, 931 bp, Arabidopsis thaliana
  G2517,family:WRKY
tcctcactctctctctttttctctaaccataaaatctctttgatctctttctctgtgttttgataatggaaaatgttggtgttgggatgccgttttacgatttagggcaaacaagggtttacccactcttgtctgatttccacgatttatcggcggagaggtatccggtagggttcatggatttactgggtgttcatcgtcatacacccacccatacgccgttgatgcattttccgaccacacctaactcgtcctcgagcgaagctgtgaatggagatgacgaagaagaagaagatggagaagaacagcagcataagacaaagaagcggtttaaattcactaaaatgagtagaaagcagacgaagaagaaggtgccaaaagtgtcattcatcacgaggagtgaggttcttcatctagatgatggttataagtggagaaaatacggtcaaaaacctgtcaaagacagcccttttccaagaaattattaccgttgcacaacaacttggtgtgacgtgaagaagagagtagagagatcattcagtgatccaagcagtgtaatcaccacttacgaaggtcaacatactcatcctcgtccactactcatcatgcccaaagaaggcagctctccatccaatggctcagcttctagggcccacattggcctccctacactccctcctcagcttttagattacaacaaccaacaacaacaagcgccgtcttcttttggaaccgagtacattaacaggcaagaaaaaggaattaatcatgatgatgatgacgatcatgttgtgaagaagagtcgaactcgggatctgctggatggagctggtttagtcaaagatcatggccttcttcaggatgttgttccctctcatatcattaaggaagagtattagttaatcgcataattatgtagctagctagctag

SEQ ID NO: 1548 - protein, 277 aa, Arabidopsis thaliana
  G2517,WRKY domain coordinates 117-177
MENVGVGMPFYDLGQTRVYPLLSDFHDLSAERYPVGFMDLLGVHRHTPTHTPLMHFPTTPNSSSSEAVNGDDEEEEDGEEQQHKTKKRFKFTKMSRKQTKKKVPKVSFITRSEVLHLDDGYKWRKYGQKPVKDSPFPRNYYRCTTTWCDVKKRVERSFSDPSSVITTYEGQHTHPRPLLIMPKEGSSPSNGSASRAHIGLPTLPPQLLDYNNQQQQAPSSFGTEYINRQEKGINHDDDDDHVVKKSRTRDLLDGAGLVKDHGLLQDVVPSHIIKEEY

SEQ ID NO: 1549 - DNA, 1197 bp, Arabidopsis thaliana
  G2520,family:HLH/MYC
aaggagttttgcatactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttga

SEQ ID NO: 1550 - protein, 354 aa, Arabidopsis thaliana
  G2520,HLH/MYC domain coordinates 139-197
MDPSGMMNEGGPFNLAEIWQFPLNGVSTAGDSSRRSFVGPNQFGDADLTTAANGDPARMSHALSQAVIEGISGAWKRREDESKSAKIVSTIGASEGENKRQKIDEVCDGKAEAESLGTETEQKKQQMEPTKDYIHVRARRGQATDSHSLAERARREKISERMKILQDLVPGCNKVIGKALVLDEIINYIQSLQRQVEFLSMKLEAVNSRMNPGIEVFPPKEVMILMIINSIFSIFFTKQYMFLSRYSRGRSLDVYAVRSFKHCNKRSDLCFCSCSPKTELKTTIFSQNMTCFCRYSRVGVAISSSKHCNEPFGQQAFENPEIQFGSQSTREYSRGASPEWLHMQIGSGGFERTS

SEQ ID NO: 1551 - DNA, 1423 bp, Arabidopsis thaliana
  G2522,family:AT-hook
tcgaccggttgcatgttgttatcttgctcttgaagtctatcgaacccttttagattctgattttgttctcttcttatccctcctcctataagttagccatttagggtccccatcgaattttactaagttaaagtcagagtctttttggttaagctatggatcgaagagacgcaatggcgttatccgggtcgggttcttactatatccaaagaggaatccccggttctggtcctcctcctcctcaaactcaaccaacgtttcacggatcacaaggatttcatcatttcaccaattccatctctccttttgggtcaaacccaaacccaaatccaaaccctggaggtgtctctactggattcgtgtctcctcctttacccgttgactcttctccggctgattcgtcagcggcggcggcgggagctttggttgctcctccttcaggtgacacgtctgtgaagcggaagagaggacggcctagaaaatatggacaagatggtggttctgtttcgttggcattgtctccttctatctccaacgtttccccgaactctaacaaacgtggccgtggaagacctcctggctccggcaagaagcaacggctatcttccattggtgaaatgatgccttcatcaactgggatgagcttcacaccgcatgtaatcgtagtttccattggtgaagacattgcttcaaaggttatatcgttctcgcatcaaggtccacgagcgatatgtgtcttatccgcaagtggtgctgtctctactgcaactcttcttcagccagcaccttctcatggaactattatatacgagggtctattcgagctcatatctctctcaacttcttatctgaacacaactgacaatgactacccaaaccgcactggaagtctagcggtctcacttgctagccccgatggtcgtgtcattggtggtggaattggaggtcctctaatagcagcaagccaagtccaggtcattgttggcagcttcatttgggcaattccgaaagggaagattaaaaaacgtgaagaaacttctgaagatgtccaagatactgatgctttggaaaacaacaacgataacacagcagcaacgtcacctcctgttcctcagcaaagtcagaacattgttcagactcctgtaggcatttggtcaactggttcaaggtcaatggatatgcatcacccccatatggacattgatctaatgcgtggatgattcatgtatatataagcattgaatctaggagaagaagaagaaacttgagctaacctccctgaaacaaagtagtctattggtattgtttaggaaagaaaaagacaattagtaagtttaggaatttctgcgtgttttcgagctttcagttagttgatttggtctcttgacttgttatgaatgggaaaaaaaattgcttgtttctt

SEQ ID NO: 1552 - protein, 354 aa, Arabidopsis thaliana
  G2522,At-hook amino acids 101-109,2nd cons. domain 196-240,DUF296 164-279
MDRRDAMALSGSGSYYIQRGIPGSGPPPPQTQPTFHGSQGFHHFTNSISPFGSNPNPNPNPGGVSTGFVSPPLPVDSSPADSSAAAAGALVAPPSGDTSVKRKRGRPRKYGQDGGSVSLALSPSISNVSPNSNKRGRGRPPGSGKKQRLSSIGEMMPSSTGMSFTPHVIVVSIGEDIASKVISFSHQGPRAICVLSASGAVSTATLLQPAPSHGTIIYEGLFELISLSTSYLNTTDNDYPNRTGSLAVSLASPDGRVIGGGIGGPLIAASQVQVIVGSFIWAIPKGKIKKREETSEDVQDTDALENNNDNTAATSPPVPQQSQNIVQTPVGIWSTGSRSMDMHHPHMDIDLMRG

SEQ ID NO: 1553 - DNA, 1772 bp, Arabidopsis thaliana
  G2525,family:DBP
agtcaagctctgaagtcgaagcaaagttaattacagagagagagaaaggatggagagagaactcagacgaccgaacccaatcaacagctctcgccggccggagatattttcttcaggcggtagtagtactcaactaccggaaagcccacgaggcccaatggagttcttgtctagatcctggagtgtctctgccttggaagtctccagagctctccacaccgccaaatcagcttcagccaccaacaggcctccctcatccattaacactccgataccggaagaaacgctaaaccctgagaaagaagaatgtccgccggagaacagtactagtgttagtagccagttctcgttcgctgcctcggccacttcacagcttgttcttgagcgcataatgtctcaatcggaggtgtcaccgttaacgtcggggaggctatcacacagcagcggcccactcaacggcggcggttcttttacggagacagacagtcctcctatctccccttccgatgaattcgacgacgtcatcaagtattttcgcacccacaacaccatacatcctctcttctccggcacaggaggcagccgtggtaccaccggaaatgggagcaatacccccatggctggaaccggtccaaagacagttggtaggtggctcaaggaccgtaaggaaaagaagaaagaagagactaggactcagaatgcacaggttcacgcagctgtttctgttgcagcggttgcatctgctgtggcagctgtagcagcagccacagcagcttcttcccctggtaagaacgagcagatggccagaatcgatatggccatggcttcagcggctgctctggtggctgctcagtgtgtggaggctgcagaaatcatgggagcagatagggatcatttgacatccgtggtgagctctgccgtgaatgttaagtcccatgacgatattgtcacccttactgcagctgctgcaacaggtactgcattaaaacgtagtcacccttacttctgtagagattccatacctgaattcacccccttttcttttgcagctctgcgaggagcagctacactcaaggcaagagcgcttaaggaagtatggaacatagctgcagtattgccagccgagaaaggggcaagttcagcgttgtgtggacaggttgacacaaagcatagtgatagcagctttagtggagaattacctgtggctggggaagacttccttggcgtctgtaaccaggaattactagctaaaggcactgagctcctcaaacgaactcgtggaggtgaactccactggaagattgtctctgtctacatcaacaaagcaggccaagctgtgctgaaaatgaaaagtaaacacgttggagggaccttcacaaagaagaagaaacatatggtgcttgaagtgagaaaggatatacctgcatgggctggcagagatcttttcaacggagacaagcatcactactttggcttaaagacagaaacaaagagggtcattgaatttgagtgcagaaaccaaagggaatacgagatatggactcagggcgtatccaggctacttgccattgctgctgagaagaagcagaaaagttccatgtccaaatggatggcaccttaacaacataagctaggaaagaagtagatgctttgtagaacgaactgcttatgataagaataggtttaaacataatggagtagaagacattcccttttgtaatatccttttattcaattgagtgaacagagatgacttctaaagctaacaacaa

SEQ ID NO: 1554 - protein, 523 aa, Arabidopsis thaliana
  G2525,DBP domain coordinates 196-308
MERELRRPNPINSSRRPEIFSSGGSSTQLPESPRGPMEFLSRSWSVSALEVSRALHTAKSASATNRPPSSINTPIPEETLNPEKEECPPENSTSVSSQFSFAASATSQLVLERIMSQSEVSPLTSGRLSHSSGPLNGGGSFTETDSPPISPSDEFDDVIKYFRTHNTIHPLFSGTGGSRGTTGNGSNTPMAGTGPKTVGRWLKDRKEKKKEETRTQNAQVHAAVSVAAVASAVAAVAAATAASSPGKNEQMARIDMAMASAAALVAAQCVEAAEIMGADRDHLTSVVSSAVNVKSHDDIVTLTAAAATGTALKRSHPYFCRDSIPEFTPFSFAALRGAATLKARALKEVWNIAAVLPAEKGASSALCGQVDTKHSDSSFSGELPVAGEDFLGVCNQELLAKGTELLKRTRGGELHWKIVSVYINKAGQAVLKMKSKHVGGTFTKKKKHMVLEVRKDIPAWAGRDLFNGDKHHYFGLKTETKRVIEFECRNQREYEIWTQGVSRLLAIAAEKKQKSSMSKWMAP

SEQ ID NO: 1555 - DNA, 945 bp, Arabidopsis thaliana
  G2531,family:NAC
atgagttggtgtgatggttcagatgataactacgatcttaatcttgaaagagtatcgaacactgatcatccatcggttcaactcaaagaccaatctcaatcatgtgtaacgagccgtccagattccaagattagcgctgaaactcccatcacgacttgtccttcttgcggacacaagctccatcatcaccaagacgaccaggttggtagcatcaaagatttaccaagcttaccggcaggagtcaaattcgatccgtcggataaagagatccttatgcatttggaggcgaaggtatcatccgataagcgaaaacttcatccgttgattgatgaatttatacctacgcttgaaggagagaatggaatttgttatacgcatcctgagaaacttcctggagtaagcaaggacgggcaagtacggcacttcttccaccggccatcaaaggcttatacgaccggaacacgaaaacgaagaaaagtgagcacagatgaggaaggccatgaaacaaggtggcacaaaacaggcaagactcgacctgttttgtctcaatcaggagaaaccggtttcaagaagatcctagtgctctacaccaactatggtcgccagaagaagcctgagaagacgaattgggtgatgcatcagtatcatttaggtagcagcgaggacgaaaaagacggtgaaccagtcctctctaaagtcttctaccaaacacagcctaggcaatgcggttcgatggaacctaaaccgaaaaatctcgtaaacctaaaccggtttagttatgaaaatattcaggccggtttcgggtatgagcatggtggtaaaagtgaagagacgacgcaggtgattcgagagttggtagttcgtgaaggcgatgggtcatgttcgtttcttagttttacttgtgatgcaagtaagggtaaagaaagcttcatgaagaatcaatag

SEQ ID NO: 1556 - protein, 314 aa, Arabidopsis thaliana
  G2531,NAC domain coordinates 52-212
MSWCDGSDDNYDLNLERVSNTDHPSVQLKDQSQSCVTSRPDSKISAETPITTCPSCGHKLHHHQDDQVGSIKDLPSLPAGVKFDPSDKEILMHLEAKVSSDKRKLHPLIDEFIPTLEGENGICYTHPEKLPGVSKDGQVRHFFHRPSKAYTTGTRKRRKVSTDEEGHETRWHKTGKTRPVLSQSGETGFKKILVLYTNYGRQKKPEKTNWVMHQYHLGSSEDEKDGEPVLSKVFYQTQPRQCGSMEPKPKNLVNLNRFSYENIQAGFGYEHGGKSEETTQVIRELVVREGDGSCSFLSFTCDASKGKESFMKNQ

SEQ ID NO: 1557 - DNA, 1005 bp, Arabidopsis thaliana
  G2535,family:NAC
atgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataa

SEQ ID NO: 1558 - protein, 334 aa, Arabidopsis thaliana
  G2535,NAC domain coordinates 11-114
MNISVNGQSQVPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMRKTLVFYKGRAPHGQKSDWIMHEYRLDESVLISSCGDHDVNVETCDVIGSDEGWVVCRVFKKNNLCKNMISSSPASSVKTPSFNEETIEQLLEVMGQSCKGEIVLDPFLKLPNLECHNNTTITSYQWLIDDQVNNCHVSKVMDPSFITSWAALDRLVASQLNGPNSYSIPAVNETSQSPYHGLNRSGCNTGLTPDYYIPEIDLWNEADFARTTCHLLNGSG

SEQ ID NO: 1559 - DNA, 687 bp, Arabidopsis thaliana
  G2536,family:NAC
atgggagaagagctttctgtagggtttcggttctatccgaccgaagtagagctccttacgtattacctaagaatccagcttggtggaggaaatgccaccattcatagtctcataccgatcctcgatgtgtttagcgttgagcctactcagcttccaaatcttgcgggagagaggtgtcgaggagatgcagaacaatggattttctttgtgccaagacaagagcgtgaagctagaggaggcagaccaagtaggaccactggttcaggatactggaaagcaactggttcacctggacccgtgttctcgccggataaccgagtgatcggagtaaagaagacgatggttttctataccggaaaagcacctactgggagaaagacaaagtggaagatgaatgaatataaagcagttgaaacagccagtgtatctaccatcccaaagtcaggaagctcgagagcctttgacagacgtcccacagaagcttatgcgatagagagaaatcttcctagcaatggagttgagacatcatctcgtgccacaatatcaacctcaccagaaacttcacattcaggaggaaaccaagttgatttaccggtgaatgctactactattacacaaagcatctcagatatggttgatgagctatcgcaacctttttgggagtgggaacaaatgaattggtcttaa

SEQ ID NO: 1560 - protein, 228 aa, Arabidopsis thaliana
  G2536,NAC domain coordinates 5-135
MGEELSVGFRFYPTEVELLTYYLRIQLGGGNATIHSLIPILDVFSVEPTQLPNLAGERCRGDAEQWIFFVPRQEREARGGRPSRTTGSGYWKATGSPGPVFSPDNRVIGVKKTMVFYTGKAPTGRKTKWKMNEYKAVETASVSTIPKSGSSRAFDRRPTEAYAIERNLPSNGVETSSRATISTSPETSHSGGNQVDLPVNATTITQSISDMVDELSQPFWEWEQMNWS

SEQ ID NO: 1561 - DNA, 960 bp, Arabidopsis thaliana
  G2539,family:NAC
atggcgattccacaaagaaacaagcgcaaagcaagatcctcgccggaacggctaacacaaccgccggaactaccacacaactccgacgttccttcttcttcgtcttcttctgccgctgataatttcttttcttggtcgacgaaacagtttgctttcccgccaggttatagatttgtaccaaaggaccaagaactcatctttcattacttgaaacccttttcgcaaggcaataaatgctcattgctcaatgttcctatccatcgtgtgaacatctacgagtcaaatccacaacatctttcagagaaatatgagaagggtaatgataaagattggttctatatatcggagaggaccaagaccggtaaggctggaagaagtaataaacgtgtcgacaatggaggatattggagcgcaactgtagctgcccaaaagatcaacgctggaaatggcatagtcggctacaagacttcactagagtactatgttgggaaacaatcaaatagtgtcaaaggggattggttaatgcaagagtactggtttgagtcttctgatgataacaacaacgagaaggtggatcatgctttgtgcaagatttatctgactccagcggcagcaaagaagaagaaagctgaggaagcagagaatgagaagctgaagaaagaagaagacgttgagcagctggatttgaatcaaccagaccaattgcagctgcaacagcctcatgatattgtgtatcaaccgcagtattgtttacttccagaacatcatcagccgcagccttttcctgataacttttctgagttgatcagctttcaacagcaaccagtgatgatcccagacgattttgaagatttcttggctgaattcactaaaccacattcactggatggagatgaagaattcaacaattatggtttgtttgaaggcttctttgacacagaaggaatgataaaacattaa

SEQ ID NO: 1562 - protein, 319 aa, Arabidopsis thaliana
  G2539,NAC domain coordinates 54-178
MAIPQRNKRKARSSPERLTQPPELPHNSDVPSSSSSSAADNFFSWSTKQFAFPPGYRFVPKDQELIFHYLKPFSQGNKCSLLNVPIHRVNIYESNPQHLSEKYEKGNDKDWFYISERTKTGKAGRSNKRVDNGGYWSATVAAQKINAGNGIVGYKTSLEYYVGKQSNSVKGDWLMQEYWFESSDDNNNEKVDHALCKIYLTPAAAKKKKAEEAENEKLKKEEDVEQLDLNQPDQLQLQQPHDIVYQPQYCLLPEHHQPQPFPDNFSELISFQQQPVMIPDDFEDFLAEFTKPHSLDGDEEFNNYGLFEGFFDTEGMIKH

SEQ ID NO: 1563 - DNA, 2169 bp, Arabidopsis thaliana
  G2543,family:HB
atgagtttcgtcgtcggcgtcggcggaagtggtagtggaagcggcggagacggtggtggtagtcatcatcacgacggctctgaaactgataggaagaagaaacgttaccatcgtcacaccgctcaacagattcaacgccttgaatcgagtttcaaggagtgtcctcatccagatgagaaacagaggaaccagcttagcagagaattgggtttggctccaagacaaatcaagttctggtttcagaacagaagaactcagcttaaggctcaacatgagagagcagataatagtgcactaaaggcagagaatgataaaattcgttgcgaaaacattgctattagagaagctctcaagcatgctatatgtcctaactgtggaggtcctcctgttagtgaagatccttactttgatgaacaaaagcttcggattgaaaatgcacaccttagagaagagcttgaaagaatgtctaccattgcatcaaagtacatgggaagaccgatatcgcaactctctacgctacatccaatgcacatctcaccgttggatttgtcaatgactagtttaactggttgtggaccttttggtcatggtccttcactcgattttgatcttcttccaggaagttctatggctgttggtcctaataataatctgcaatctcagcctaacttggctatatcagacatggataagcctattatgaccggcattgctttgactgcaatggaagaattgctcaggcttcttcagacaaatgaacctctatggacaagaacagatggctgcagagacattctcaatcttggtagctatgagaatgttttcccaagatcaagtaaccgagggaagaaccagaactttcgagtcgaagcatcaaggtcttctggtattgtcttcatgaatgctatggcacttgtcgacatgttcatggattgtgtcaagtggacagaactctttccctctatcattgcagcttctaaaacacttgcagtgatttcttcaggaatgggaggtacccatgagggtgcattgcatttgttgtatgaagaaatggaagtgctttcgcctttagtagcaacacgcgaattctgcgagctacgctattgtcaacagactgaacaaggaagctggatagttgtaaacgtctcatatgatcttcctcagtttgtttctcactctcagtcctatagatttccatctggatgcttgattcaggatatgcccaatggatattccaaggttacttgggttgaacatattgaaactgaagaaaaagaactggttcatgagctatacagagagattattcacagagggattgcttttggggctgatcgttgggttaccactctccagagaatgtgtgaaagatttgcttctctatcggtaccagcgtcttcatctcgtgatctcggtggagtgattctatcaccggaagggaagagaagcatgatgagacttgctcagaggatgatcagcaactactgtttaagtgtcagcagatccaacaacacacgctcaaccgttgtttcggaactgaacgaagttggaatccgtgtgactgcacataagagccctgaaccaaacggcacagtcctatgtgcagccaccactttctggcttcccaattctcctcaaaatgtcttcaatttcctcaaagacgaaagaacccgtcctcagtgggatgttctttcaaacggaaacgcagtgcaagaagttgctcacatctcaaacggatcacatcctggaaactgcatatcggttctacgtggatccaatgcaacacatagcaacaacatgcttattctgcaagaaagctcaacagactcatcaggagcatttgtggtctacagtccagtggatttagcagcattgaacatcgcaatgagcggtgaagatccttcttatattcctctcttgtcctcaggtttcacaatctcaccagatggaaatggctcaaactctgaacaaggaggagcctcgacgagctcaggacgggcatcagctagcggttcgttgataacggttgggtttcagataatggtaagcaatttaccgacggcaaaactgaatatggagtcggtggaaacggttaataacctgataggaacaactgtacatcaaattaaaaccgccttgagcggtcctacagcttcaactacagcttga

SEQ ID NO: 1564 - protein, 722 aa, Arabidopsis thaliana
  G2543,HB domain coordinates 31-91
MSFVVGVGGSGSGSGGDGGGSHHHDGSETDRKKKRYHRHTAQQIQRLESSFKECPHPDEKQRNQLSRELGLAPRQIKFWFQNRRTQLKAQHERADNSALKAENDKIRCENIAIREALKHAICPNCGGPPVSEDPYFDEQKLRIENAHLREELERMSTIASKYMGRPISQLSTLHPMHISPLDLSMTSLTGCGPFGHGPSLDFDLLPGSSMAVGPNNNLQSQPNLAISDMDKPIMTGIALTAMEELLRLLQTNEPLWTRTDGCRDILNLGSYENVFPRSSNRGKNQNFRVEASRSSGIVFMNAMALVDMFMDCVKWTELFPSIIAASKTLAVISSGMGGTHEGALHLLYEEMEVLSPLVATREFCELRYCQQTEQGSWIVVNVSYDLPQFVSHSQSYRFPSGCLIQDMPNGYSKVTWVEHIETEEKELVHELYREIIHRGIAFGADRWVTTLQRMCERFASLSVPASSSRDLGGVILSPEGKRSMMRLAQRMISNYCLSVSRSNNTRSTVVSELNEVGIRVTAHKSPEPNGTVLCAATTFWLPNSPQNVFNFLKDERTRPQWDVLSNGNAVQEVAHISNGSHPGNCISVLRGSNATHSNNMLILQESSTDSSGAFVVYSPVDLAALNIAMSGEDPSYIPLLSSGFTISPDGNGSNSEQGGASTSSGRASASGSLITVGFQIMVSNLPTAKLNMESVETVNNLIGTTVHQIKTALSGPTASTTA

SEQ ID NO: 1565 - DNA, 1575 bp, Arabidopsis thaliana
  G2550,family:HB
atggctgtgtattaccctaatagtgtcggcatgcaatctctttaccaagaatccatttacctcaacgaacaacaacaacaacaacaacaagcttcttcttcctctgctgcatctttctccgagattgtttccggtgatgttcgaaacaacgagatggtatttatcccaccaacaagcgacgtagccgtcaacggaaacgtaacggtgtcaagtaacgatctaagctttcacggtggaggactttctttaagtcttggtaatcagatccagtcagctgtctctgtttctccgtttcagtatcattaccagaatctttcgaaccaattgagttacaataatcttaatccttctactatgtctgatgagaatgggaagagcttgagtgttcatcagcatcactctgatcaaattttaccttcctctgtttacaacaacaatggtaataatggtgttggattctacaacaattaccgttacgagacatcagggtttgtgagtagtgtactgagatctcgttaccttaaaccaacacaacaattgcttgatgaagttgttagtgtaaggaaagatttgaaattggggaataagaagatgaagaatgataaaggtcaagactttcacaatgggtctagtgataacattacagaagatgataaatctcaatcgcaggagttgtctccttcagaacgtcaggagctacagagcaagaagagcaagcttttaacaatggtggatgaggtagataaaaggtataaccaataccatcatcaaatggaagctttagcatcgtctttcgagatggtaacaggtcttggagcagctaagccttacacatccgtagctctgaatagaatctctcgccatttccgctgtttacgcgacgcgataaaagaacagattcaggtgatcagagggaagcttggggagagagagacttctgatgaacaaggagagaggataccgcgtcttaggtacttagatcaacggttgagacaacagagagctttgcatcaacaacttggaatggttagaccagcttggagaccacaaagaggcttacctgaaaactctgtctctatacttcgagcttggctctttgagcatttccttcatccatatcctaaagaatcagagaaaatcatgctttcaaagcagacaggactatcgaaaaaccaggttgcaaattggtttattaacgcgagagttcgactatggaaaccaatgattgaagagatgtataaagaagagtttggagaatcagcagagttactctctaactctaatcaagacaccaaaaaaatgcaggaaacatctcagctcaaacacgaagactcttcgtcttcgcaacaacagaatcagggaaacaacaacaacaacatcccatatacatctgatgcagaacaaaacctagtctttgcagatcctaaaccagaccgtgctactactggagattacgacagcttgatgaactatcatgggtttggtattgatgattacaatcgttacgttggccttggaaaccaacaagatggcagatattctaatccccatcaattacacgactttgttgtctaa

SEQ ID NO: 1566 - protein, 524 aa, Arabidopsis thaliana
  G2550,HB domain coordinates 345-408
MAVYYPNSVGMQSLYQESIYLNEQQQQQQQASSSSAASFSEIVSGDVRNNEMVFIPPTSDVAVNGNVTVSSNDLSFHGGGLSLSLGNQIQSAVSVSPFQYHYQNLSNQLSYNNLNPSTMSDENGKSLSVHQHHSDQILPSSVYNNNGNNGVGFYNNYRYETSGFVSSVLRSRYLKPTQQLLDEVVSVRKDLKLGNKKMKNDKGQDFHNGSSDNITEDDKSQSQELSPSERQELQSKKSKLLTMVDEVDKRYNQYHHQMEALASSFEMVTGLGAAKPYTSVALNRISRHFRCLRDAIKEQIQVIRGKLGERETSDEQGERIPRLRYLDQRLRQQRALHQQLGMVRPAWRPQRGLPENSVSILRAWLFEHFLHPYPKESEKIMLSKQTGLSKNQVANWFINARVRLWKPMIEEMYKEEFGESAELLSNSNQDTKKMQETSQLKHEDSSSSQQQNQGNNNNNIPYTSDAEQNLVFADPKPDRATTGDYDSLMNYHGFGIDDYNRYVGLGNQQDGRYSNPHQLHDFVV

SEQ ID NO: 1567 - DNA, 1182 bp, Arabidopsis thaliana
  G2552,family:HLH/MYC
cacaaatggaaggaagagtcaacgctctgtcaaacataaacgatctcgaacttcacaatttcttggtcgatccaaacttcgatcagttcataaacctcataagaggagatcatcaaaccattgacgaaaacccagttcttgatttcgatcttggtccattacaaaacagcccctgtttcatagacgagaaccagttcatcccaacacctgtcgatgacctcttcgacgaattgcctgacttagactccaacgttgctgaatcattccgtagcttcgacggtgatagtgttagagccggtggtgaagaagatgaagaagattacaacgacggtgatgattcttcagccactactacgaataatgatgggacccgtaagacgaagactgatcggtctaggactttgatctctgagagaagaaggagagggcgtatgaaggataagctttatgcattgagatctcttgttcccaatattactaagatggataaagcatccattgttggagatgcagtgttgtatgttcaagaacttcagtcacaagcgaagaaactcaaatccgatatcgcgggtcttgaagcttctttaaactctactggagggtaccaagaacatgctcctgatgctcaaaagactcaaccttttcgcggtatcaatcctcctgcttccaaaaaaatcattcagatggatgttatacaagtggaggagaaagggttttatgtgagattggtgtgtaacaaaggagaaggtgttgctccatctctttacaagtctttggagtctcttacaagtttccaagtgcagaactctaacctaagctctccttctccggacacatacctcttaacatataccttagatgggacatgcttcgaacagagcttaaacttgcctaacctgaagctgtggatcactggatcacttttaaatcaaggttttgaattcatcaagtcatttacttgattctataacgcttgctctaacgtgagtcaaatccggttctgcactatattgattgtgtacctttcttacatgtttcataacttccagggctctaatttctattctagtgatgatgtaaccgagattgttgattctctattgaataaacaccatgttatatagtaatttagcgacaaattgtatggttaaatgaagtaatatttatgttttgtttataaaa

SEQ ID NO: 1568 - protein, 318 aa, Arabidopsis thaliana
  G2552,HLH/MYC domain coordinates 124-181
MEGRVNALSNINDLELHNFLVDPNFDQFINLIRGDHQTIDENPVLDFDLGPLQNSPCFIDENQFIPTPVDDLFDELPDLDSNVAESFRSFDGDSVRAGGEEDEEDYNDGDDSSATTTNNDGTRKTKTDRSRTLISERRRRGRMKDKLYALRSLVPNITKMDKASIVGDAVLYVQELQSQAKKLKSDIAGLEASLNSTGGYQEHAPDAQKTQPFRGINPPASKKIIQMDVIQVEEKGFYVRLVCNKGEGVAPSLYKSLESLTSFQVQNSNLSSPSPDTYLLTYTLDGTCFEQSLNLPNLKLWITGSLLNQGFEFIKSFT

SEQ ID NO: 1569 - DNA, 1167 bp, Arabidopsis thaliana
  G2555,family:HLH/MYC
ctgtttttgtatccgtgtaaattaatcacacggtagtttttgatgaaaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctgaaagaagagcaaatgagtggtgggatatcaggaatgatggatatgaacatggacaagatttttgaggattcagttccttgtagggttcgtgctaaacgtggttgtgctactcatcctcgtagcattgctgaacgggtgagaagaacgcgaataagtgatcggattaggaggctgcaagagcttgttcctaacatggataagcaaaccaacactgcagacatgttggaagaagctgtggagtatgtgaaggctcttcaaagccagatccaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcaaaaaaaaaaa

SEQ ID NO: 1570 - protein, 259 aa, Arabidopsis thaliana
  G2555,HLH/MYC domain coordinates 184-242
MQSTHISGGSSGGGGGGGGEVSRSGLSRIRSAPATWIETLLEEDEEEGLKPNLCLTELLTGNNNSGGVITSRDDSFEFLSSVEQGLYNHHQGGGFHRQNSSPADFLSGSGSGTDGYFSNFGIPANYDYLSTNVDISPTKRSRDMETQFSSQLKEEQMSGGISGMMDMNMDKIFEDSVPCRVRAKRGCATHPRSIAERVRRTRISDRIRRLQELVPNMDKQTNTADMLEEAVEYVKALQSQIQELTEQQKRCKCKPKEEQ

SEQ ID NO: 1571 - DNA, 1502 bp, Arabidopsis thaliana
  G2557,family:HLH/MYC
tcgacttcctgtgaactcatctgtttgttctcttcttccggtttcactttttcatgtcctgccgttattacaacgaggattgtgtttgatccgatggaaggattggaatctgtgtacgctcaagctatgtatggaatgacacgagagagcaaaatcatggagcatcaaggatcagatttgatttggggaggaaatgagctaatggctcgagaactctgttcttcttcttcttatcaccaccaactcattaatccgaatcttagcagctgtttcatgtctgatcttggagtcttaggtgagattcaacagcagcaacatgttggcaacagagctagctcgatagatccatcatcactcgattgtttgttatctgcgacgtcgaatagcaacaacacctcgacggaggacgatgaaggaatatctgtgcttttctcagattgtcagactctttggagctttggtggagtctcatctgcagagtctgagaacagagagatcactactgagacgacaacaacgataaagcctaagcctttgaagagaaacagaggaggagatggaggaactactgagactacaacaacaacaacaaaacctaagtctttgaagagaaacagaggagacgagacaggaagtcactttagtcttgttcatcctcaagatgattcggagaaaggaggtttcaagcttatatacgatgagaatcaatcgaaatcaaagaaaccaagaacagagaaagaacgaggcggttcttcgaacattagtttccaacattcaacttgtttgtctgacaatgtcgagcccgatgctgaggcgattgcacaaatgaaggagatgatatacagagcggctgcatttagaccggtgaatttcgggttagagattgtggagaagcctaagaggaagaacgtcaagatatcgacggatcctcaaacggttgcagcgagacagagaagggagaggataagtgagaagattagggttttacaaacattggttccaggtgggacgaagatggatactgcatcaatgcttgatgaagctgctaattatctcaagttccttagagcacaagtaaaagctttagaaaacttgagacccaagcttgaccaaaccaatctctctttctcttctgctcctacatcgtttccattattccacccatcttttcttccattgcaaaatcctaatcaaatccatcatccagagtgttgacagattataaacttttgagtttcatcatcatcaacagaatcatggcgtcttgattgttttagcagttctcaagaaaggcaacttctgtgacaagggtggtgtcgggcagtgttgtttacactttccagtctttgttttgcatttctttttatataaagtttgtattttatatagaatctgtggaattcgagggttgaaatattgtgaaaaacagagccgcaagaggttaattacagtctctgcaatattttcaaccttttattactttattagagtaaagatagcgt

SEQ ID NO: 1572 - protein, 373 aa, Arabidopsis thaliana
  G2557,HLH/MYC domain coordinates 272-329
MEGLESVYAQAMYGMTRESKIMEHQGSDLIWGGNELMARELCSSSSYHHQLINPNLSSCFMSDLGVLGEIQQQQHVGNRASSIDPSSLDCLLSATSNSNNTSTEDDEGISVLFSDCQTLWSFGGVSSAESENREITTETTTTIKPKPLKRNRGGDGGTTETTTTTTKPKSLKRNRGDETGSHFSLVHPQDDSEKGGFKLIYDENQSKSKKPRTEKERGGSSNISFQHSTCLSDNVEPDAEAIAQMKEMIYRAAAFRPVNFGLEIVEKPKRKNVKISTDPQTVAARQRRERISEKIRVLQTLVPGGTKMDTASMLDEAANYLKFLRAQVKALENLRPKLDQTNLSFSSAPTSFPLFHPSFLPLQNPNQIHHPEC

SEQ ID NO: 1573 - DNA, 761 bp, Arabidopsis thaliana
  G2559,family:DBP
atgactttagaggagcagaagaaagtcataatgcccgaggccgtcgcatcggagccatcaccaccatccaaggaggagaagtccgacgattcgaaagctattgttctcgtcgtcgctgcaaaagaacctacggaagacaagaaagtaggttcagttcaccgagatgctgttttggttagactcgagcaagataagaggatatctctaatcaaagcttgggaagaggctgagaaatccaaagtggagaacaaagctcagaagaagatttcttcagttggagcttgggaaaacagcaagaaagcttctgtggaagctgagctaaaaaagatcgaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctgatcggagaaatggtctttgatgttgcattgtggtttcatttgttattaacttgagaaagaagagattattggtagttgaagtggttggtgtgggtttcatttggcaacataaaaagttacatggccataatgtaacgtcttattatgtttggagtaatgtgttttactcatgtgtaatttgtacagcttaaccttgagagacttcttttgaactttctaaacttaaactcccaa

SEQ ID NO: 1574 - protein, 175 aa, Arabidopsis thaliana
  G2559,DBP domain coordinates 60-170
MTLEEQKKVIMPEAVASEPSPPSKEEKSDDSKAIVLVVAAKEPTEDKKVGSVHRDAVLVRLEQDKRISLIKAWEEAEKSKVENKAQKKISSVGAWENSKKASVEAELKKIEEQLNKKKAHYTEQMKNKIAQIHKEAEEKRAMTEAKRGEDVLKAEEMAAKYRATGTAPTKLFGFF

SEQ ID NO: 1575 - DNA, 1317 bp, Arabidopsis thaliana
  G2565,family:GARP
atgacacttgctagcgattttggttttccatccgctatatcttcatcttttacaattctagaagagagataccacaataactttcctaacactttgtgtgtttcatcaggacaggaatcgatgaataacaaccccgtcccctgtcaggtgtttcctctggtctctggtggtagttctggtgggaatttgttttcatcttcttccggattctgcaatggtgtctatgtttcatcttcctcccaggcacggccatctgtttctaccgtgccaagagacagaattactgttgctcacgtctctggtgaagggcagaggcaggaatgccctgtggaaacacattccttgcaattgatcaatcaacctcaagaacagaaaattatgacttggtcttcagaccagattcggggcttcttcgattttcctgttccagatccacaagcagcgagcagcagaactatggtttcatccaaggaagtgctttcaaaatgcgaatggccagactgggcggatcagttgatctctgatgatagtcttgaaccaaattggtcggagcttctaggtgatcctaatgtactcaatctatattcaaaggttcaaacacagtcttctgatatagcaaggcaagagatcgtctttagaaatcagcatcaggtggatccatcaatggagccgtttaatgccaaaagcccaccagctagttcaatgacatctaagcaaagaatgcgttggacaccagaacttcatgaagcatttgtcgaagctatcaatcagctcggtggtagtgaacgagccacccctaaggctgttttgaagctcatcaatagccctgggttgaccgtttatcatgtcaaaagccatttgcagaaatacagaactgcaaggtataaaccagagctttccaaagatacagtaaagaatttgaaaaccattgaagatatcaaatctcttgacttgaagacgagcattgaaatcactgaagctctccggttacagatgaaagttcaaaaacaactccacgagcaacttgagatccaaagatcactgcagttacaaatcgaagaacaaggtcggtatcttcagatgatgattgagaaacaacagaagatgcaagagaacaaaaaagactctacttcctcatcatcaatgccagaagctgacccttcagctccatcaccaaacctttcacaacctttcctccataaagcaaccaattcagaaccatcaataactcagaaactgcagaatggttctagcacaatggatcaaagtgaatctacttctgggactagtaatagaaaacgggttagagaagattag

SEQ ID NO: 1576 - protein, 438 aa, Arabidopsis thaliana
  G2565,GARP domain coordinates 243-292
MTLASDFGFPSAISSSFTILEERYHNNFPNTLCVSSGQESMNNNPVPCQVFPLVSGGSSGGNLFSSSSGFCNGVYVSSSSQARPSVSTVPRDRITVAHVSGEGQRQECPVETHSLQLINQPQEQKIMTWSSDQIRGFFDFPVPDPQAASSRTMVSSKEVLSKCEWPDWADQLISDDSLEPNWSELLGDPNVLNLYSKVQTQSSDIARQEIVFRNQHQVDPSMEPFNAKSPPASSMTSKQRMRWTPELHEAFVEAINQLGGSERATPKAVLKLINSPGLTVYHVKSHLQKYRTARYKPELSKDTVKNLKTIEDIKSLDLKTSIEITEALRLQMKVQKQLHEQLEIQRSLQLQIEEQGRYLQMMIEKQQKMQENKKDSTSSSSMPEADPSAPSPNLSQPFLHKATNSEPSITQKLQNGSSTMDQSESTSGTSNRKRVRED

SEQ ID NO: 1577 - DNA, 2094 bp, Arabidopsis thaliana
  G2567,family:ARF
tgccactgtttcagcaaaaacggtcacaaaaaatatgataaatgtgatgaatccaatgaaaggtggaacagagaaaggtttagatcctcagctatggcatgcatgtgctggtggtatggttcgtatgcctcctatgaactctaaagtcttttactttcctcaaggtcacgccgaaaacgcttacgattgtgtcgatttcggtaatctccctattcctcccatggttttgtgtcgtgttttagccattaagtatatggctgatgctgaatctgacgaggttttcgctaaactgagattgattcctttgaaagatgatgagtatgttgatcacgagtatggtgatggtgaagatagtaacggtttcgagagtaatagtgagaaaacgccttcgtttgctaagactttgactcagtctgatgctaataacggtgggggtttctctgttcctcgttattgcgctgagacgattttcccgaggttggattataacgccgagccgccggttcagaccattcttgctaaggatgttcatggtgatgtttggaagttcagacatatttatagagggacgcctcggcgtcaccttcttacaaccggatggagtaattttgtaaaccagaagaagcttgtggcgggagattcgattgtcttcatgagagcggagaatggagatctttgtgtaggtattaggagggctaagagaggagggataggtaatggacccgaatattcagcgggttggaatccgatcggtggaagttgcggctactcttctctgttaagggaagatgaaagcaatagtttgaggagaagtaattgttcccttgcggataggaaggggaaagtgacggctgaatctgttatagaagcagccactcttgctattagcggaagaccgtttgaggttgtgtactatccgagagctagcacttcagagttttgtgtcaaggcattagatgctcgagctgccatgcggattccgtggtgctcaggtatgaggtttaagatggcttttgagacagaggattcgtctcggataagttggtttatggggactgtttcagctgttaatgtctctgatcctatccgttggcctaactctccttggcggcttctacaggtggcgtgggatgagccagatttactccaaaacgtgaagcgagttaacccgtggttggtggaattggtatcaaacgtacatccgatcccgcttacttcgttttcgccaccgaggaaaaagatgcggctacctcagcatccagattacaacaatctgatcaattcgattccagtaccttcattcccaagcaatccccttattagatcaagcccgttaagctctgttctggacaatgttcccgtgggtttacagggagccaggcataatgctcatcagtactacgggttatcatcttcggatcttcaccattactacttgaatagaccacctcctcctcctcctccatcctctctccaactttctccttctctcggtctccgaaacatcgataccaaaaacgaaaaaggattttgctttttgacaatgggaacaacaccatgcaatgataccaaatctaaaaagtcccatattgtattgttcggcaagcttatactacccgaggaacagctatcagaaaaaggctcaacggataccgcaaacatagagaaaacgcagatttcatcaggcgggtcgaaccaaaacggcgttgcgggaagggagttttcttcgtcagatgaaggatcaccttgctctaagaaagttcatgatgcatcaggtttggaaacagggcattgtaaagtgtttatggagtcagacgatgtaggtcgaaccttagacctatcggttcttggttcatacgaagaattgagtcggaaactctctgacatgtttggaatcaaaaagtctgagatgttaagctctgttctctatagggatgcatcaggagccatcaaatacgcaggaaacgaacctttcagtgagttcttgaagacagctcgaagattgacaattctgacggaacaaggaagtgagagcgttgtagtataacttggcagagtgttttgttggagcttggaagtcaaaactcaacgatt

SEQ ID NO: 1578 - protein, 670 aa, Arabidopsis thaliana
  G2567,ARF domain coordinates 18-384
MINVMNPMKGGTEKGLDPQLWHACAGGMVRMPPMNSKVFYFPQGHAENAYDCVDFGNLPIPPMVLCRVLAIKYMADAESDEVFAKLRLIPLKDDEYVDHEYGDGEDSNGFESNSEKTPSFAKTLTQSDANNGGGFSVPRYCAETIFPRLDYNAEPPVQTILAKDVHGDVWKFRHIYRGTPRRHLLTTGWSNFVNQKKLVAGDSIVFMRAENGDLCVGIRRAKRGGIGNGPEYSAGWNPIGGSCGYSSLLREDESNSLRRSNCSLADRKGKVTAESVIEAATLAISGRPFEVVYYPRASTSEFCVKALDARAAMRIPWCSGMRFKMAFETEDSSRISWFMGTVSAVNVSDPIRWPNSPWRLLQVAWDEPDLLQNVKRVNPWLVELVSNVHPIPLTSFSPPRKKMRLPQHPDYNNLINSIPVPSFPSNPLIRSSPLSSVLDNVPVGLQGARHNAHQYYGLSSSDLHHYYLNRPPPPPPPSSLQLSPSLGLRNIDTKNEKGFCFLTMGTTPCNDTKSKKSHIVLFGKLILPEEQLSEKGSTDTANIEKTQISSGGSNQNGVAGREFSSSDEGSPCSKKVHDASGLETGHCKVFMESDDVGRTLDLSVLGSYEELSRKLSDMFGIKKSEMLSSVLYRDASGAIKYAGNEPFSEFLKTARRLTILTEQGSESVVV

SEQ ID NO: 1579 - DNA, 1866 bp, Arabidopsis thaliana
  G2570,family:GARP
atggcttctgctcaatctttctacaaccaaagctctgtcttgaaaatcaatgtcatggttgtggacgatgatcatgttttccttgatatcatgtcacgcatgcttcaacactccaaatacagagatccatcagttatggagatcgcagttatagctgtagacgatccgaagaaagcattatctactctaaaaattcaacgagacaatatagatctcataatcacagattattatatgcctggtatgaacggtttacaactcaaaaaacaaatcactcaggaatttggaaatttaccggtcttagttatgtcatcggacaccaacaaagaagaggagagtttaagttgtggagcgatgggtttcattccaaaacccatacatcctactgacttaacaaagatttaccagtttgctttaagcaacaagaggaacggtaagtcaacactatcgaccgagcaaaaccacaaggacgcagatgttagtgtccctcagcaaatcacgttggttcctgagcaagctgacgtcttaaagaccaagaggaagaactgctcatttaaatcggattcaagaaccgtgaacagtacaaatggaagttgtgttagtacggatggttcaagaaaaaatcgaaaaagaaaacccaacggtggtcctagtgatgatggcgagtctatgtcgcaacccgcgaaaaagaaaaagattcagtggacggattctcttcacgacctattcttacaggctatccgacatattggtcttgataaggcggtgccaaaaaagatcctagcgttcatgagcgtaccatacttgacaagagagaacgtagccagccatttacagaaatatcggatattcttgagaagagttgcggagcagggtttgtatagcatgttgtcggatagaggcatagactcgatgtttcgacaaactcacattaaggagccgtacttcaactattacacaccatctacttcttggtatgacacaaggcttaacaatagatcattctattccaaacccgtacatggctttggacagtctaaactcttgtccacaacacgtgagcccgtctgcttcaaccagatgccttacaactacatgaaccggtcatccacctatgagccgcaccgtattggatctggatcaaacttgacgctgcccatccagagcaacctcagtttcccaaaccaaccatctcaaaacgaagaaagaagaagctttttcgaaccacccgtgatggcaaacaaaatcgcccaaacatctcaagttcttgggtttggacaacttggaccgtcagctatcagtggtcataatttcaacaataacatgacgagtagatatggaagtttgattccgagccaaccgggacctagccacttctcctatgggatgcaatcgttcttaaacaatgagaacgtaacatataaccctcagccacctgccaatgcaactacacagccaaatcttgatgaacttcctcaactggagaatctcaacttatacaatgatttcggcaacactagtgagcttccttacaacataagtaactttcaattcgatgacaacaagcatcaacaaggagaagcggatcccaccaaatttgagctcccagctgcaaaattttcgactgaactgaatcatgaagacgatggtgactggaccttcgtgaacataaaccagggtcaatctaatggagaaacatcgaacactattgcttctccggagactaatactccaattttgaacattaaccataatcagaatcagggacaagatgttccagagtttaacgattggtcgtttttggatccacaggaattggttgatgacgacttcatgaactctctgttcaacaatgacatgaattga

SEQ ID NO: 1580 - protein, 621 aa, Arabidopsis thaliana
  G2570,GARP domain coordinates 235-283
MASAQSFYNQSSVLKINVMVVDDDHVFLDIMSRMLQHSKYRDPSVMEIAVIAVDDPKKALSTLKIQRDNIDLIITDYYMPGMNGLQLKKQITQEFGNLPVLVMSSDTNKEEESLSCGAMGFIPKPIHPTDLTKIYQFALSNKRNGKSTLSTEQNHKDADVSVPQQITLVPEQADVLKTKRKNCSFKSDSRTVNSTNGSCVSTDGSRKNRKRKPNGGPSDDGESMSQPAKKKKIQWTDSLHDLFLQAIRHIGLDKAVPKKILAFMSVPYLTRENVASHLQKYRIFLRRVAEQGLYSMLSDRGIDSMFRQTHIKEPYFNYYTPSTSWYDTRLNNRSFYSKPVHGFGQSKLLSTTREPVCFNQMPYNYMNRSSTYEPHRIGSGSNLTLPIQSNLSFPNQPSQNEERRSFFEPPVMANKIAQTSQVLGFGQLGPSAISGHNFNNNMTSRYGSLIPSQPGPSHFSYGMQSFLNNENVTYNPQPPANATTQPNLDELPQLENLNLYNDFGNTSELPYNISNFQFDDNKHQQGEADPTKFELPAAKFSTELNHEDDGDWTFVNINQGQSNGETSNTIASPETNTPILNINHNQNQGQDVPEFNDWSFLDPQELVDDDFMNSLFNNDMN

SEQ ID NO: 1581 - DNA, 1193 bp, Arabidopsis thaliana
  G2571,family:AP2
attaaatagatctttaaacaaaaaaaccaaattctacttttctttcaaaaacaatctctcattatctcaatcttactcttgttcaatctcttttgaacttgaaaaaccatcattctatcaaatcaaacacaattgttagggtttctttttatcttatactccacgaaacgtctggttgagaaaaaatggaagaaagcaatgatatttttcagaacaatttcagtcctaaaatctcagaaatcagagcatctctgtctcagatcatattagcaggaggaccaaacacactcgactcaatcttctcacttctcactccctcctccgtagaatccgccacaacatcattcaacactcacaatcctccgccaccgccgcagctcgggtcctccgtctatctccgccaacgagatatcatcgagaagttccaccttcagaacagagcaatctccactcctcatcctcctctgttttcctcaacgtacgatcatcatcaaacttccgagctaatgctccaagcggcggccgggtctccagccgccgctttcgccgctgcgttagcggctgggagggtgacgaaaaagaagaaactttacagaggagtgaggcagagacattggggaaaatgggttgcggagataagattgccgcaaaacagaatgagggtttggttaggtacttacgacacggcggaagccgccgcttacgcttacgatcgcgccgcctataagctccgtggagaatacgctcgtctcaattttcctaatctcaaagacccgagtgagctactcggactcggagattcctctaagctaatagctctcaagaacgccgtcgacgggaagatccaatccatttgccagagagtcagaaaagagagagcaaaaaagagcgtaaaagtgagcaaaaactcgtcggccacggcggattcttcgtgtttgtcatcgccggagattctgtcgtcgtctccggtgacgacaactactactgcggttacttcagaggatagttattgggtttcacctatgggtttgtgtaacagtgaaaatagttctccggtatcagtttcggtccctagtgaagtaccggcgacggcggaggaagaggcaatgatgggagtggacactgatgggtttttattagcgaggatgccatcgttcgatccagagctgatttgggaagttcttgccaattaa

SEQ ID NO: 1582 - protein, 335 aa, Arabidopsis thaliana
  G2571,AP2 domain coordinates 133-200
MEESNDIFQNNFSPKISEIRASLSQIILAGGPNTLDSIFSLLTPSSVESATTSFNTHNPPPPPQLGSSVYLRQRDIIEKFHLQNRAISTPHPPLFSSTYDHHQTSELMLQAAAGSPAAAFAAALAAGRVTKKKKLYRGVRQRHWGKWVAEIRLPQNRMRVWLGTYDTAEAAAYAYDRAAYKLRGEYARLNFPNLKDPSELLGLGDSSKLIALKNAVDGKIQSICQRVRKERAKKSVKVSKNSSATADSSCLSSPEILSSSPVTTTTTAVTSEDSYWVSPMGLCNSENSSPVSVSVPSEVPATAEEEAMMGVDTDGFLLARMPSFDPELIWEVLAN

SEQ ID NO: 1583 - DNA, 1647 bp, Arabidopsis thaliana
  G2574,family:WRKY
atggaggttcttttgaaattaccctcttcagagtctcctcttaaggataaatttggatctgttcaaatccatgaagctaataagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacgatgaatgatggttgtcaatggagaaaatatggacaaaagattgcgaaaggaaatccatgtccacgagcatattatcgctgcacggttgcacctggatgtcccgttagaaaacaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagctag

SEQ ID NO: 1584 - protein, 548 aa, Arabidopsis thaliana [sequence omitted]

SEQ ID NO: 1585 - DNA, 849 bp, Arabidopsis thaliana
  G2575,family:WRKY
atggatgatcatgttgagcacaattataacacatctttagaagaagtacacttcaagagcttaagtgattgcttacaaagctcattagtaatggattataactcactagagaaggtcttcaaattctcaccttatagttccccttttcaatcggtttcaccgtcagtaaacaacccttacttaaatctcacttcgaattctccggtggtctcatcttcctccaatgaaggcgagcctaaagagaacaccaacgataagagtgaccaaatggaggataacgaaggcgacctacatggtgttggtgaaagctccaagcaactgacaaaacaaggtaaaaagaaaggagagaagaaagagagagaagttagggttgcatttatgaccaaaagcgagattgatcatcttgaagatggttatagatggcgaaaatatggacaaaaagcagtgaagaacagcccttatccaaggagttactataggtgcacaacacagaagtgtaacgtgaagaaacgtgtagagagatcgtttcaagatccgtcgatcgtaattacaacctacgaaggaaaacacaaccatccgatcccatcgacgttgagaggaaccgtggcagctgaacatctactagtccaccgtggtggtggaggcagtttactccatagcttccctcgtcaccatcaagattttctcatgatgaaacattctccggccaattatcaatcggtgggatctctgtcgtacgaacatggccatgggacctctagttacaattttaataataatcaaccagttgttgactatggtcttcttcaggacattgttccttcaatgttctccaagaacgagtcttga

SEQ ID NO: 1586 - protein, 282 aa, Arabidopsis thaliana
  G2575,WRKY domain coordinates 137-192
MDDHVEHNYNTSLEEVHFKSLSDCLQSSLVMDYNSLEKVFKFSPYSSPFQSVSPSVNNPYLNLTSNSPVVSSSSNEGEPKENTNDKSDQMEDNEGDLHGVGESSKQLTKQGKKKGEKKEREVRVAFMTKSEIDHLEDGYRWRKYGQKAVKNSPYPRSYYRCTTQKCNVKKRVERSFQDPSIVITTYEGKHNHPIPSTLRGTVAAEHLLVHRGGGGSLLHSFPRHHQDFLMMKHSPANYQSVGSLSYEHGHGTSSYNFNNNQPVVDYGLLQDIVPSMFSKNES

SEQ ID NO: 1587 - DNA, 1276 bp, Arabidopsis thaliana
  G2579,family:AP2
ccaaaaaaaaacttactcatcataagatatctttaaccaaaaccctaaaagaaacctcctttcaaaaaaaccatttcttcatcatcatgtcaacctccaaaaccctagaccataataaaccatttgaaacatcccaaacgcaaatgggttttgctctgatccaccaaaacacatccgccaacacaaccaccaccaccacaaccggcgagagacgaggccggagatcaaagcaagcggagccagggaggttcctaggagtccggagacgtccatggggtcgttacgcagccgagataagagatccaaccaccaaagaacgtcactggctaggcactttcgacacagctcacgaagctgctcttgcctacgatagagctgctctttcaatgagaggtactcaagctcgaaccaacttcgtctacactccaactgatgtccacaccatcctcacaaaccctaatctccactctctcattgtctctccttacaataacaaccaatctttcttaccaaactcttctccacagtttgtcatcgatcatcatcctcattatcaaaactatcatcaaccacaacaacctaaacacactctcccccaaactgtcttacccgcggcttctttcaaaacgccagttcgtcatcaaagcgtggatattcaagcgtttggtaatagtcctcaaaactcatcttctaacggctcgttatcttcttcactagacgaagaaaacaacttcttcttctctttaacaagcgaagaacataataagtccaataacaactcgggttacttggattgcattgtcccaaaccactgccttaaaccacctccggaggccaccaccacccaaaatcaagccggagctagtttcacaactccggtagcaagcaaagcctctgaaccatatggagggtttagtaatagctacttcgaagatggtgagatgatgatgatgaatcatcatgagtttggttcgtgtgatctctctgccatgatcacgaactatggtgctgctgccgcttcaatgtcaatggaagattacgggatgatggagccgcaagatttatcttcttcttctatcgctgcttttggagatgtcgttgcagacactacaggcttctactcagtcttttagaacattctatattatatatgttttttatatatgcaataatattattagtatttacgttattcgatggtcgtttgattgttgttgttaactatatgttatcgactttattatataaatcctgcttattgtttcatgcatcataa

SEQ ID NO: 1588 - protein, 348 aa, Arabidopsis thaliana
  G2579,AP2 domain coordinates 52-119
MSTSKTLDHNKPFETSQTQMGFALIHQNTSANTTTTTTTGERRGRRSKQAEPGRFLGVRRRPWGRYAAEIRDPTTKERHWLGTFDTAHEAALAYDRAALSMRGTQARTNFVYTPTDVHTILTNPNLHSLIVSPYNNNQSFLPNSSPQFVIDHHPHYQNYHQPQQPKHTLPQTVLPAASFKTPVRHQSVDIQAFGNSPQNSSSNGSLSSSLDEENNFFFSLTSEEHNKSNNNSGYLDCIVPNHCLKPPPEATTTQNQAGASFTTPVASKASEPYGGFSNSYFEDGEMMMMNHHEFGSCDLSAMITNYGAAAASMSMEDYGMMEPQDLSSSSIAAFGDVVADTTGFYSVF

SEQ ID NO: 1589 - DNA, 653 bp, Arabidopsis thaliana
  G2583,family:AP2
caaatcagaaaatatagagtttgaaggaaactaaaagatggtacattcgaggaagttccgaggtgtccgccagcgacaatggggttcttgggtctctgagattcgccatcctctattgaagagaagagtgtggcttggaactttcgaaacggcagaagcggctgcaagagcatacgaccaagcggctcttctaatgaacggccaaaacgctaagaccaatttccctgtcgtaaaatcagaggaaggctccgatcacgttaaagatgttaactctccgttgatgtcaccaaagtcattatctgagcttttgaacgctaagctaaggaagagctgcaaagacctaacgccttctttgacgtgtctccgtcttgatactgacagttcccacattggagtttggcagaaacgggccgggtcgaaaacaagtccgacttgggtcatgcgcctcgaacttgggaacgtagtcaacgaaagtgcggttgacttagggttgactacgatgaacaaacaaaacgttgagaaagaagaagaagaagaagaagctattattagtgatgaggatcagttagctatggagatgatcgaggagttgctgaattggagttgacttttgactttaacttgttgcaagtccacaaggggtaagggttttc

SEQ ID NO: 1590 - protein, 189 aa, Arabidopsis thaliana
  G2583,AP2 domain coordinates 4-71
MVHSRKFRGVRQRQWGSWVSEIRHPLLKRRVWLGTFETAEAAARAYDQAALLMNGQNAKTNFPVVKSEEGSDHVKDVNSPLMSPKSLSELLNAKLRKSCKDLTPSLTCLRLDTDSSHIGVWQKRAGSKTSPTWVMRLELGNVVNESAVDLGLTTMNKQNVEKEEEEEEAIISDEDQLAMEMIEELLNWS

SEQ ID NO: 1591 - DNA, 792 bp, Arabidopsis thaliana
  G2585,family:WRKY
atgaactcttgccaacaaaaggctatggagaagttgcttcacgggcatgggtgcgccaaccagctgctcatcatggaccagaccgagtcagactcgtccatggaaagggaggatttggccaagtccgtcctccattgtttctcagatgcgctctccatcttgatcgatactaatgaccaccaagacgatcaatccaataactcatctcctcaggactcttctcctgtgcttgagagctccaggaaaccacttcacaagaggggaagaaagacatctatggcagagagctcagactaccatagacacgaatcttcaaccccgatctaccacgacggcttcctctggaggaaatacggacaaaagcagatcaaagaatctgagtaccaaaggagttactacaagtgtgcctacaccaaggaccagaactgtgaagcaaagaagcaggttcaaaagatccaacacaatcctccattgtactcaaccacttacttcggccagcacatatgccagcttcatcaagcttatgcaactttccccattgacacatctgacttcgaagagcacgagggatcccacatgatccgattcggtcaccccaatatcagcttctcctcctccacctctaacctccgccaacatcagaatcatcaggatcgcatcaaagatgaatacatgaaaccggtgatagcagaagattggtctccatcccagtggatgtcgtccgaggttgccctcgccgtggaggctttcgagtttaatcctttctggacatctcacgacttatcatcatga

SEQ ID NO: 1592 - protein, 263 aa, Arabidopsis thaliana
  G2585,WRKY domain coordinates 103-162
MNSCQQKAMEKLLHGHGCANQLLIMDQTESDSSMEREDLAKSVLHCFSDALSILIDTNDHQDDQSNNSSPQDSSPVLESSRKPLHKRGRKTSMAESSDYHRHESSTPIYHDGFLWRKYGQKQIKESEYQRSYYKCAYTKDQNCEAKKQVQKIQHNPPLYSTTYFGQHICQLHQAYATFPIDTSDFEEHEGSHMIRFGHPNISFSSSTSNLRQHQNHQDRIKDEYMKPVIAEDWSPSQWMSSEVALAVEAFEFNPFWTSHDLSS

SEQ ID NO: 1593 - DNA, 765 bp, Arabidopsis thaliana
  G2587,family:WRKY
atggtttccaacattgatcacaaggctatggaagcactcctccgtggccaaggatgcgctaacaacctcaagattctccttgaaaacggcgaaataagctcagtttcaacagaaccactcatccacaccattctcgattctttctcacttgctctgtcttttatggattctcctaatcatccaccataccatgaatcctcttctcataacatggcaagtcatatgtcccggagatcatctaagcaagtacaacatcgcagaaaactttgtgtagcagaaggtttagtgaattacaatcacgattcccggactatgtgccccaatgatggcttcacctggaggaaatatggacaaaaaaccattaaagcctcagcgcacaaaaggtgttactatcggtgtacctatgcaaaagaccaaaactgcaatgctacaaagcgggtgcagaagatcaaagacaaccctccagtgtacagaaccacttacttgggaaaacatgtgtgtaaagcttttgcagttcatgatgatacatatagttccacgatgattcgattcgaccaagttgttcctgaaccgattatgccgcagctcacaacaattgaccaccaagtaattaccgtggaggaaaactccgcagaacatatcatgaaccaagaatgtgatattaatgattatttggtggatgatgacccattttgggctagtcaatttcccccgtttccatcgagtgacacaatgttcttggaaaacatttctgcttttgattag

SEQ ID NO: 1594 - protein, 254 aa, Arabidopsis thaliana
  G2587,WRKY domain coordinates 108-165
MVSNIDHKAMEALLRGQGCANNLKILLENGEISSVSTEPLIHTILDSFSLALSFMDSPNHPPYHESSSHNMASHMSRRSSKQVQHRRKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 1595 - DNA, 1379 bp, Arabidopsis thaliana
  G2589,family:MADS
aaagaaaagaaaaataaagataatgaggacgaagactaagttagtactcatacctgatagacactttcggagagccacattcaggaagaggaatgcagggataaggaagaaactccacgagctgacaactctctgtgacatcaaagcatgtgcggtaatctacagtccgttcgagaatccaacggtgtggccgtcaaccgaaggtgttcaagaggtgatttcggagttcatggagaagccggcgacagaacggtccaagacgatgatgagtcatgagactttcttgcgggaccaaatcaccaaagaacaaaacaaactagagagtctacgtcgtgaaaaccgagaaactcagcttaagcattttatgtttgattgcgttggaggcaagatgagtgagcaacagtatggtgcaagggaccttcaagatttaagtctttttactgatcaatatcttaatcagcttaatgccaggaagaagttccttacagaatatggtgagtcttcttcttctgttcctcctctgtttgatgttgcgggtgccaatcctcctgttgttgcagatcaagctgcggtaactgttcctcctttgtttgctgttgcgggtgccaatcttcctgttgttgctgatcaagctgcggtaactgttcctcctctgtttgctgttgcgggtgccaatcttcctgttgttgcagatcaagctgcggttaatgttcctactggatttcataacatgaatgtgaaccagaatcagtatgagccggttcagccctatgtccctactggttttagtgatcatattcaatatcagaatatgaacttcaatcaaaaccaacaagagccggttcattaccaggctcttgctgttgcgggtgccggtcttcctatgactcagaatcagtatgagcccgttcactaccagagtcttgctgtcgcgggtggcggtcttcctatgagtcagttgcagtatgagccggttcagccttatatccctactgtttttagtgataatgttcaatatcagcatatgaatttgtatcaaaatcaacaagagccggttcactaccaagctcttggtgttgcaggtgccggtcttcctatgaatcagaatcagtatgagccggttcagccctatgtccctactggttttagtgatcattttcagtttgagaatatgaatttgaatcaaaatcaacaggagccggttcaataccaagctcctgttgattttaatcatcagattcaacaaggaaactatgatatgaatttgaaccagaatatgagtttggatccaaatcagtatccgtttcaaaatgatccattcatgaatatgttgacagaatatccttatgaataagcgggttatgttggagagcatgcac

SEQ ID NO: 1596 - protein, 443 aa, Arabidopsis thaliana
  G2589,MADS domain coordinates 1-57
MRTKTKLVLIPDRHFRRATFRKRNAGIRKKLHELTTLCDIKACAVIYSPFENPTVWPSTEGVQEVISEFMEKPATERSKTMMSHETFLRDQITKEQNKLESLRRENRETQLKHFMFDCVGGKMSEQQYGARDLQDLSLFTDQYLNQLNARKKFLTEYGESSSSVPPLFDVAGANPPVVADQAAVTVPPLFAVAGANLPVVADQAAVTVPPLFAVAGANLPVVADQAAVNVPTGFHNMNVNQNQYEPVQPYVPTGFSDHIQYQNMNFNQNQQEPVHYQALAVAGAGLPMTQNQYEPVHYQSLAVAGGGLPMSQLQYEPVQPYIPTVFSDNVQYQHMNLYQNQQEPVHYQALGVAGAGLPMNQNQYEPVQPYVPTGFSDHFQFENMNLNQNQQEPVQYQAPVDFNHQIQQGNYDMNLNQNMSLDPNQYPFQNDPFMNMLTEYPYE

SEQ ID NO: 1597 - DNA, 1099 bp, Arabidopsis thaliana
  G2590,family:MADS
cacacaccaaagaaaagaaaaacaaagataatgaggtcgaaaattaagttatcactcatagctaataagacctcaaggagaaccacattcaggaagaggaagggagggataacgaacaaactccatgagctaacaactctctgcggcgtcaaagcatgtgcggtaatctccagtccgtacgagaatccagtggtgtggccgtcaaccgaaggtgttcaagaggcggtttccatgtttatggagaggccggcgacagaacaatccaagctgatgatgagtcatgagacctacttgcaggacaaaattaccaaagaaacaaagaaactggagagtctacgtcgtgaaaaccgagaatctcagcttaggcaatttatgtttgattgtgttgaaggtaagatgagtgagcatcagtatggtgcaagggaccttcaagatttaagtctttatattgatcactatatcaatcagcttaattcaagtgtcatgctccttacaaacaatggtgcgtcttcttcttcctttcctcctccgcttcatacttcagttgcgggtgcgggtgcgggtgcgggtgctgctcctcttgttgttgcgggtgcgggtgcggctcctcttgctgttgcgggggcgggtgcgagtcctcttgctgttgcgggtgtgggtgcggctcctcttgctgttgcgggtgccggtcctcctatggctcagaatcagtatgagccgattcagccctatatccctactgcttttagtgataatattcaataccaagctcctgtggattttaatcatcagatccaacatggaatctatgataatctcagtttggatccaaatcatcagtatccgtttcaagatgatccattcatggagatgttgatggaatatccttatgaacaagtgggttatgctgcagagcatgcacacatccctttcatgaacggaaactactacaactaccaccaaccaccaaccgttggtcttactaccaccggtcacatgccttccaacaacgccaccaccaccaccaccaccaacaccaccgttgtgtgatgtgtttcagtagtttgcatttgtgttttgtccatttcaaaagaccaat

SEQ ID NO: 1598 - protein, 339 aa, Arabidopsis thaliana
  G2590,MADS domain coordinates 2-57
MRSKIKLSLIANKTSRRTTFRKRKGGITNKLHELTTLCGVKACAVISSPYENPVVWPSTEGVQEAVSMFMERPATEQSKLMMSHETYLQDKITKETKKLESLRRENRESQLRQFMFDCVEGKMSEHQYGARDLQDLSLYIDHYINQLNSSVMLLTNNGASSSSFPPPLHTSVAGAGAGAGAAPLVVAGAGAAPLAVAGAGASPLAVAGVGAAPLAVAGAGPPMAQNQYEPIQPYIPTAFSDNIQYQAPVDFNHQIQHGIYDNLSLDPNHQYPFQDDPFMEMLMEYPYEQVGYAAEHAHIPFMNGNYYNYHQPPTVGLTTTGHMPSNNATTTTTTNTTVV

SEQ ID NO: 1599 - DNA, 1567 bp, Arabidopsis thaliana
  G2592,family:TUBBY
gagaaaaaacagcaaagaaaatcagagagatcaaaaaaaagaaaaaaaagaacagagattcttttgaactaacgaagacatatcgtttctctaaagtagaatctttggtattcggaaaaatgtcgtttctgagtattgttcgtgatgttagagatactgtaggaagcttttcgagacgtagtttcgacgtgagagtatctaatgggacgactcatcagaggagtaaatctcacggtgttgaggcacatattgaagatcttattgtaatcaagaacactcgttgggctaatttaccggctgcgctattacgagatgtgatgaaaaagttggatgaaagcgagagtacttggcctgcacgtaaacaagtcgttgcttgtgctggtgtctgcaagacatggagactaatgtgcaaagatattgtgaaaagtcctgagttctcaggcaaactcacatttccagtttcgttgaaacagcccgggcctagggatggaatcatacaatgttatatcaaaagagacaagtctaacatgacttaccacctttacctttctcttagtcctgccatacttgttgaaagtgggaagtttcttctctcggcaaagcgctcacggagagctacatacacagagtatgtaatatcaatggatgcagacaacatttcaagatcaagcagcacttacattggcaaactgaagtctaactttctagggacaaaatttatagtatatgatacggctcctgcgtacaacagtagccagatattgtccccaccaaaccggagtcgtagtttcaactccaagaaagtgtctcccaaagtcccttctggaagttacaacattgctcaagttacatacgagctgaacttgcttggaacccgtggacctcgtagaatgaactgcattatgcactctatcccctccttagctctagaacccggaggtactgtccctagccaacctgagtttctacaacgttcccttgatgaatctttccgcagcatcggttcctcaaagatagtcaaccactcgggagatttcacccgaccgaaagaggaagaaggaaaggtgcgacctttggtactgaaaactaaaccgccaaggtggctccaaccgttgcgatgttggtgccttaacttcaaagggagagtgactgtagcttctgtcaagaacttccagttgatgtccgctgcaacggttcagcccggtagtggtagtgatggtggagcattggctacgaggccatcgttatcaccacagcagccagagcaatcaaaccatgataagataatactacactttgggaaagtgggtaaggatatgttcactatggactatcgttatcctctctctgcctttcaagcgtttgccatttccctgagcacctttgatactaaattggcatgtgaataaaagtagaaagatcataagagggacttaaaactaataggaaccgtttacgatatgcgagggtttgtttgtttttgtttatctgtctgatctggtgtgttagtgaatgtgaacttttgtggttgtttatcttcgaaaagaaaaaataagtgttggtgacc

SEQ ID NO: 1600 - protein, 429 aa, Arabidopsis thaliana
  G2592,TUBBY domain coordinates 119-429
MSFLSIVRDVRDTVGSFSRRSFDVRVSNGTTHQRSKSHGVEAHIEDLIVIKNTRWANLPAALLRDVMKKLDESESTWPARKQVVACAGVCKTWRLMCKDIVKSPEFSGKLTFPVSLKQPGPRDGIIQCYIKRDKSNMTYHLYLSLSPAILVESGKFLLSAKRSRRATYTEYVISMDADNISRSSSTYIGKLKSNFLGTKFIVYDTAPAYNSSQILSPPNRSRSFNSKKVSPKVPSGSYNIAQVTYELNLLGTRGPRRMNCIMHSIPSLALEPGGTVPSQPEFLQRSLDESFRSIGSSKIVNHSGDFTRPKEEEGKVRPLVLKTKPPRWLQPLRCWCLNFKGRVTVASVKNFQLMSAATVQPGSGSDGGALATRPSLSPQQPEQSNHDKIILHFGKVGKDMFTMDYRYPLSAFQAFAISLSTFDTKLACE

SEQ ID NO: 1601 - DNA, 1419 bp, Arabidopsis thaliana
  G2603,family:TUBBY
cctttttccacctaaactcgttatatctttaaaagactcagcctttaagtatccccagaagtcgtatgaccttacgtagcttaatccttgagatgcgttcgagaccgcatcgtgtggtccacgaccttgccgccgccgcagctgccgattccacttctgtgtcatcgcaagattatcgctggtcagagattcctgaagagcttcttagggagattctgattcgtgttgaagcggcggacggtggcggatggccgtcacgacgcagcgtggtggcttgtgccggcgtttgtcgtggctggcggctacttatgaacgaaaccgtcgttgtccctgagatctcttctaagttgactttccccatctctctcaagcagcctggtccaagggattcactggttcaatgctttatcaaacgtaatcgaattacgcaatcatatcatctctatctcggattaaccaactctttaacggatgatgggaagtttttgcttgctgcgtgtaagttgaagcacacaacttgtacggattacattatctctttacgttctgatgatatgtcgagaagaagccaagcttatgttggcaaagtgagatcgaacttcctaggaacgaaattcactgtctttgatggaaatctgctgccttcaacgggagccgcaaagttgagaaagagccgatcttataatcccgcaaaagtttcagcaaaagttcctcttggaagttatcctgtcgctcatatcacatatgagctgaatgtcttaggatcccggggaccaagaaagatgcaatgtcttatggacacaatacctacaagcacaatggagcctcaaggagtagcttcagaaccatcagagtttcccttactcggtactcggtcaaccttatccaggtctcagtcaaaaccattacgcagtagctcaagccacctgaaagaaacaccattagtgctgagcaacaagacaccacggtggcacgagcagctacgctgctggtgcttgaatttccatggccgtgtcacagtagcgtcagtgaagaactttcagctcgtggcagcaggagctagctgtggcagtggcacgggaatgtcaccggagaggcagagcgagcggattatattgcagtttgggaaagtcgggaaagatatgttcacgatggattatggatacccgatctcagctttccaggcttttgccatttgcttgagcagctttgagactagaatcgcttgtgaatgatttacaagactttgttaagatatcgctatatctatcttgtaaagagcaatttgtagccttttgtaaattgtgttctttttaaaaacaacgagtcgttgtcttgtgtttgataatgttacagttccttttgttttgtagcttttttgtacattgtgatcttgcaagaaaatcaactctattgcta

SEQ ID NO: 1602 - protein, 389 aa, Arabidopsis thaliana
  G2603,TUBBY domain coordinates 104-389
MTLRSLILEMRSRPHRVVHDLAAAAAADSTSVSSQDYRWSEIPEELLREILIRVEAADGGGWPSRRSVVACAGVCRGWRLLMNETVVVPEISSKLTFPISLKQPGPRDSLVQCFIKRNRITQSYHLYLGLTNSLTDDGKFLLAACKLKHTTCTDYIISLRSDDMSRRSQAYVGKVRSNFLGTKFTVFDGNLLPSTGAAKLRKSRSYNPAKVSAKVPLGSYPVAHITYELNVLGSRGPRKMQCLMDTIPTSTMEPQGVASEPSEFPLLGTRSTLSRSQSKPLRSSSSHLKETPLVLSNKTPRWHEQLRCWCLNFHGRVTVASVKNFQLVAAGASCGSGTGMSPERQSERIILQFGKVGKDMFTMDYGYPISAFQAFAICLSSFETRIACE

SEQ ID NO: 1603 - DNA, 549 bp, Arabidopsis thaliana
  G2604,family:Z-LSDlike
tcgacgagattgagagaagagatttatccaaaaaaatattgcaattcttcttggagtgaataatgccagtccctcttgcaccatatccaacacctccggcaccggcactggctccgtcgtacaacactcctccggcaaatggaagtacaagtgggcagagccagttagtgtgttcaggttgcagaaaccttctgatgtatcccgtcggagcaacctccgtctgttgcgccgtctgtaacgccgtcacggccgttcctccgcccggaacggagatggcacagttggtatgtggaggatgtcatacactcttaatgtacattcgtggagctacaagtgttcaatgttcttgttgtcacactgttaatctcgccctcgaagcaaaccaagtagcgcatgtgaattgcggaaactgcatgatgctactaatgtatcaatatggagcaagatcagtgaaatgtgccgtttgtaactttgtcacatctgttgggggttcaacgagcacgactgattcgaagtttaacaattaaaacttggatctatctacctatc

SEQ ID NO: 1604 - protein, 154 aa, Arabidopsis thaliana
  G2604,Z-LSDlike domain coordinates 34-64,73-103
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 1605 - DNA, 795 bp, Arabidopsis thaliana
  G2616,family:HB
tcacttccacattgtcttcttcatatggtaaaaaggagagaggagaaggcaaagtggtgaaagaggagatggagcaagagagcctaaacggtaggtatggtagtagagtaatgacggatgaacaaatggagactcttcgtaagcaaatcgccatttacgccgttctttgcgaccagctcgtcttcctccacaactctctctcttctgtccctcttctttcatcaggaatgaatccaatgagaggtgagtattttgatccaatggtggcatcgtcaagcgctcatggaatgtcgactcggcctcgatggactcctacgacaacgcaacttcagattcttgagaacatttacaaggaaggcagtggaacaccaaatccgcggaggattaaagagatcacgatggaactgtctgaacatggacaaatcatggagaaaaatgtataccattggtttcaaaaccgacgagctcggtccaaacgaaagcaacctccgacaacgacaattacctcgagtcaggcggatgatgcggccgtgacaacaactgaggagagagggaggtgtggagatgattctggagggtttgagtcttatgagcatatactgttcccgagtcctgatttagggattgagcatttgttgaatagggacaagtttatagactgagtgaaacaaagatgatgaactctccaacctctctgtttttatttggttttctcaataaattgatatcatcgtatatgattgtgtgagggagaccttgaacaagtttttttttactgtagaatttgtttttccg

SEQ ID NO: 1606 - protein, 197 aa, Arabidopsis thaliana
  G2616,HB domain coordinates 79-139
MEQESLNGRYGSRVMTDEQMETLRKQIAIYAVLCDQLVFLHNSLSSVPLLSSGMNPMRGEYFDPMVASSSAHGMSTRPRWTPTTTQLQILENIYKEGSGTPNPRRIKEITMELSEHGQIMEKNVYHWFQNRRARSKRKQPPTTTITSSQADDAAVTTTEERGRCGDDSGGFESYEHILFPSPDLGIEHLLNRDKFID

SEQ ID NO: 1607 - DNA, 678 bp, Arabidopsis thaliana
  G2617,family:Z-C2H2
atggatagaggagaatgcttgatgtcgatgaagcttagaccgatggtgacgaggccatcttcggatgggactttattttggccgtttagggaagagagagcgtttgcgtcagctgaggagtatggcggcggaggtggttgcatgtggccaccgaggtcttactcatgcagcttttgcgggagagagttcaagtcggcgcaagcactaggcggtcatatgaacgttcatcgaagagaccgagctcgactcaaacaacaatcattatcaccttcatcaactgaccaagccacacctcctgaatgtgatcgtcaacaacaagttcttgatgtgggatcaaaggttcttgttcaagaagaaacaagaaagcctaacggaaccaagagggagataagtgatgtttgtaataacaacgttttagaaagttctatgaaaagatatgaacatgacaatggtgaagtcaagactgacttatcggtcggtctactgagtactgagtttgatcctcggaagaagcaactaatcaacggatcatcttcgtcatggaagagggcaaagacggatgtgtcaagatttccaatgatgttagggttggtcattggaatttccgagatcaacggccatcatgaggagttggatcttgagctaaggctaggagctgatccgcctaaggttaactag

SEQ ID NO: 1608 - protein, 225 aa, Arabidopsis thaliana
  G2617,Z-C2H2 domain coordinates 57-77
MDRGECLMSMKLRPMVTRPSSDGTLFWPFREERAFASAEEYGGGGGCMWPPRSYSCSFCGREFKSAQALGGHMNVHRRDRARLKQQSLSPSSTDQATPPECDRQQQVLDVGSKVLVQEETRKPNGTKREISDVCNNNVLESSMKRYEHDNGEVKTDLSVGLLSTEFDPRKKQLINGSSSSWKRAKTDVSRFPMMLGLVIGISEINGHHEELDLELRLGADPPKVN

SEQ ID NO: 1609 - DNA, 696 bp, Arabidopsis thaliana
  G2628,family:bZIP
gtgtgatatcgaaatccaaaaatctccctcttcctttctctatttctttcttaaattccatcatctagaaatttcaaagcctcataatttcaatcttttagaagggactccatcgcgtaacaataatttcaactcaatgttccaacaaaacttacatgatgaagacgacgtccatgttcaagaccatgtctacaatcatgaccagtaccatcatcaacaaccgaatgttgtgacggatgaagagaagaggttaaggagaatggcgtctaatcgagaatcagcaagaagaacgcggatgcgtgagcggatgatgaaagaggggttgcaaatgcaagtaaaacaactcatggcgtacaatcaattcttgtataacaaatatattagcttgttggagtacaatcaccagatcttgcaagagaattcacagctcaaagagacagtttcatcctttcatgatcaatatactatatcttatggaaaccatgaaggtatacttggaaacaccaatgatttcgatttaaaccaactatcttcgtatcaaccatcttaactggtaagtcgaaaaatattatttttagtggaaaatggttctaatgtaattagcttcttttattatttatctctctactggattctatctatatagaataataattgtcaatacatttgcttcatgatttctcaatatatttctag

SEQ ID NO: 1610 - protein, 137 aa, Arabidopsis thaliana
  G2628,bZIP domain coordinates 36-105
MFQQNLHDEDDVHVQDHVYNHDQYHHQQPNVVTDEEKRLRRMASNRESARRTRMRERMMKEGLQMQVKQLMAYNQFLYNKYISLLEYNHQILQENSQLKETVSSFHDQYTISYGNHEGILGNTNDFDLNQLSSYQPS

SEQ ID NO: 1611 - DNA, 492 bp, Arabidopsis thaliana
  G2631,family:CAAT
atggatccgatggatatagttggaaaatcaaaggaagatgcttcgcttccgaaagctaccatgacgaaaattataaaggagatgttacccgcagatgttcgtgttgctagagatgctcaagatctattgattgagtgttgtgtagagttcataaatcttatatcgtcggagtcgaatgaagtgtgtaacaaagaggataaacgaacaatagcccctgagcacgtactcaaagctttacaggttcttggctttggggaatacgtagaagaagtttatgccgcgtatgagcaacataaatatgaaaccatgcaggattcgcagagaagtgtgaagatgaatagcggagcagagatgacggaagaagaggcggcagcggaacaacagaggatgtttgcagaagctcgagcaagaatgaatggaggtgttacagttcctcaaccagagcaactagaagaaccccaacaacaacaacaaacaagtctacaaagctaa

SEQ ID NO: 1612 - protein, 163 aa, Arabidopsis thaliana
  G2631,CAAT domain coordinates 11-99
MDPMDIVGKSKEDASLPKATMTKIIKEMLPADVRVARDAQDLLIECCVEFINLISSESNEVCNKEDKRTIAPEHVLKALQVLGFGEYVEEVYAAYEQHKYETMQDSQRSVKMNSGAEMTEEEAAAEQQRMFAEARARMNGGVTVPQPEQLEEPQQQQQTSLQS

SEQ ID NO: 1613 - DNA, 912 bp, Arabidopsis thaliana
  G2632,family:CAAT
atgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatga

SEQ ID NO: 1614 - protein, 303 aa, Arabidopsis thaliana [sequence omitted]

SEQ ID NO: 1615 - DNA, 1473 bp, Arabidopsis thaliana
  G2633,family:SCR
atgtacaagcagcctagacaagagcttgaggcttattattttgagcctaactctgttgagaagcttaggtacttaccggttaacaactctcgtaaacggttttgtacgctcgagccatttcctgactctcctccttataatgctctatctactgctacatatgatgatacatgtggctcttgtgtaacggatgagttgaatgacttcaaacacaagattagggaaatcgaaacggtgatgatggggccggactcgttggacttacttgtcgattgcacggactcatttgattccacggcgagtcaagagattaatggttggagatcaactctagaggctatctcgaggcgggatttaagagctgatcttgtttcatgtgccaaagctatgtcggaaaatgatcttatgatggctcattcaatgatggagaagttgcggcagatggtttcggtttctggtgagcctattcaacggttgggagcttacttattggaaggtctagtggcgcagctagcttcgtcgggcagttctatatacaaagcacttaataggtgtcctgaaccggctagcacagagcttctctcttacatgcacattctctatgaggtttgtccttacttcaagtttggatacatgtcagcaaatggtgctattgctgaggcaatgaaggaagaaaacagagttcacattattgatttccaaatcggtcaagggagtcaatgggtcactcttatccaggcttttgcagctaggcctggtgggcctccgcggattcggataacgggtatcgatgatatgacttcagcgtatgctcgtggaggtggcctaagcattgttggaaatagactcgctaagcttgctaagcagttcaacgttccattcgagtttaactcggtatcggtgtcagtttccgaggttaaacctaaaaacctcggggttcgacctggggaagctctagccgtaaactttgcctttgtgcttcatcatatgccagacgaaagcgtgagcaccgagaatcaccgcgaccggttattgagaatggtgaagagcttatctcccaaggtggtgactcttgtggaacaagagtcaaacacaaacacagccgctttcttcccgaggttcatggagacaatgaactactatgccgcgatgtttgagtcaattgatgtgactctaccaagagatcacaaacagaggattaatgtggagcaacattgtctagcaagagatgtcgtgaacatcatcgcatgtgaaggagctgatcgggtggagcgacacgagctcctaggaaaatggaggtcacggtttgggatggcgggtttcactccttacccgttgagtcccttggtgaattcaaccattaaaagtctgcttaggaactactcagacaagtacaggctagaagaaagagatggagctttgtatcttggttggatgcatcgagatttggttgcctcgtgtgcttggaaatga

SEQ ID NO: 1616 - protein, 490 aa, Arabidopsis thaliana
  G2633,SCR domain coordinates 197-262,325-413,417-489
MYKQPRQELEAYYFEPNSVEKLRYLPVNNSRKRFCTLEPFPDSPPYNALSTATYDDTCGSCVTDELNDFKHKIREIETVMMGPDSLDLLVDCTDSFDSTASQEINGWRSTLEAISRRDLRADLVSCAKAMSENDLMMAHSMMEKLRQMVSVSGEPIQRLGAYLLEGLVAQLASSGSSIYKALNRCPEPASTELLSYMHILYEVCPYFKFGYMSANGAIAEAMKEENRVHIIDFQIGQGSQWVTLIQAFAARPGGPPRIRITGIDDMTSAYARGGGLSIVGNRLAKLAKQFNVPFEFNSVSVSVSEVKPKNLGVRPGEALAVNFAFVLHHMPDESVSTENHRDRLLRMVKSLSPKVVTLVEQESNTNTAAFFPRFMETMNYYAAMFESIDVTLPRDHKQRINVEQHCLARDVVNIIACEGADRVERHELLGKWRSRFGMAGFTPYPLSPLVNSTIKSLLRNYSDKYRLEERDGALYLGWMHRDLVASCAWK

SEQ ID NO: 1617 - DNA, 961 bp, Arabidopsis thaliana
  G2636,family:NAC
tcttcttgtgccgacaatggatgttgatgtgtttaacggttgggggaggccaagatttgaagatgaatcccttatgccacctgggtttaggtttcatccaactgatgaagagctgatcacttactatctcctcaagaaggttcttgactctaatttctcttgtgccgccatttctcaagttgatctcaacaagtctgagccttgggagcttcctgagaaagcgaaaatgggggagaaggagtggtacttcttcacactaagagaccgtaaatacccaacgggactgagaacgaacagagcaacagaagctggttactggaaagccactggtaaagacagagagatcaaaagctcaaagacaaaatcacttctcgggatgaagaaaactcttgtcttttacaaaggcagagctcctaaaggagagaagagttgttgggtcatgcatgagtatcgccttgacggcaaattctcttaccattacatttcctcctccgctaaggatgaatgggttctctgtaaagtttgtctgaaaagcggcgtagttagtagagagacgaacttgatctcttcttcttcttcttctgccgtcaccggagagttctcctctgccggttctgcaattgctccgatcatcaatacctttgcgacggagcacgtgtcctgtttctccaataactctgctgctcataccgatgcgagctttcatacattccttcccgctccaccgccgtcactgcccccacgtcagccacgtcacgtcggtgatggcgtggcgtttggtcagtttctggatttgggatcatcgggacagattgatttcgatgcagcagcagcagcgttctttccgaatctaccttctctgcctcccacggttcttcctcctcctccgtcatttgcaatgtacggtggaggctcccccgccgtgagtgtgtggccgtttactctctgatcgccatgcggt

SEQ ID NO: 1618 - protein, 310 aa, Arabidopsis thaliana
  G2636,NAC domain coordinates 14-146
MDVDVFNGWGRPRFEDESLMPPGFRFHPTDEELITYYLLKKVLDSNFSCAAISQVDLNKSEPWELPEKAKMGEKEWYFFTLRDRKYPTGLRTNRATEAGYWKATGKDREIKSSKTKSLLGMKKTLVFYKGRAPKGEKSCWVMHEYRLDGKFSYHYISSSAKDEWVLCKVCLKSGVVSRETNLISSSSSSAVTGEFSSAGSAIAPIINTFATEHVSCFSNNSAAHTDASFHTFLPAPPPSLPPRQPRHVGDGVAFGQFLDLGSSGQIDFDAAAAAFFPNLPSLPPTVLPPPPSFAMYGGGSPAVSVWPFTL

SEQ ID NO: 1619 - DNA, 996 bp, Arabidopsis thaliana
  G2639,family:SRS
atggcaggatttttctcgttaggacacggcggaggaggaaacactccagacaaccacagaacaaacactaataatccttcttcatcgggaacagaatcttggctttggtgcagaaaccctaactctaacgctgacggtggagaagctggtccttcttacaaaggaacccttgagctatggcaacacccaaacaatcaagaaatcattttccagcagcagcagcaacagcaacaaaggctggatctttacacttccgctgcgggtttaggtgttggaccgagcaaccggagcttaattgaaacttccggcggtgcgttgatgatgatgagaagcggtagcggtagcggcggaccaagctgccaggattgtgggaatcaatctaagaaagactgctctcacatgagatgtaggacttgctgcaagagccgtggccttgactgtcccactcacgtgaagagcacgtgggttcctgccgctaaacgccgagaacgccagcagcagctttctaccggtcagcaaccgcagcaactgggagggagcgtccctaaacgacagagagagcgtatcccggcgagatcgacttccatggcctacactcgtataccttctaacaacacttcagggttggaggttgggaattttccgccggaagttagctcgtcggcagtttttcggtgcgtgcgtgtgagttccgtagatgatgaagaagaagagtatgcatataaaacagctgtgagtataggcggtcacgtcttcaaaggtgttctctacgatcaaggcccggccgagagaagctcctcgggcggtggatctcagccgttgaatctcataaccgcaggcccatcggcctcatcatcaagcccaaacgtgagctgcaacaatggagtcgttggctccacttcagatcattatatcgatcctgcctcacttaattatcctactcccattaacactttcatgactggtacgcacttcttctccaactcaagatcttga

SEQ ID NO: 1620 - protein, 331 aa, Arabidopsis thaliana
  G2639,SRS domain coordinates 114-167
MAGFFSLGHGGGGNTPDNHRTNTNNPSSSGTESWLWCRNPNSNADGGEAGPSYKGTLELWQHPNNQEIIFQQQQQQQQRLDLYTSAAGLGVGPSNRSLIETSGGALMMMRSGSGSGGPSCQDCGNQSKKDCSHMRCRTCCKSRGLDCPTHVKSTWVPAAKRRERQQQLSTGQQPQQLGGSVPKRQRERIPARSTSMAYTRIPSNNTSGLEVGNFPPEVSSSAVFRCVRVSSVDDEEEEYAYKTAVSIGGHVFKGVLYDQGPAERSSSGGGSQPLNLITAGPSASSSSPNVSCNNGVVGSTSDHYIDPASLNYPTPINTFMTGTHFFSNSRS

SEQ ID NO: 1621 - DNA, 1113 bp, Arabidopsis thaliana
  G2640,family:SRS
atggcggggtttttctcgctagacggtggtggaggaggaggcggaggtggaggtaacaaccaagaagatcaccggagcaacacaaatcctcctccgcctgtatcagaagcttggctctggtatagaaaccctaacgttaacgcaaacgcaaacacaaacgttaacgcaaacgctccttcttcgtcaaacgctgctttaggaacacttgagttatggcaaaaccacaatcagcaagagatcatgtttcagcatcagcaacatcagcaaaggttggatctttactcttccgccgcaggtttaggtgttggaccaagtaatcataaccaattcgatatctccggcgaaacttcaaccgccggcgccggaagagctgcggcgatgatgatgattcgtagtggtggtagcggaggaggaagtggtggtgtgagctgtcaagactgtgggaatcaagcgaagaaagattgttctcacatgaggtgtagaacttgttgtaaaagccgtggcttcgagtgttctactcacgtgagaagcacgtgggtccctgctgctaaacgccgtgagagacaacagcaattagctacggtccagcctcaaactcagctgcctcgcggtgagagcgttcctaaacgccaccgtgaaaatttaccggcaacttcatcgtctcttgtctgcactcgcataccttctcattcagggctagaagttggcaatttcccggcggaggtgagttcatcggcggtgtttaggtgcgtgcgtgtgagctcagtagaagatggagaagaagagtttgcttaccaaacagctgtaagcattggtggtcacattttcaaaggcattttatacgacctcggtcctggaagtagtggtggcggaggctacaacgttgttgccgccggtgagagctcctctggtggtggtggagctcaacagctgaatctcataacagctggctctgtaaccgttgctaccgcttcttcctctactccaaacctcggtggtattggcagctcatcagccgcggcagccacgtacattgatccagccgctctttatccaactccgatcaatacattcatggccggtacacaattctttcccaacccaagatcatga

SEQ ID NO: 1622 - protein, 370 aa, Arabidopsis thaliana
  G2640,SRS domain coordinates 146-189
MAGFFSLDGGGGGGGGGGNNQEDHRSNTNPPPPVSEAWLWYRNPNVNANANTNVNANAPSSSNAALGTLELWQNHNQQEIMFQHQQHQQRLDLYSSAAGLGVGPSNHNQFDISGETSTAGAGRAAAMMMIRSGGSGGGSGGVSCQDCGNQAKKDCSHMRCRTCCKSRGFECSTHVRSTWVPAAKRRERQQQLATVQPQTQLPRGESVPKRHRENLPATSSSLVCTRIPSHSGLEVGNFPAEVSSSAVFRCVRVSSVEDGEEEFAYQTAVSIGGHIFKGILYDLGPGSSGGGGYNVVAAGESSSGGGGAQQLNLITAGSVTVATASSSTPNLGGIGSSSAAAATYIDPAALYPTPINTFMAGTQFFPNPRS

SEQ ID NO: 1623 - DNA, 963 bp, Arabidopsis thaliana
  G2649,family:SRS
atgggcatggttggtctaagagatgtattccttgttgctccggcttatcaccaccagaacgccggagtgatatctggatccgatcatatgaacagtaatgcagctgcggcggcggcgctcggtgtcggagtgattcctctactcacggcgggtacaccgcagcaaaacgtggaagactccgacattaacttcctcggaaacaaccggagatggcagaataacaacaacaaccacgaaacgcagtatcttcacttcaagagtactaaccagacaacggtcggaacgagctcgaacaactcggggtctggctcaggcgcatcaggaaccgccacgtgtcaagactgtggaaatcaggcgaagaaagagtgtaagcagaggcggtgtaggacttgctgcaagagccgtggctttgattgttctactcacgtgaagagcacgtgggtctctgctgctcggcggagagagaggcaggtcatgcctaccggcgctaatccaacggctggctcgtctctttcgacctcctccgggacgaagaagccgaggatcgtagggtctcaacaacaacaacaacaacaagccacttctcatacttcaacttctaacacaccacctcaaagtttcgagaccagctccagccgacaagacggaggagggtcaagggaagcatggccagggcaggttagggcagcggcggtgttcaagtgtgttagagtaacggcagtggaggacggggatgatgagtacgcgtaccaagcggtggtgaaaatcggcggccatgtctttaaaggattcttgtacgatcaagggcttgaaccaaaagaaggttttcctagtatgtcggatttgcatttaggtggttcagccaataaccataacggagtttctgcctcggcgcctattctcgacccgcctaatgttgtttatggtggtggtggaggttcaggcggtgggttttacagttaa

SEQ ID NO: 1624 - protein, 320 aa, Arabidopsis thaliana
  G2649,SRS domain coordinates 112-155
MGMVGLRDVFLVAPAYHHQNAGVISGSDHMNSNAAAAAALGVGVIPLLTAGTPQQNVEDSDINFLGNNRRWQNNNNNHETQYLHFKSTNQTTVGTSSNNSGSGSGASGTATCQDCGNQAKKECKQRRCRTCCKSRGFDCSTHVKSTWVSAARRRERQVMPTGANPTAGSSLSTSSGTKKPRIVGSQQQQQQQATSHTSTSNTPPQSFETSSSRQDGGGSREAWPGQVRAAAVFKCVRVTAVEDGDDEYAYQAVVKIGGHVFKGFLYDQGLEPKEGFPSMSDLHLGGSANNHNGVSASAPILDPPNVVYGGGGGSGGGFYS

SEQ ID NO: 1625 - DNA, 822 bp, Arabidopsis thaliana
  G2650,family:TEO
tcaagcttaccagtttttctgtatcgacagaggacatgggaataaaaaaagaagatcagaaaagttccttgtccttgttgacgcaacgatggaataatccgaggatcgtgcgagtctcccgagcatttggaggcaaagatagacacagcaaagtgtgcacagttcgtggtctccgagacaggaggataaggttgtcggtgatgacagcgatccaagtctacgaccttcaagaacgattagggctgagtcagcctagcaaagtcattgattggctcttagaagttgccaaaaacgacgtcgatttgcttcctcctttgcaattcccacctggttttcaccaacttaaccctaatctcaccggccttggagaatcttttcccggggtcttcgatcttggaagaacacagagagaagctttggatcttgagaaaaggaaatgggttaatcttgatcatgtgtttgatcacatcgatcatcacaaccatttctcgaattcaatccagagcaacaagctttatttccctacaattacttcgtctagcagctcttatcactacaaccttggacatctccaacagtcactactagaccaatctggtaacgtcactgtcgcattttctaataactataataataataatctcaatcctccggcggcggaaactatgagttctctattcccaacaaggtacccttcgtttctcggtggtggtcaacttcaactctttagtagcacaagctcacaaccagaccatatcgagtagttccagctgcagattatttttagacgatctttaacaagttgaagaattcaagtcatgt

SEQ ID NO: 1626 - protein, 242 aa, Arabidopsis thaliana
  G2650,TEO domain coordinates 34-91
MGIKKEDQKSSLSLLTQRWNNPRIVRVSRAFGGKDRHSKVCTVRGLRDRRIRLSVMTAIQVYDLQERLGLSQPSKVIDWLLEVAKNDVDLLPPLQFPPGFHQLNPNLTGLGESFPGVFDLGRTQREALDLEKRKWVNLDHVFDHIDHHNHFSNSIQSNKLYFPTITSSSSSYHYNLGHLQQSLLDQSGNVTVAFSNNYNNNNLNPPAAETMSSLFPTRYPSFLGGGQLQLFSSTSSQPDHIE

SEQ ID NO: 1627 - DNA, 1413 bp, Arabidopsis thaliana
  G2655,family:HLH/MYC
atcaaaccacaactttgtttgacctttttttgagtacttctcttgtcttttcttcttcaagtttacttagttctttgagaacaaatttctgttgattttttttctttcttgtagagggataattacaagtttaatttccctagagtgtctttaccttttgccttgtctccctctcgagacaaaaagagaaagagaaacactttctgtcctctttttttttcctctctttttctctctcgctggaaaccttttcatattcaagtgtaattttaatatttcaagcaattttctagctaattatggccttggaggctgtagtttacccgcaagatccgttctcctacatctcttgcaaagattttccgttttacgacttatactttcaagaagaagaagatcaagatccacaagatactaagaacaacattaagctagggcaaggacaaggacatggttttgcgagtaataattacaacggtagaaccggagattatagtgatgattataattacaacgaagaggatctccaatggccacgagaccttccttatggatctgccgtcgacaccgagagccagcctccaccgtcggatgtggcggcgggaggagggaggaggaaaaggaggaggacgaggagtagcaagaacaaagaagagatcgagaaccagaggatgactcacatcgccgttgaaagaaatcgccggaaacagatgaacgagtacctcgccgttctccggtctctcatgccaccttattatgctcaaaggggagatcaagcatcgatagtaggcggagccattaactacttaaaggagcttgagcatcatttacaatcaatggaacctccggttaagaccgccacagaagacaccggagccggccacgaccagaccaaaacaacctcggctagttcgtcgggaccattctcggatttctttgcatttcctcagtactcgaaccggcctacctctgcggcggcggctgaggggatggcggagatagaggtaacgatggtagagagccatgcgagtctgaaaatacttgcgaaaaagagaccgagacagcttcttaaactggtctcatcgatacagagcctaaggctcactcttctccatctaaacgtcacaactcgagacgactccgtcctctattccatcagcgtcaaggttgaagaagggagccaattgaatacagtagaagatattgcagcagctgtgaatcaaatcctaaggaggatcgaagaagagtcatcctttagctagtattgttgaattttagttatggcacatttagaggagctctaatttttcatgtgtgatcttttgctctctctttttcatatattaaataatataaatttcctttttctttttgttaacgttaattctaatgcattatatattggagtttttg

SEQ ID NO: 1628 - protein, 320 aa, Arabidopsis thaliana
  G2655,HLH/MYC domain coordinates 119-178
MALEAVVYPQDPFSYISCKDFPFYDLYFQEEEDQDPQDTKNNIKLGQGQGHGFASNNYNGRTGDYSDDYNYNEEDLQWPRDLPYGSAVDTESQPPPSDVAAGGGRRKRRRTRSSKNKEEIENQRMTHIAVERNRRKQMNEYLAVLRSLMPPYYAQRGDQASIVGGAINYLKELEHHLQSMEPPVKTATEDTGAGHDQTKTTSASSSGPFSDFFAFPQYSNRPTSAAAAEGMAEIEVTMVESHASLKILAKKRPRQLLKLVSSIQSLRLTLLHLNVTTRDDSVLYSISVKVEEGSQLNTVEDIAAAVNQILRRIEEESSFS

SEQ ID NO: 1629 - DNA, 819 bp, Arabidopsis thaliana
  G2661,family:HLH/MYC
accatatcatgtaacagttataaaccacgacaatcacaatggatgatttcaatcttcgtagcgaaaaccctaattcatcatccaccacttcctcatcctcttcctctttccaccgtcacaagagcgaaaccggaaacacaaaacggtcaaggtcaacgtccacgttatcgacggaccctcagagcgtggcggctcgcgacagacggcaccgaattagcgaccgtttcaagattttacaaagcatggtccctggtggtgcgaagatggacactgtatctatgcttgacgaagccattagctacgtcaagttcttgaaggctcagatctggtatcaccaaaacatgcttctcttcataaacgaccacgaaactacatcatcttgtacttactctcccggcgctggagaatttggaccgaaactctttggttatgatgacgattatgcccctataatggacacatattcacaaggcgtgccacttacggttgcggactcgaagtatacgccgtggtttggttcggttgatgatgagcaagaacgtgactcgtcctagtcgttgccatatatgcaacattatgtgatttacatatccagaatctaccgtcttccttattctcgcaatacttagtaactatagtttaaggattatattatatgcgtctactatatatatctgagtgtatctaatttagagattgtaatatacatgagtatgagactaattaacctatagtatttgtattgacgtatggataatcacttggaaacacgaaaaagagagtatacaatactgtatattaattatggactttaaaaaa

SEQ ID NO: 1630 - protein, 171 aa, Arabidopsis thaliana
  G2661,HLH/MYC domain coordinates 40-97
MDDFNLRSENPNSSSTTSSSSSSFHRHKSETGNTKRSRSTSTLSTDPQSVAARDRRHRISDRFKILQSMVPGGAKMDTVSMLDEAISYVKFLKAQIWYHQNMLLFINDHETTSSCTYSPGAGEFGPKLFGYDDDYAPIMDTYSQGVPLTVADSKYTPWFGSVDDEQERDSS

SEQ ID NO: 1631 - DNA, 1568 bp, Arabidopsis thaliana
  G2679,family:CPP
aagatctcaaagagacgacgacgaagcaaaagaagaagaagaagaagagagagctattcaagcttaaagcataaaacaatctctgctccttatatagttcttcactatggaagatttgagtaatcagaatctcctcccgcgtcaatcagatatctccatccctgcggagaagatggattcgtttcaaaagtcgctagaacctccgccgtgttctccggtgaaatcttctcaacaatcagaaacggaagtcacaccgcctcagaaaccaccgcttcaccaatttggtcacaaccaagttcagaagaatcgagtgagcaatcaagatccatcgacctcacgaagacataatgaagttgaatcgaaagagaatactccaaataaacaacaaaaacattgcaattgcaaaaactcaaagtgtttgaaactgtattgtgaatgctttgcttctggatcttattgtaatggttgtaactgtgtgaattgtcacaacaaattggagaatgagtcttcgagacaagtagctatctcggggatcttagagcgtaaccctgatgcgtttaagcccaagattgctggtagtcctcatggaatgaaagatttgcaggagaatgtgcagcaagtgttgcttattggaaagcacagcaaaggatgccactgcaggaaatcaggatgtctcaagaagtactgtgagtgttaccaggcgaatattctatgttcggagaattgtagatgtcaagactgcaagaactttgaaggaagcgaagaaagaaaagctcttcttcatggatctcaggtctcggatacctacatacaacagatgaccaatgcggctgttaaccgtgccatcgacatgtctgcttatctgtaccctcctgaatcaagaaagagaaagagcaaggacatttcagattctgtagtttcatcatacggtgtccaataccagagggcaaaccacgttagaagaaatggtgaaaattctctattttcactccctaacaacaaggccgtgtccggatctaccacaagtgcttacaggtcttcttggtcaaatacattccaaccacatcatgtcagagagctatgttcacttttggtctcaaactcggttgatgtagcaaataaattgtcagacaaagggaggaagaacgacaaaggcccttcttcacttgatggagcccaaagagttgctaatgagatcaatgactcaccagattgtgtccttgatgctaatagaatggacgagaagcctatatctcccgcaacacgtgcattgatgtgtgacgaagaacatgagatcgggtcagagaaagagacatcggcccgagtgaaaacaagccaagagaaagaagacacagacacaagctcggggatttacttagagcaagaaagacagatattgtcaatcttcagggactatctcattcagctctcaaaccgtgcgaggataaatggtaaaaatatcaaaagcaacacaaatccaagttgaaagaaaccagaagatgaagaacaaagccatcgagactcaaattagggacattgcttagggaatttttttgatttttttttta

SEQ ID NO: 1632 - protein, 459 aa, Arabidopsis thaliana
  G2679,CPP domain coordinates 107-177
MEDLSNQNLLPRQSDISIPAEKMDSFQKSLEPPPCSPVKSSQQSETEVTPPQKPPLHQFGHNQVQKNRVSNQDPSTSRRHNEVESKENTPNKQQKHCNCKNSKCLKLYCECFASGSYCNGCNCVNCHNKLENESSRQVAISGILERNPDAFKPKIAGSPHGMKDLQENVQQVLLIGKHSKGCHCRKSGCLKKYCECYQANILCSENCRCQDCKNFEGSEERKALLHGSQVSDTYIQQMTNAAVNRAIDMSAYLYPPESRKRKSKDISDSVVSSYGVQYQRANHVRRNGENSLFSLPNNKAVSGSTTSAYRSSWSNTFQPHHVRELCSLLVSNSVDVANKLSDKGRKNDKGPSSLDGAQRVANEINDSPDCVLDANRMDEKPISPATRALMCDEEHEIGSEKETSARVKTSQEKEDTDTSSGIYLEQERQILSIFRDYLIQLSNRARINGKNIKSNTNPS

SEQ ID NO: 1633 - DNA, 1083 bp, Arabidopsis thaliana
  G2682,family:CPP
atgacaggaaacgcagattccggcaaaatcgcgacagagaaagaccctaggaagctcgttttcaccaaattggaggtatctcccgtcttccgagaatctcctgttaaagaacttcctctttttcctccgatttctcgcagagagcattcagaagcaaaggataagacagatgaagaaggcattacttcgaggaaacacaaaggatgtcgatgcaagcagtccaaatgtttaaagttgtactgtgactgttttgcatcaggagtggtatgtacagactgtgattgtgttgattgtcataacaactctgagaaatgtgatgctagagaagcagctatggtgaatgtactaggtcgcaacccaaatgccttcagtgaaaaggctttaggtagcctaactgataatcaggctgcacctgatactaaacctggactgctttcgagaggctgcaaatgtaaaagaaccaggtgtttgaagaagtactgtgagtgctttcaggctaatcttctgtgctcagacaactgtaaatgcatcaactgcaagaatgttagtgaagcgttccagcctcctgcattttctgctcacaattccccacaagtataccggaggagaagagaccgagagctaactgaggcaactccgttattttcgatacctgacaattccattcaaaatgctctgggttcccctatgtcttgctctcctaaacttccttacaggtccctcatgggatacacctctacacttcttccggacttgggagatttatgctcacttctcgttgcagcgtcagaatctgctacaacaactgcagaggaccagaacaggatatttacaaagcctgatgataaggaagccattgagctgtcaagtgagtctgagagtcgtaatgtggaagaagaaatacaatcacgtggaagattgatcgaactgatagatgttcaatacaatggagaagaggattcccaatgtaagaccaagacaagtgtcaatgaaacagatatatacatggagcaggaaagggcagtgcttgaaactttcagagactgtctccaaaagttcatcaaatcgagactggaatcataa

SEQ ID NO: 1634 - protein, 360 aa, Arabidopsis thaliana
  G2682,CPP domain coordinates 67-181
MTGNADSGKIATEKDPRKLVFTKLEVSPVFRESPVKELPLFPPISRREHSEAKDKTDEEGITSRKHKGCRCKQSKCLKLYCDCFASGVVCTDCDCVDCHNNSEKCDAREAAMVNVLGRNPNAFSEKALGSLTDNQAAPDTKPGLLSRGCKCKRTRCLKKYCECFQANLLCSDNCKCINCKNVSEAFQPPAFSAHNSPQVYRRRRDRELTEATPLFSIPDNSIQNALGSPMSCSPKLPYRSLMGYTSTLLPDLGDLCSLLVAASESATTTAEDQNRIFTKPDDKEAIELSSESESRNVEEEIQSRGRLIELIDVQYNGEEDSQCKTKTSVNETDIYMEQERAVLETFRDCLQKFIKSRLES

SEQ ID NO: 1635 - DNA, 726 bp, Arabidopsis thaliana
  G2686,family:WRKY
atgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagaagatttgcggagtaaaaggtttagagatttacagagatgattcccccaatccccgccttgatgacggcttcacctggaggaaatatggacaaaaaaccatcaaaacctctttgtaccaaaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttga

SEQ ID NO: 1636 - protein, 241 aa, Arabidopsis thaliana
  G2686,WRKY domain coordinates 122-173
MFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 1637 - DNA, 1065 bp, Arabidopsis thaliana
  G2690,family:AP2
atggatatggacgagatgagcaatgtagccaagacaacgacagagacttcaggcttaactgactctgtcttgagcctcacgaaacgcatgaaacctactgaggttacgaccaccacaaaacctgccttgtccaacacgacgaaattcaaaggagttgttcagcaacagaacggtcattggggtgctcagatttacgcagaccatcgaaggatttggcttggaactttcaaatccgctcatgaagccgctgctgcttacgatagcgcatcgattaagcttcgaagctttgatgctaactcgcaccggaacttcccttggtctgattttaccctccatgaaccggactttcaagagtgctacacgacagaagctgtgttgaacatgatcagagacggttcttatcaacacaagttcagagattttctcagaatccggtctcagattgttgcgaatatcaacatcgtgggatcaaaacaagtcttaggaggaggagaaggtggtcaagaatcgaacaagtgtttctcgtgcacgcagctttttcagaaagaactgacaccgagcgatgtagggaaactgaataggcttgtgatacctaagaagtatgcagtgaagtatatgcctttcataagcgatgatcaaagcgagaaagagacgagtgaaggagtagaagatgtggaggttgtcttttacgacagagcaatgagacaatggaagtttaggtattgttactggagaagtagccagagctttgtcttcaccagaggatggaatggtttcgtgaaggagaagaatctcaaggagaaagatattattgtcttttacacttgcgatgtccccaacaatgtgaagacattagaaggccaaagcaagaccttcttgatgattgatgttcatcacttttcaggcaacggtttcgtggttcccgaggaagtaaacaagacggttcatgagatttctgatgaagagatgaaaacagaaaccctctttacctcgaaggtagaagaagaaaccaaatcagaggagaagaaaggagggtttatgctgtttggtgttaggatccaatag

SEQ ID NO: 1638 - protein, 354 aa, Arabidopsis thaliana
  G2690,AP2 domain coordinates 46-108,176-275
MDMDEMSNVAKTTTETSGLTDSVLSLTKRMKPTEVTTTTKPALSNTTKFKGVVQQQNGHWGAQIYADHRRIWLGTFKSAHEAAAAYDSASIKLRSFDANSHRNFPWSDFTLHEPDFQECYTTEAVLNMIRDGSYQHKFRDFLRIRSQIVANINIVGSKQVLGGGEGGQESNKCFSCTQLFQKELTPSDVGKLNRLVIPKKYAVKYMPFISDDQSEKETSEGVEDVEVVFYDRAMRQWKFRYCYWRSSQSFVFTRGWNGFVKEKNLKEKDIIVFYTCDVPNNVKTLEGQSKTFLMIDVHHFSGNGFVVPEEVNKTVHEISDEEMKTETLFTSKVEEETKSEEKKGGFMLFGVRIQ

SEQ ID NO: 1639 - DNA, 1531 bp, Arabidopsis thaliana
  G2691,family:AP2
gcgatttcgtctctgtttctaatctcctttgcaattcaatcgtcttcttcttcttcctcgtctgtcttgttctttggtctgagtctgacggctgttcttaacgctcttcgcttctgctccgaacagaggcttattcttgaggttccttccatttccatgggcttaagacttaaaaggacttgttctggtgttgaagtatttgggggttttcacgaaaagcaaaaaataccctttttcatagttcgctgaaacagagaaatctttttcctgaaaaaaacctcatccgatttagcagtttttgatcagagatttttgagtggggtttttttggtgtgttcttggtgtgtttgagaagatatgaagtcctttgtgaaacctgagagagactctttgttgagaacagttcgtattgttttcactgatcctgatgctactgatgattcctcttcctctagcgatgaatggttacctaaacctcgaaaggtaaagcgttttgttcatgagattactttcctccctcaggtctccgagagttctcaggatcgtagcaatgctgtcaaaacccctagaaggaaatctactaggcagtttaagtatcctgtgggagttaggccgaggccatcaggcaaatttgctgctgagattttgaacccattcactaaaactaagaaatggttgggtacttatgaaactcctgcagaagctgagaaggcttatgttgacaagaaggttgagtatgatgcactggcttcttcaggttctgctgtttcctcatcggttgtaacagtgactagccagtgcttgcgttcccctacttctgcttctgtttcttgtgtaagtgctgatgatttgtctaaagaaaagacgtctctgaacaaagatgttgctgcgtctggtgattcaaccaccaaagaagtgttcactactttcgacttttcggatgtgaaaatacctgatctgagattcttagcagcagaagaggattctatggtttctaatgcaaatggtgcagagctagactttgattgtttccttactgactctaacattctgctggatgattactcattgctcgaaaatgatatcaacttcagcaggtttgaaaacagtcttccaagtgagctacctgactgtgatttcactgaaatggaattccagcttgatgatttcaaatttgcctatacagatcatctgacaacaccgcctctcggtttggtttaagagttgttagcttcggtttctgtttcacaggaacatgatgaagaaagctagaaagtatgatccttgcggtctgatctctatggatttttcatgtgcttttagaacagtccaaaggagtgatttgcacaacattttttcataaatgttggttttactttctttcatctttatgttttaatctatttccttatgcattgttcttcgtatctcttttgtctcttggtgttgtacctttctcttttaatgtttgtctaatcaggacagaaaatctaaaccgagaatttaataagtcatgggttgatattaatag

SEQ ID NO: 1640 - protein, 287 aa, Arabidopsis thaliana
  G2691,AP2 domain coordinates 78-146
MKSFVKPERDSLLRTVRIVFTDPDATDDSSSSSDEWLPKPRKVKRFVHEITFLPQVSESSQDRSNAVKTPRRKSTRQFKYPVGVRPRPSGKFAAEILNPFTKTKKWLGTYETPAEAEKAYVDKKVEYDALASSGSAVSSSVVTVTSQCLRSPTSASVSCVSADDLSKEKTSLNKDVAASGDSTTKEVFTTFDFSDVKIPDLRFLAAEEDSMVSNANGAELDFDCFLTDSNILLDDYSLLENDINFSRFENSLPSELPDCDFTEMEFQLDDFKFAYTDHLTTPPLGLV

SEQ ID NO: 1641 - DNA, 1341 bp, Arabidopsis thaliana
  G2694,family:OTHER
atgtctacctcctcctcttcttccgacaacggagccggtggaagcggcggcgttttcgaggccccatctccatcccgccctcgccgcggagccaacgatgtttggccggagccttttcttgaatctctcgccgttcaagttgccgttaacgcttccacatccgccggcctcctcgccgcagctccggctcttgccaacgtttttcgggtttgcaccacgtggcacgctgtctctcgctccgaccatctatggcaactactatctcgccaagtttgggcaagaacacatttgatgcacgacacgtggcgggacgagttcatctaccgtcatcggacggctagaaacttccggacgcgtactcacacctacttcactctccaatttgacccgtctgatgtggacgagcctgatagtctctcttgccgttgtctcaccctctcagacctctacttagccgcagggttcgccgacggaaccgtccggctttttcttttaaacaaccgactccacgtcaggaccttacggccacctctacgtgaccgctttggtagattctcacgagccgtctcaggcattgttatctccgactcaaggctcacgttcgctacgatggacggagacatccacgtggcggaaatagacggtgttggtcacacacgcacggcttacgcaggagatatagttaacgacggtgcgttggtagatttcactggctgtggacgttggtgggtcggtcttttcgcgggtgtgccaggtcgtgcctttcacatatgggactgtaacagcgaagagacaacattcgtcggtggtacactcaccgaccctgaagctgtcatgggatggcacacgttaacagagctaacaacgtcccttggccgtctcagaatctccggtaacgagacggcggtagcatgcacgagatggagaatcatggtgatcgatctaagaaaccaaggagtgatcatcggagaagacgaagagcaacgtagaggactaatagtgacaggcttcgatgccaacgacgaagcgtacgttagattggacagtagaggaaacgctagcgtgcgaagggtgaacacgcaacaaacggtgtgtgagttccgtgttagtggagcggcgcagagaagagtaatgggttgtgttaatagactgcacgcgctaatgtgcgcaggtggtataatgcgcgtgtgggaggtagagagaggagagtatctgtacagtattagggagagagtaggagaagttgacgccattgttgccgatgatagacatgtggcggttgcgtcagcttcatcaacggctcagagtattatacatctatgggatttcggtgcactgtag

SEQ ID NO: 1642 - protein, 446 aa, Arabidopsis thaliana
  G2694,OTHER domain coordinates 1-446
MSTSSSSSDNGAGGSGGVFEAPSPSRPRRGANDVWPEPFLESLAVQVAVNASTSAGLLAAAPALANVFRVCTTWHAVSRSDHLWQLLSRQVWARTHLMHDTWRDEFIYRHRTARNFRTRTHTYFTLQFDPSDVDEPDSLSCRCLTLSDLYLAAGFADGTVRLFLLNNRLHVRTLRPPLRDRFGRFSRAVSGIVISDSRLTFATMDGDIHVAEIDGVGHTRTAYAGDIVNDGALVDFTGCGRWWVGLFAGVPGRAFHIWDCNSEETTFVGGTLTDPEAVMGWHTLTELTTSLGRLRISGNETAVACTRWRIMVIDLRNQGVIIGEDEEQRRGLIVTGFDANDEAYVRLDSRGNASVRRVNTQQTVCEFRVSGAAQRRVMGCVNRLHALMCAGGIMRVWEVERGEYLYSIRERVGEVDAIVADDRHVAVASASSTAQSIIHLWDFGAL

SEQ ID NO: 1643 - DNA, 1233 bp, Arabidopsis thaliana
  G2699,family:SCR
atgaccaaaacccggattctcaacccgacccgattcccttctcccaaacccttacgtggctgcggcgacgctaacttcatggaacagctcctccttcactgcgccaccgccatagactccaacgacgctgcattaactcaccaaatcctctgggtcctcaacaacatcgctccaccagacggtgactccacccaacgtcttacatccgcattcctccgcgcgttgctctcacgcgccgtctccaaaacccctacactatcatccaccattagcttcctacctcaggccgatgaactccatcgtttctcagtcgtggagttagccgctttcgtagacctcactccgtggcaccggttcggattcattgcagccaacgccgcgatcttaaccgccgttgaaggttactcaacggttcacatcgttgacttaagtttgactcattgtatgcaaatccctactcttatagacgccatggcaagccgactcaacaaacctcctccgcttcttaaactcaccgtcgtctcttcctccgaccacttcccaccattcatcaacatctcctacgaagaactcggatctaaactagtcaacttcgccaccacacgaaacattacaatggagttcacaatcgtaccttctacttactccgatggcttctcctccctcttacaacagttacggatttatccttcttcattcaacgaagctctcgtcgttaactgtcacatgatgctccgttacatccctgaagaacccctaacttcatcatcatcatcgctccgaacagttttcttgaaacaactccgatctttgaatccaagaatcgtaaccctaatcgaagaagacgtagatctcacatcggagaacttggttaaccggttaaaatcggcgtttaactacttctggattccgttcgatacgacggacacgtttatgagtgagcagagacggtggtacgaggcggagataagttggaagatagaaaacgtggtggcgaaggaaggtgcggagagagtggagaggacggagacgaagagacggtggatagagagaatgagagaggctgagttcggtggagttagggttaaagaagatgcggtggcggatgtgaaggcgatgctggaggagcacgctgtcgggtggggaatgaagaaggaagacgacgacgagagtctcgtgctgacgtggaaaggtcatagtgttgtgtttgctaccgtttgggttcccatttaa

SEQ ID NO: 1644 - protein, 410 aa, Arabidopsis thaliana
  G2699,SCR domain coordinates 107-172,243-333,333-407
MTKTRILNPTRFPSPKPLRGCGDANFMEQLLLHCATAIDSNDAALTHQILWVLNNIAPPDGDSTQRLTSAFLRALLSRAVSKTPTLSSTISFLPQADELHRFSVVELAAFVDLTPWHRFGFIAANAAILTAVEGYSTVHIVDLSLTHCMQIPTLIDAMASRLNKPPPLLKLTVVSSSDHFPPFINISYEELGSKLVNFATTRNITMEFTIVPSTYSDGFSSLLQQLRIYPSSFNEALVVNCHMMLRYIPEEPLTSSSSSLRTVFLKQLRSLNPRIVTLIEEDVDLTSENLVNRLKSAFNYFWIPFDTTDTFMSEQRRWYEAEISWKIENVVAKEGAERVERTETKRRWIERMREAEFGGVRVKEDAVADVKAMLEEHAVGWGMKKEDDDESLVLTWKGHSVVFATVWVPI

SEQ ID NO: 1645 - DNA, 866 bp, Arabidopsis thaliana
  G2701,family:MYB-related
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcggc

SEQ ID NO: 1646 - protein, 263 aa, Arabidopsis thaliana
  G2701,MYB-related domain coordinates 31-81,127-175
METLHPFSHLPISDHRFVVQEMVSLHSSSSGSWTKEENKMFERALAIYAEDSPDRWFKVASMIPGKTVFDVMKQYSKLEEDVFDIEAGRVPIPGYPAASSPLGFDTDMCRKRPSGARGSDQDRKKGVPWTEEEHRRFLLGLLKYGKGDWRNISRNFVVSKTPTQVASHAQKYYQRQLSGAKDKRRPSIHDITTGNLLNANLNRSFSDHRDILPDLGFIDKDDTEEGVIFMGQNLSSENLFSPSPTSFEAAINFAGENVFSAGA

SEQ ID NO: 1647 - DNA, 1032 bp, Arabidopsis thaliana
  G2702,family:MYB-(R1)R2R3
atgatgatgaggaaaccggacattactacgatcagagacaaaggcaagccaaatcatgcatgtggtggtaataacaacaaaccgaagctaagaaaaggactttggtcgcctgatgaagatgagaagctgataagatacatgttgactaatggacaaggatgttggagtgacatcgctagaaatgctggtcttttacgttgtggtaaaagttgtcgccttcgctggatcaattacttgaggcctgatcttaaacgtggatccttctctcctcaggaggaggatctcatcttccatttgcattccattcttggtaacaggtggtctcaaatagctactcggcttccaggtagaacagacaacgagatcaaaaacttttggaactcgacattgaagaagcggcttaagaacaacagcaacaacaatacttcatcaggatcatcacctaacaatagtaatagtaattccttggacccaagagatcaacatgtggatatgggaggcaactcaacttcattgatggatgactatcatcatgatgaaaacatgatgacagtggggaacaccatgcgcatggactcttcctccccattcaatgttggaccaatggttaatagtgtgggcttaaaccaactttatgatcccttgatgatatcagtgccggataacggatatcaccaaatgggaaacacagtgaatgtgttcagcgttaatggtttaggagattatggaaacacaattcttgatccaattagcaagagagtatcagtagaaggtgatgattggttcattcccccctcggagaataccaacgtcattgcttgtagtacaagcaacaacctaaacttacaggcccttgatccttgcttcaatagcaaaaatctttgtcattcagaaagcttcaaggtagggaatgtgttggggatagagaatggttcttgggaaatagaaaaccctaaaatcggagattgggatttggatggtctcatcgataacaactcttcttttcccttccttgatttccaagtcgattga

SEQ ID NO: 1648 - protein, 343 aa, Arabidopsis thaliana
  G2702,MYB-(R1)R2R3 domain coordinates 31-131
MMMRKPDITTIRDKGKPNHACGGNNNKPKLRKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLKKRLKNNSNNNTSSGSSPNNSNSNSLDPRDQHVDMGGNSTSLMDDYHHDENMMTVGNTMRMDSSSPFNVGPMVNSVGLNQLYDPLMISVPDNGYHQMGNTVNVFSVNGLGDYGNTILDPISKRVSVEGDDWFIPPSENTNVIACSTSNNLNLQALDPCFNSKNLCHSESFKVGNVLGIENGSWEIENPKIGDWDLDGLIDNNSSFPFLDFQVD

SEQ ID NO: 1649 - DNA, 1338 bp, Arabidopsis thaliana
  G2713,family:TUBBY
atgtcgtttcgaggcattgttcaagatttgagagatgggtttgggagcttgtcaaggaggagtttcgattttaggctctcgagtcttcataaagggaaagctcagggttcttcgttccgtgagtattcgtcatcccgtgatctcttgtcgcctgtgatagttcagacaagtagatgggctaatcttcctccagagttactctttgatgtgatcaaaagattagaggaaagtgagagtaattggcctgcaagaaaacatgttgtggcttgtgcttcggtttgtcggtcttggagagctatgtgccaagagattgttttggggcctgaaatctgtgggaaactcactttccctgtttccctcaaacagccagggcctcgtgatgcaatgattcagtgtttcatcaaaagggataaatcaaagctaacatttcacctttttctttgtttaagtcccgctctattagtggagaatgggaaatttcttctttcagctaaaagaactcgtagaactactcgaaccgagtacattatctccatggatgctgataacatctcaagatccagcaactcttacctcggaaagctcagatcaaacttccttgggacaaagttcttggtgtacgacacgcaaccaccaccaaacacatcttcgagcgcacttatcactgatcgaacaagccgaagcaggtttcactccagacgagtttctcctaaagtaccatccggaagctacaacattgctcaaatcacctatgagctcaacgtgttgggcacacgcgggccacgacgaatgcactgcatcatgaactccatcccaatttcatcgctcgaaccaggcggttcagtccctaaccaacccgagaaactcgtccctgcaccatactctctcgacgactcattccgcagtaacatctccttctccaaatcatcatttgaccaccgctccctcgatttcagcagttctagattctccgaaatgggaatatcctgcgacgacaacgaagaagaagcgagtttcagaccgttgattctaaagaacaagcagccaaggtggcacgagcagttgcaatgctggtgtttgaatttccgcggacgtgtgacagttgcatcggttaagaatttccagcttgtagcagcaagacagccgcagcctcaagggacaggtgcagcagcagcaccaacaagtgcacctgctcaccctgagcaagacaaggtgattctccagtttggtaaagtagggaaagatatgttcacaatggactataggtatccattatcggcgtttcaggcgtttgcgatatgcttaagcagctttgacaccaagcttgcttgtgaatag

SEQ ID NO: 1650 - protein, 445 aa, Arabidopsis thaliana
  G2713,TUBBY domain coordinates 123-445
MSFRGIVQDLRDGFGSLSRRSFDFRLSSLHKGKAQGSSFREYSSSRDLLSPVIVQTSRWANLPPELLFDVIKRLEESESNWPARKHVVACASVCRSWRAMCQEIVLGPEICGKLTFPVSLKQPGPRDAMIQCFIKRDKSKLTFHLFLCLSPALLVENGKFLLSAKRTRRTTRTEYIISMDADNISRSSNSYLGKLRSNFLGTKFLVYDTQPPPNTSSSALITDRTSRSRFHSRRVSPKVPSGSYNIAQITYELNVLGTRGPRRMHCIMNSIPISSLEPGGSVPNQPEKLVPAPYSLDDSFRSNISFSKSSFDHRSLDFSSSRFSEMGISCDDNEEEASFRPLILKNKQPRWHEQLQCWCLNFRGRVTVASVKNFQLVAARQPQPQGTGAAAAPTSAPAHPEQDKVILQFGKVGKDMFTMDYRYPLSAFQAFAICLSSFDTKLACE

SEQ ID NO: 1651 - DNA, 903 bp, Arabidopsis thaliana
  G2717,family:MYB-related
atgggtgctcctaagcagaaatggactcaagaagaagagtcagctttaaagtctggagttataaagcatggacctggtaaatggcgcacaattctcaaagatcctgaatttagcggagtcttgtacctgcgttccaatgttgatcttaaggacaaatggagaaacatgagtgtcatggcaaatggctggggatcgcgcgaaaagtctaggttagctgttaaaaggacgttctcccttcctaaacaggaagagaactcactagccctaaccaattctttgcaaagtgatgaagaaaatgtggatgcgacctctggactccaagtttcttctaatcctcctccaaggagacctaatgtaaggttggatagccttataatggaagcaatagctaccctgaaagaacctggtggctgtaacaaaacaacaattggtgcctacattgaggatcaatatcatgctccaccagacttcaaacgcttgttgtctaccaagctaaagtacttgacatcttgcgggaaacttgtgaaggttaaacgtaagtacagaattccaaactccactcccttgtcttcccacaggagaaaaggtctgggggtgtttggaggaaaacagaggacttcttctttgccttcacctaaaacagacatagatgaagtgaattttcagacaaggtcacagattgatacagagatagccagaatgaagagtatgaacgtacatgaggcggcagcagttgcagcacaggcagtagcagaggcagaagctgccatggcagaggctgaggaagctgcaaaggaagcggaggcagcagaagccgaagcagaagcagctcaagctttcgctgaggaagcttcaaagacattgaaaggaagaaacatctgcaaaatgatgatccgtgcctga

SEQ ID NO: 1652 - protein, 300 aa, Arabidopsis thaliana
  G2717,MYB-related domain coordinates 6-54
MGAPKQKWTQEEESALKSGVIKHGPGKWRTILKDPEFSGVLYLRSNVDLKDKWRNMSVMANGWGSREKSRLAVKRTFSLPKQEENSLALTNSLQSDEENVDATSGLQVSSNPPPRRPNVRLDSLIMEAIATLKEPGGCNKTTIGAYIEDQYHAPPDFKRLLSTKLKYLTSCGKLVKVKRKYRIPNSTPLSSHRRKGLGVFGGKQRTSSLPSPKTDIDEVNFQTRSQIDTEIARMKSMNVHEAAAVAAQAVAEAEAAMAEAEEAAKEAEAAEAEAEAAQAFAEEASKTLKGRNICKMMIRA

SEQ ID NO: 1653 - DNA, 252 bp, Arabidopsis thaliana
  G2718,family:MYB-related
atgaatacgcagcgtaagtcgaagcatcttaagaccaatccaaccattgttgcctcttcttctgaagaagtgagcagtcttgagtgggaagaaatagcaatggctcaggaagaagaggatttgatttgcaggatgtataagcttgtcggtgaaaggtgggatttaatagctgggaggattccaggaagaacagcagaagagattgagaggttttgggtgatgaagaatcatcgaagatctcaattacgttga

SEQ ID NO: 1654 - protein, 83 aa, Arabidopsis thaliana
  G2718,MYB-related domain coordinates 32-76
MNTQRKSKHLKTNPTIVASSSEEVSSLEWEEIAMAQEEEDLICRMYKLVGERWDLIAGRIPGRTAEEIERFWVMKNHRRSQLR

SEQ ID NO: 1655 - DNA, 1200 bp, Arabidopsis thaliana
  G2719,family:MYB-(R1)R2R3
atggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctga

SEQ ID NO: 1656 - protein, 399 aa, Arabidopsis thaliana
  G2719,MYB-(R1)R2R3 domain coordinates 56-154
MEGETHQSEPLPLASGDSDEGISAAIEAELAELAAGDSSGGGGCGGGGGGIRSKVKGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLRRKYADLWNNGQWMANSVTTASVKNENVDETTNPPSSKQQLPQGDINSSPPKPPQVSDVVMEEAANEPQEPQEQQEQAPPVVSNVPTENNVFRPVARVGAFSIYNPTSQKNGYRDYNIVPCEGPLIQAAKPDSLAGKFLQSLCDEPQIPSKCGHGCSTLPAETKFSRNSVLGPEFVDYEEPSAVFNQELISIATDLNNIAWIKSGLDNAVVREAEQSLKMDNYNYNDPRIKFTGMMPRQDFFCARS

SEQ ID NO: 1657 - DNA, 279 bp, Arabidopsis thaliana
  G2723,family:MYB-related
atggcctctagttctatgagctcgagctcttcttggacgtctaagcaaaacaagatgttcgagagggctttagccgtttacgataaagacactcccgaccgttggcaaaacgtggctaaagcagttggaagtaaatctgcagaggaagttaaacgtcactacgacatcctcgttgaagatctcatgaacatcgaacaagacttagtacctttgcctaaatacaaaaccgtcgatgttggaagtaaatctagaggcatcgatgattttgatttgaggtga

SEQ ID NO: 1658 - protein, 92 aa, Arabidopsis thaliana
  G2723,MYB-related domain coordinates 10-60
MASSSMSSSSSWTSKQNKMFERALAVYDKDTPDRWQNVAKAVGSKSAEEVKRHYDILVEDLMNIEQDLVPLPKYKTVDVGSKSRGIDDFDLR

SEQ ID NO: 1659 - DNA, 651 bp, Arabidopsis thaliana
  G2724,family:MYB-(R1)R2R3
atggaaatagaaataaggagaggtccatggactgtggaagaagacatgaagctcgtcagttacatttctcttcacggtgaaggaagatggaactccctctctcgttctgctggactgaatagaacggggaaaagttgcagattgcggtggctaaattatctccggccggatatccgccgtggagacatatcccttcaagaacaatttatcatccttgaactccattctcgttggggaaatcggtggtcaaagattgctcaacatttaccgggaagaacagataacgagataaagaattattggagaacacgtgttcaaaagcatgcaaaacttctaaaatgtgacgtgaacagcaagcaattcaaagacaccatcaaacatctctggatgcctcgtctcatcgagagaatcgccgccactcaaagtgtccaatttacctctaaccactactcgcctgagaactccagcgtcgccaccgccacgtcatcaacgtcgtcgtctgaggctgtgagatcgagtttctacggtggtgatcaggtggaatttggaacgttggatcatatgacaaatggtggttattggttcaacggcggagatacgtttgaaactttgtgtagttttgacgagctcaacaagtggctcatacagtag

SEQ ID NO: 1660 - protein, 216 aa, Arabidopsis thaliana
  G2724,MYB-(R1)R2R3 domain coordinates 7-113
MEIEIRRGPWTVEEDMKLVSYISLHGEGRWNSLSRSAGLNRTGKSCRLRWLNYLRPDIRRGDISLQEQFIILELHSRWGNRWSKIAQHLPGRTDNEIKNYWRTRVQKHAKLLKCDVNSKQFKDTIKHLWMPRLIERIAATQSVQFTSNHYSPENSSVATATSSTSSSEAVRSSFYGGDQVEFGTLDHMTNGGYWFNGGDTFETLCSFDELNKWLIQ

SEQ ID NO: 1661 - DNA, 1456 bp, Arabidopsis thaliana
  G2741,family:GARP
gaaaaaaaaaaaaaaaaaaattgtttgctcatcatcttcacaaaccaaacttctcttcttctccgatctcagatttgaatttttatcgattttgagcttcgaagagctcaatctctaactgaatttcgagaaattagagagtttgaaatgggagaggaagtacaaatgagcgattacgatgtttccggcgacggagatagggtttctgaatgggagatgggattaccaagcgacgaagatctagcatctctttcttactctctgattccaccgaatttggcgatggcgtttagtatcacaccggagagaagccgtacgattcaggatgtgaatcgtgcatcggagacgacgctctcgtcgctacgtggtggatcttcaggtccaaatacctcgtcgtcgaataataacgtggaggaggaagatcgagttggatctagcagtcctggatcggattcgaagaagcaaaagacatcaaacggtgatggagatgacggtggcggtgtggatccggattcggcgatggcggcggaagaaggagattcaggaactgaagatctatctgggaaaacacttaaacgaccgcgtttagtgtggacaccgcagctacacaagagattcgttgacgttgtagctcacttagggatcaaaaacgctgttccgaagacgattatgcagctgatgaacgttgaaggattaactcgtgagaacgttgcgtctcatcttcaaaagtataggctttacctcaaaaggatgcagggattgactaatgaaggtccctctgcttcggataagctcttctcttcaacacctgttcctccacagagcttccaagatatcggtggcggtggcggtagcagcggtaatgttggagtgccgattccgggggcgtatggaacgcaacagatgatgcagatgccagtttatgcacatcatatgggtatgcaaggatatcatcatcaaaatcataatcatgatccttatcatcagaatcatcgtcatcatcatggagctggtggaaatggtgcgtttgagtcaaatccttatatgatgcagcagaataagtttggatccatggcttcttatccttctgttggaggtggaagcgcaaatgagaattaaaaagagtctatagatggattcaatgggggaggaagagataggtgagcttgttattgctcgtggaactgataattattgtcaagtttctgtttttttaagtacagtacagttataattcttactcgatttgatcgaaattttcatcaagtttctgtcttttactataaatggtatacaataaagtcttaataatcacttgtgaggtgagtgccctcagatttatttgtctgcagacttcttaaagtggtaatcaagagagtgaattgtttatttctgtgagagatggcgtcagacacaaactttattttaaaaatttataaaccaatcaaatgtttca

SEQ ID NO: 1662 - protein, 323 aa, Arabidopsis thaliana
  G2741,GARP domain coordinates 149-197
MGEEVQMSDYDVSGDGDRVSEWEMGLPSDEDLASLSYSLIPPNLAMAFSITPERSRTIQDVNRASETTLSSLRGGSSGPNTSSSNNNVEEEDRVGSSSPGSDSKKQKTSNGDGDDGGGVDPDSAMAAEEGDSGTEDLSGKTLKRPRLVWTPQLHKRFVDVVAHLGIKNAVPKTIMQLMNVEGLTRENVASHLQKYRLYLKRMQGLTNEGPSASDKLFSSTPVPPQSFQDIGGGGGSSGNVGVPIPGAYGTQQMMQMPVYAHHMGMQGYHHQNHNHDPYHQNHRHHHGAGGNGAFESNPYMMQQNKFGSMASYPSVGGGSANEN

SEQ ID NO: 1663 - DNA, 1265 bp, Arabidopsis thaliana
  G2743,family:GARP
ctaactttatagttaaagttatcaattattcgaaaacaaagctggttttttgttttgtcccttaaaccagcatgatcaagaacttaagtaatatgaagaatgacaatcagaaacgtgaaaaatgttgcgagtacatcgaagctctcgaagaagaacgtcgcaagatcaatgttttccaacgcgagcttcctctttgcgtagagctcgtgactcaagcgattgaggcgtataagagggagatatcagggacgtcgacggataacttatacggacagtcggagtgctcagagcagaccaccggagaatgtgggcgcatcttggatctgttcataccaatcaaacactcttcgacctccatagaagaagaggttgatgacaaagatgatgatgatgaagaacaccagtctcatgaaaccgacatagattttgatgacaagaacatgaaatctgaatggctcaagtctgttcagctctggaaccaatccgacgcagttgtttctaataatagacaggatcgctcacaagaaaagacagagacgctggtagagttgataaaaataaacgatgaagcagcgaagaaaaacaacaacataaaatcaccggtgactactagcgatggtggcagtggcggtggcggtggcagaagagggcagagaaagaataggcggtgttggtcgcaagagttacacagacgcttcttgaacgctcttaaacaacttggtggccctcatgtagctacgccgaaacagataagagatataatgaaggttgatgggttaacaaatgatgaagtcaaaagtcatttacagaaatataggctgcatgcaagacggccaagccaaacaacaccgaacaacagaaactctcaaacgcaacatttcgtggtggttggtggaatatgggtcccacagactaaccattcaacggccaacgcagtcaacgccgtcgcatcgggtgagaccaccgggatttatgggcctatggtcagttcgttgccgtccgagtggccgaggcattccaattttggtaggaagatttcggaagatagatcaagatgctctaacaacggattttttcggtgtagctcaccagctatgtcttgttctactcgtacaaagacgaaagatgcaaaaataatatcataaatttaatttttgattatttattaagagaaaaaagttatagacattaatattgtgaagagtgtatatatatagatgttggagcgtgcctctatgttatttttaaaaaaaaaaaaaaaaaaa

SEQ ID NO: 1664 - protein, 357 aa, Arabidopsis thaliana
  G2743,GARP domain coordinates 201-249
MIKNLSNMKNDNQKREKCCEYIEALEEERRKINVFQRELPLCVELVTQAIEAYKREISGTSTDNLYGQSECSEQTTGECGRILDLFIPIKHSSTSIEEEVDDKDDDDEEHQSHETDIDFDDKNMKSEWLKSVQLWNQSDAVVSNNRQDRSQEKTETLVELIKINDEAAKKNNNIKSPVTTSDGGSGGGGGRRGQRKNRRCWSQELHRRFLNALKQLGGPHVATPKQIRDIMKVDGLTNDEVKSHLQKYRLHARRPSQTTPNNRNSQTQHFVVVGGIWVPQTNHSTANAVNAVASGETTGIYGPMVSSLPSEWPRHSNFGRKISEDRSRCSNNGFFRCSSPAMSCSTRTKTKDAKIIS

SEQ ID NO: 1665 - DNA, 970 bp, Arabidopsis thaliana
  G2747,family:ABI3/VP-1
ggtgaggaagtcaaaatcttgagagatctgagattgtaagaagatgaatcaagaagataaagagaagcctattgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcaattcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgatgatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggtagtataccacgtggcagagtttctatggttggtgctggttctctcctccagttgaggttagtgagcagtgatgatgagtctttagtagcaatggaagctgcaagtcttgaggatcatcacttctttacaaagaaaggaaaaccttctttgtcttttgatttggataggtgatgattatgcatgagattaatcactatt

SEQ ID NO: 1666 - protein, 299 aa, Arabidopsis thaliana
  G2747,ABI3/VP-1 domain coordinates 19-113
MNQEDKEKPIEEASSSMEREHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQRDSCNKDKLYIDWRRRPKIPDHHHQQFAGAMFPRFYTFPHPQMPTNYETHNLYHRFHQRDLGIGYYVRSMERSHPTAVIESVPVMMQRRAQVASMASRGEKRLRLFGVDMECGGGGGSVNSTEEESSSSGGSIPRGRVSMVGAGSLLQLRLVSSDDESLVAMEAASLEDHHFFTKKGKPSLSFDLDR

SEQ ID NO: 1667 - DNA, 2435 bp, Arabidopsis thaliana
  G2754,family:SWI/SNF
caatataccctcggttttgaatttgctctcaaaagcgacggagacgactgtttggctcggtgatttctcccgccgtttgggtttttcttaccggaatttccttctccttcgatggttagtctgcgctccagaaaagttattccggcttcggaaatggtcagcgacgggaaaacggagaaagatgcgtctggtgattcacccacttctgttctcaacgaagaggaaaactgtgaggagaaaagtgttactgttgtagaggaagagatacttctagccaaaaatggagattcttctcttatttctgaagccatggctcaggaggaagagcagctgctcaaacttcgggaagatgaagagaaagctaacaatgctggatctgctgttgctcctaatctgaatgaaactcagtttactaaacttgatgagctcttgacgcaaactcagctctactctgagtttctccttgagaaaatggaggatatcacaattaatgggatagaaagtgagagccaaaaagctgagcccgagaagactggtcgtggacgcaaaagaaaggctgcttctcagtacaacaatactaaggctaagagagcggttgctgctatgatttcaagatctaaagaagatggtgagaccatcaactcagatctgacagaggaagaaacagtcatcaaactgcagaatgaactttgtcctcttctcactggtggacagttaaagtcttatcagcttaaaggtgtcaaatggctaatatcattgtggcagaatggtttgaatggaatattagctgatcaaatgggacttggaaagacgattcaaacgatcggtttcttatcacatctgaaagggaatgggttggatggtccatatctagtcattgctccactgtctacactttcaaattggttcaatgagattgctaggttcacgccttccatcaatgcaatcatctaccatggggataaaaatcaaagggatgagctcaggaggaagcacatgcctaaaactgttggtcccaagttccctatagttattacttcttatgaggttgccatgaatgatgctaaaagaattctgcggcactatccatggaaatatgttgtgattgatgagggccacaggttgaaaaaccacaagtgtaaattgttgagggaactaaaacacttgaagatggataacaaacttctgctgacaggaacacctctgcaaaataatctttctgagctttggtctttgttaaattttattctgcctgacatctttacatcacatgatgaatttgaatcatggtttgatttttctgaaaagaacaaaaacgaagcaaccaaggaagaagaagagaaaagaagagctcaagttgtttccaaacttcatggtatactacgaccattcatccttcgaagaatgaaatgtgatgttgagctctcacttccacggaaaaaggagattataatgtatgctacaatgactgatcatcagaaaaagttccaggaacatctggtgaataacacgttggaagcacatcttggagagaatgccatccgaggtcaaggctggaagggaaagcttaacaacctggtcattcaacttcgaaagaactgcaaccatcctgaccttctccaggggcaaatagatggttcatatctctaccctcctgttgaagagattgttggacagtgtggtaaattccgcttattggagagattacttgttcggttatttgccaataatcacaaagtccttatcttctcccaatggacgaaacttttggacattatggattactacttcagtgagaaggggtttgaggtttgcagaatcgatggcagtgtgaagctggatgaaaggagaagacagattaaagatttcagtgatgagaagagcagctgtagtatatttctcctgagtaccagagctggaggactcggaatcaatcttactgctgctgatacatgcatcctctatgacagcgactggaaccctcaaatggacttgcaagccatggacagatgccacagaatcgggcagacgaaacctgttcatgtttataggctttccacggctcagtcgatagagacccgggttctgaaacgagcgtacagtaagctcaagctggaacatgtggttattggccaagggcagtttcatcaagaacgtgccaagtcttcaacacctttagaggaagaggacatactggcgttgcttaaggaagatgaaactgctgaagataagttgatacaaaccgatataagcgatgcggatcttgacaggttacttgaccggagtgacctgacaattactgcaccgggagagacacaagctgctgaagcttttccagtgaagggtccaggttgggaagtggtcctgcctagttcgggaggaatgctgtcttccctgaacagttaggacacattaataagccaggccttgaaacc

SEQ ID NO: 1668 - protein, 764 aa, Arabidopsis thaliana
  G2754,SWI/SNF domain coordinates 198-393,554-638
MVSLRSRKVIPASEMVSDGKTEKDASGDSPTSVLNEEENCEEKSVTVVEEEILLAKNGDSSLISEAMAQEEEQLLKLREDEEKANNAGSAVAPNLNETQFTKLDELLTQTQLYSEFLLEKMEDITINGIESESQKAEPEKTGRGRKRKAASQYNNTKAKRAVAAMISRSKEDGETINSDLTEEETVIKLQNELCPLLTGGQLKSYQLKGVKWLISLWQNGLNGILADQMGLGKTIQTIGFLSHLKGNGLDGPYLVIAPLSTLSNWFNEIARFTPSINAIIYHGDKNQRDELRRKHMPKTVGPKFPIVITSYEVAMNDAKRILRHYPWKYVVIDEGHRLKNHKCKLLRELKHLKMDNKLLLTGTPLQNNLSELWSLLNFILPDIFTSHDEFESWFDFSEKNKNEATKEEEEKRRAQVVSKLHGILRPFILRRMKCDVELSLPRKKEIIMYATMTDHQKKFQEHLVNNTLEAHLGENAIRGQGWKGKLNNLVIQLRKNCNHPDLLQGQIDGSYLYPPVEEIVGQCGKFRLLERLLVRLFANNHKVLIFSQWTKLLDIMDYYFSEKGFEVCRIDGSVKLDERRRQIKDFSDEKSSCSIFLLSTRAGGLGINLTAADTCILYDSDWNPQMDLQAMDRCHRIGQTKPVHVYRLSTAQSIETRVLKRAYSKLKLEHVVIGQGQFHQERAKSSTPLEEEDILALLKEDETAEDKLIQTDISDADLDRLLDRSDLTITAPGETQAAEAFPVKGPGWEVVLPSSGGMLSSLNS

SEQ ID NO: 1669 - DNA, 1702 bp, Arabidopsis thaliana
  G2757,family:TH
gcgcgtattcagcggcggtggagaaggttgcgtcgggtgcgcacacgtcacccaccactccgcggtgcactttagcacaattctcaaccggccacctccttctcggcccaatccatcattaacctaacttttctttctaacgtgcgcctctcctctcctccgcctctttattatcccttacccaccgctctttctactttcactaatttattcttcgccgccgcaatgacaatacccgatgatggatctcccgtcgccatggccatcgattcttccaccgccgtaaccgtcgccaccaccaccactcgaagagttcctcctccgtgctggaccgacgaggaaaccgctgcgcttgtcaatgcctacaaggataaatggttcgccctccgccgcgggaacctccgtgcggctgattgggatgacgtcgccgcggctgtttcgtcctcgtccaccgttggaggtccgccgaaatcagcaatccaatgtcgacacaagatcgagaagcttcggaaacgttatcgcggcgaaaaacaacgagctcttaatcgaccaggcaagttctcttcctcttgggatttgttccctatcttggatgctatgggattcgctccggtgactccggcagccgtagaaacttacgatcccgatgtggatcatgatgatgagagtaacggtttggatggatttagggttagatcgaagaggtctgggaagtttagcggtggttactctgattcacctcgagaagtaggagatggatatggggttagatctagggcaaggagtaacatgaaaatgtatggtggtttcaagtctgagtttgattcagatcacgattcaggaagtggatttggattgaaaaggaaatacaatgggaatccaaaggttagtgctgatttcgatgctgattctgatgatgagattgtgttagtccccaaggcaactaggcttaggactcatggcaagccttcctctggtgattttagccatggcagtggtggtgggtttccgttgaagtcgtttggtgatcggaattttgcttctcatgggtttaaacctaagaatttcagtaagcctgaacccaatttctctcaggatctggattatgatgatgagtttgatgatgatagagcagagagggaaggattcaacccgaggattcaaagttctaggagctcttcgcgggtgaatggctacagcaggaaggatgggagctatcctcgaaacactggtgcttccaatggctatggatcgtcttctaggttcaagcatgagcaaatgaatgcagcagcagaagttgagtctgacccgatcgatgaagttgtttcttctgttaagatgttgacagaaatgtttgtgagggtggagaattcgaagatggagatgatgagagagatggagaagtcgagaatggagatggagctgaagcattgccagatgatgcttgagtcacagcagcagatcataggcgcgtttgctgaagcgttgagcgagaaaaagagcacaaatgcaaggaggccggtttcgtagtagcaaagtcgcttattaaagaggaatgaaacggttcataatatggattttcatatggtataatgatcaaatagctttcgagtgtagtacgaagtgtcttcttcgagttactaggaaacaaaacggcagtgaaatttgatgcgagtaatgcaggttaagtttttcaattatt

SEQ ID NO: 1670 - protein, 434 aa, Arabidopsis thaliana
  G2757,TH domain coordinates 35-123,348-434
MTIPDDGSPVAMAIDSSTAVTVATTTTRRVPPPCWTDEETAALVNAYKDKWFALRRGNLRAADWDDVAAAVSSSSTVGGPPKSAIQCRHKIEKLRKRYRGEKQRALNRPGKFSSSWDLFPILDAMGFAPVTPAAVETYDPDVDHDDESNGLDGFRVRSKRSGKFSGGYSDSPREVGDGYGVRSRARSNMKMYGGFKSEFDSDHDSGSGFGLKRKYNGNPKVSADFDADSDDEIVLVPKATRLRTHGKPSSGDFSHGSGGGFPLKSFGDRNFASHGFKPKNFSKPEPNFSQDLDYDDEFDDDRAEREGFNPRIQSSRSSSRVNGYSRKDGSYPRNTGASNGYGSSSRFKHEQMNAAAEVESDPIDEVVSSVKMLTEMFVRVENSKMEMMREMEKSRMEMELKHCQMMLESQQQIIGAFAEALSEKKSTNARRPVS

SEQ ID NO: 1671 - DNA, 1025 bp, Arabidopsis thaliana
  G2763,family:HLH/MYC
aaaggaagaagaagaagaagaaaggattcgtcttccttcttccacaccctttctgacacctcatctcccctcccaccttctccgtcccgttccgtttctccatcagatcctcgattccgatccaacagttcgaattcagtttccgattctgatctgatcgaaccaatactcactgagatttgatcggcgattatggagtctatatctccggtatcgaatcagcttcttcagccgacgacgacgagctctaattccgatcgctctcgtcgtaagcgtaagaagaaatcatcgccatcatcggttgagaaatctccatctccgtcaatatcgttggagaaatggagatcggagaagcagcaacagatctactcaacgaagctagttcatgctttaagagagctacgaatcagccaacaaccatcttcatcatcatcttcttcgattccacgtggaggtagagccgtacgtgaagtcgccgatagagctttagcagttgcggcgagaggtaaaacgttatggagtcgagcgatactttcaaaagctgtaaaactcaaattcaggaaacacaaacgccagagaatctctaatccgacgacgacgacgttaaccaccgggagtatcaggtcaaagaaacagagagcgacggttttgaggcttaaggctaaaggtttgccagctgtacagaggaaagtgaaagtactgagccggttagttcccggttgccgtaaacaatcattaccggtggttttagaagaaaccactgattatatagctgcgatggagatgcagattcgtactatgactgcgattctctccgccgttagttcttctcctccgccgccaacgccaggtcacgaagggggacaaacacacatgcttggttagttggccaaactgtccttttatttttttccaattttaaaaaccaaaaaaaaaactgtttttttttatcatattattattcttctcactgtattgtttgttgtttgaatattttactattcaactttatttaccatttcgtc

SEQ ID NO: 1672 - protein, 230 aa, Arabidopsis thaliana
  G2763,HLH/MYC domain coordinates 141-201
MESISPVSNQLLQPTTTSSNSDRSRRKRKKKSSPSSVEKSPSPSISLEKWRSEKQQQIYSTKLVHALRELRISQQPSSSSSSSIPRGGRAVREVADRALAVAARGKTLWSRAILSKAVKLKFRKHKRQRISNPTTTTLTTGSIRSKKQRATVLRLKAKGLPAVQRKVKVLSRLVPGCRKQSLPVVLEETTDYIAAMEMQIRTMTAILSAVSSSPPPPTPGHEGGQTHMLG

SEQ ID NO: 1673 - DNA, 1402 bp, Arabidopsis thaliana
  G2765,family:HLH/MYC
gggatgtttgtgaccttttgtctcttcttctctaaaattctctttctcccaaaaactaaaaaaccaaaaaaaccaaaaaatgtacgcaatgaaagaagaagactgtcttcaaacatttcacaacttacaagactatcaagaccagtttcatcttcatcatcatccacaaattctcccctggtcgtcgacatctttaccttcttttgacccactccatttcccatctaacccgacccgttattctgacccggttcactacttcaacagaagagcttcttcttcctcttcttcttttgactataacgacggttttgtctctcctcctccttccatggatcatcctcagaaccatctaaggattttatccgaagctcttggacccatcatgcgtcgtggctcgtcctttgggttcgatggtgagatcatgggaaaattgagtgcacaagaagtcatggatgctaaggctttagctgcttcaaagagtcatagtgaagctgagagaagaagacgagagagaatcaacactcatcttgctaagctgcgtagtatattaccaaacacaaccaaaacggacaaagcttctttgctagcggaagtgatccaacacatgaaggagctaaaacgacaaacatcacagatcaccgacacgtatcaagtcccaacagagtgcgatgatctgaccgtagattcgtcttacaacgacgaggaaggaaacttggtgataagagcatccttttgctgccaagacaggactgacctcatgcatgacgtcatcaatgccttaaagtctcttcgtcttcgaactctcaaagctgagatcgcaaccgtaggtggtagagtcaagaacatcttgttcttgagccgagaatacgatgatgaagaagatcatgattcatatcgtagaaacttcgatggtgatgacgtggaggattatgatgaagagaggatgatgaataatcgtgtgagttcgatagaagaagcgttaaaggcggttatagagaagtgtgttcataataatgatgaaagtaacgataacaataacttggagaaatcatcttcagggggtattaagaggcaaaggactagtaagatggtgaatcgatgttataattagttaattaagtcaagtctttattaactagggttagttaattagacttgcaaaatgggatttgattatgggttggtgatattagtattattttcggtgtttttagtagttgggattgggtttcttcttctatgtttttttaatctatgaagaaccctttgtttagggttttatagtgatgagtttggtttatatatggtagttaagacattttatcgtcttaattaatataggaaatgtatagagcttgggtttgtattaatttatcaagaagttttatttatcatattc

SEQ ID NO: 1674 - protein, 344 aa, Arabidopsis thaliana
  G2765,HLH/MYC domain coordinates 128-185
MYAMKEEDCLQTFHNLQDYQDQFHLHHHPQILPWSSTSLPSFDPLHFPSNPTRYSDPVHYFNRRASSSSSSFDYNDGFVSPPPSMDHPQNHLRILSEALGPIMRRGSSFGFDGEIMGKLSAQEVMDAKALAASKSHSEAERRRRERINTHLAKLRSILPNTTKTDKASLLAEVIQHMKELKRQTSQITDTYQVPTECDDLTVDSSYNDEEGNLVIRASFCCQDRTDLMHDVINALKSLRLRTLKAEIATVGGRVKNILFLSREYDDEEDHDSYRRNFDGDDVEDYDEERMMNNRVSSIEEALKAVIEKCVHNNDESNDNNNLEKSSSGGIKRQRTSKMVNRCYN

SEQ ID NO: 1675 - DNA, 1304 bp, Arabidopsis thaliana
  G2766,family:HLH/MYC
ctttctctcaaaccctctcctcaagattttttcctaagcatcagattagcttttgtagggtttttcttttccggtttcatgtaccctcctaattcctctaagtccaccgctcatgacggcggcggcgatgccgacaccaatcaatatgactcagccgctggagctacccgtgatttctcctctcttggccctcaaacccaccatcatccgccaccgcagcggcagcagcagcatcagcagaatcccaacctcgtcggccattatttaccgggcgagccatcttccatcggattcgattccaacgcttcttcttcgtcttctttgttccgacacagaagctctccggctggattctacgaccaacatcttcccactgatcccaacggtttttctctaggacggccaaacggaggctacggcggaggaggagagcaagggccgtcgaggttgaagtcggagctgagattctctagtgggagtagtagccatcaagaacataattctctaccgcgaatctcggaggttgaagcggctgcagcggctagaaacggtgtcgcatcaagtagtatgagttttggaaataatcgtactaacaattgggacaactcgtcttctcatatcagtttcaccattgatcaacccggaaaacggtccaagaactccgactttttcaccttagaaactcagtatagcatgccgcaaacaactctggaaatggcgacaatggagaacttgatgaacatcccagaggactcggtgccttgtagggctagagccaagcgcggcttcgcgactcacccacgcagcattgctgaaagggagagaagaacgaggataagcgggaagctgaagaagctacaagaacttgtgcctaatatggacaagcaaacgagctacgcagatatgttggatttggctgttgagcatatcaaaggtcttcagcaccaagtagagtcactggaaaagggaatggagagatgtacttgtggggcatgcaagaagcgatgatgaatgatattgttccaagtatgatgcaataaagtatagaagaaaaggagatcacttacgaaccaaattctaagacagaaagaaacatagcaaaaaggagttattttggaggtctaaagaaagtgatgatggattaatgaaggctggttttgttactctctgaaagtcttgacctttattataacttaaaattcgatcaatcgattttttttttcctgttttcctcaaagttggttaattttagcttagagcaaaacccattatttgagattgaaagagatgcgcgtttgtgtgtg

SEQ ID NO: 1676 - protein, 309 aa, Arabidopsis thaliana
  G2766,HLH/MYC domain coordinates 234-292
MYPPNSSKSTAHDGGGDADTNQYDSAAGATRDFSSLGPQTHHHPPPQRQQQHQQNPNLVGHYLPGEPSSIGFDSNASSSSSLFRHRSSPAGFYDQHLPTDPNGFSLGRPNGGYGGGGEQGPSRLKSELRFSSGSSSHQEHNSLPRISEVEAAAAARNGVASSSMSFGNNRTNNWDNSSSHISFTIDQPGKRSKNSDFFTLETQYSMPQTTLEMATMENLMNIPEDSVPCRARAKRGFATHPRSIAERERRTRISGKLKKLQELVPNMDKQTSYADMLDLAVEHIKGLQHQVESLEKGMERCTCGACKKR

SEQ ID NO: 1677 - DNA, 3300 bp, Arabidopsis thaliana
  G2768,family:DBP
ataaacacggatacgagagaaagagagctcttgtgtccaaaccctagatttcaagatcgatctatcttctttctcgtgaagacaccgctctctactcgattcctatgattactctctagatccttttcaatttccccccgaaaggtttctcgattttgatcccccaaatcggagcttggagctaccggatcttatggagtgaagcccgatcatccgtttctttgttacaagttgtcgttttgtagctgcgaagattcctcggagaaggagatttggagacatcaccggcgccattctcagctcggcgatcacacggacgttctcgttccttgaatctgcaggaacttttccaggattcgttgatttggattgattttgctacacgcgtggagtttccttctgtgaagtcgaatcagcgaaatacaaattttcaatggcaatttattacaagtttaagagtgcaagggattatgataccattgccatggatggtccttttatatccgtcggtattctcaaagacaaaattttcgaaactaagcatttgggcactggtaaagaccttgatattgtcgtctccaatgcccaaactaacgaagagtatctggatgaagcaatgttaatcccaaagaatacatctgtccttattcgtcgggttcctggacgtcctcgcatcacagttattaccacacaagagcctagaatccagaataaagtggaagacgttcaggctgaaaccaccaattttcctgttgctgatccatctgctgctgaatttcctgaagatgagtatgacgagtttgggactgatctttattccattcctgatacccaagatgcccagcatattattccacgtcctcatcttgcaaccgcagacgacaaagtagatgaagaaagcaaaattcaggcgctgattgacactccagcacttgactggcaacaacgacaaggtcaagatacttttggagctggtagaggttatgggaggggtatgcctggaaggatgaatggacgtggttttggaatggaaaggaaaacgccacctccaggttatgtgtgccatcgttgcaatatccctggacattttattcagcattgccccacaaatggagaccctaactatgatgttaagagagttaagccacctactggtatccccaagtccatgttgatggcgaccccagatggttcttattccttgccaagtggcgcagttgcagttctgaaaccaaatgaggatgcttttgagaaggaaatggagggattgccatcaacaacacgttctgtaggagaacttccacctgagctaaaatgcccattatgcaaagaagtgatgaaagatgctgcgcttacaagcaaatgttgttacaagagcttctgtgacaagtgtatcagagatcacattatttcaaagtcaatgtgtgtttgtggaagatcagatgtacttgctgacgaccttctaccaaacaagaccctcagggataccataaaccgtattttggaagctggaaacgatagcactgagaatgtgggcagcgttggccatatcccagatttggagtctgcacgctgtccacctcccaaggctctatctcctactacatctgttgcatctaaaggcgagaagaaaccagtacttagtaacaataatgatgcttcaactttaaaggcgccaatggaagttgcagagatcacaagtgcccctcgtgcatctgcagaagtgaatgtagaaaagccagttgatgcatgtgaaagcactcaagggtccgtgattgtgaaagaagcaacagtgtcaaagttgaatacgcaagcccccaaggaagaaatgcagcagcaggttgctgctggagagccaggaaaaaagaagaaaaagaaaccaagagtgcctgggaatgacatgcaatggaatcctgtgccagatctagcaggccctgactatatgatgcaaatgggaccaggtccgcagtacttcaacggcatgcaacctggcttcaatggcgtacaaccaggcttcaacggtgttcaacctggcttcaatggctttcaccctggcttcaatggatttggaggcccgtttccaggcgcaatgcctccatttatgggttacggattaaacccaatggacatgggatttggtgggggtatgaatatgatgcatccagatccattcatggcacaaggatttgggttccctaatataccaccaccccatagggacctagctgaaatgggaaaccgaatgaatctccaacgtgctatgatgggcagagatgaagccgaagcccgaaacgctgagatgttaagaaaacgtgaaaacgagagacgacctgaaggggggaagatgtttagggatggagagaatagcagaatgatgatgaacaacggtacttcagcctctgcatcatccatcaaccctaataaatctagacaagcacctccaccaccaatccacgattacgatcgccggagacgaccggagaagagactatccccagagcatccgcctacgcgtaaaaacatttccccgtctcgcgactccaagagaaaatccgagcgttatcctgatgaacgagatcggcaacgcgaccgtgagaggtcacgtcaccaagacgtagatcgtgaacacgaccgtactcgcgaccgtcgcgatgaagacagaagccgagatcatcgccaccaccgtggtgaaaccgaacgcagccaacatcaccaccgcaagagatcggaaccgccttcatcggagccaccagtccctgctactaaagcagagatcgagaataatcttaagtctagcgtattcgctcggataagttttccggaggaagaaacatcttctggtaaacgaagaaaggtgccttcctcttcttctacttctgttacggatccatctgcttccgcctctgccgcagccgccgtgggaacatcagttcaccgacacagtagtcggaaggaaatagaagtagcagattatgaatctagtgatgaagataggcatttcaagaggaagccgtcaaggtacgcgcgatcaccaccggtggtggttagtgatgtgagtgaagataaactccgatactcaaaacgtggaaagggggagagatctcgagcttgacatggattttcaaacatgtttttttttttttttgtataatcaaaaacagagaatgagaatcttcttgttttgctgtaacgaacaaagagagagagttcttttgtcatcgaattcttttttaatttttgtagtggaattcgatttcgtaactactttattcttaatctatgagaccagcgaatttacag

SEQ ID NO: 1678 - protein, 892 aa, Arabidopsis thaliana
  G2768,DBP domain coordinates 288-346
MAIYYKFKSARDYDTIAMDGPFISVGILKDKIFETKHLGTGKDLDIVVSNAQTNEEYLDEAMLIPKNTSVLIRRVPGRPRITVITTQEPRIQNKVEDVQAETTNFPVADPSAAEFPEDEYDEFGTDLYSIPDTQDAQHIIPRPHLATADDKVDEESKIQALIDTPALDWQQRQGQDTFGAGRGYGRGMPGRMNGRGFGMERKTPPPGYVCHRCNIPGHFIQHCPTNGDPNYDVKRVKPPTGIPKSMLMATPDGSYSLPSGAVAVLKPNEDAFEKEMEGLPSTTRSVGELPPELKCPLCKEVMKDAALTSKCCYKSFCDKCIRDHIISKSMCVCGRSDVLADDLLPNKTLRDTINRILEAGNDSTENVGSVGHIPDLESARCPPPKALSPTTSVASKGEKKPVLSNNNDASTLKAPMEVAEITSAPRASAEVNVEKPVDACESTQGSVIVKEATVSKLNTQAPKEEMQQQVAAGEPGKKKKKKPRVPGNDMQWNPVPDLAGPDYMMQMGPGPQYFNGMQPGFNGVQPGFNGVQPGFNGFHPGFNGFGGPFPGAMPPFMGYGLNPMDMGFGGGMNMMHPDPFMAQGFGFPNIPPPHRDLAEMGNRMNLQRAMMGRDEAEARNAEMLRKRENERRPEGGKMFRDGENSRMMMNNGTSASASSINPNKSRQAPPPPIHDYDRRRRPEKRLSPEHPPTRKNISPSRDSKRKSERYPDERDRQRDRERSRHQDVDREHDRTRDRRDEDRSRDHRHHRGETERSQHHHRKRSEPPSSEPPVPATKAEIENNLKSSVFARISFPEEETSSGKRRKVPSSSSTSVTDPSASASAAAAVGTSVHRHSSRKEIEVADYESSDEDRHFKRKPSRYARSPPVVVSDVSEDKLRYSKRGKGERSRA

SEQ ID NO: 1679 - DNA, 1968 bp, Arabidopsis thaliana
  G2771,family:HLH/MYC
gttctcttctcttctcaaaattttttgtttctttttgtctcaagctatgaacttccatactttgaatcttctacttctctttcttcctcttacttgatcttcctatagcatacttccatcatgggtgaagatgatatagtggagctcttatggaacggccaagtcgttcgaaccagccaaccacaaagaccttcctcgggtaaaccttctcctactccacccattctgcgtggtagcggaagcggcagcggagaagaaaatgctccccttccacttccacttctacaacctccacgtcccctgcatcatcagaatctcttcattcgggaagaagaaatgtcttcttggcttcactattcttacactggtgtcacgtccacaccggctactcatccgcaaagttctgtttccctgccaccaccaccacccattgctccgtacatttccggtttggattttggtttgaaattaggagtgaagatgatgtggtggaactcttatggaaaagcggccaagtcgttcaaagcatccagacacagagacccattcctcctcccattttccgcggcagcggaagtgggggaggaagacgaaatggcctcttggctttaccatcccctccgtcaagattatttttcctctggcgtcgcctctacttcagctactcgcccgcaaagttccgcctctctagcaccaacaccaccaccacccagtgttccctacggtcagattcccgttgagagaaggacagagaattttatgaacttcttgaggctaagagggaacatattttccggcggtagagttgaagctggtccggtggttatagaatcgacgcagataggctcaagcgcgaccccgtcgtcttcagccgctgaatcctgtgtaataccagcgactcacggcaccgagagtagagcggcggccattaccggagtatcccgtacttttgcagttcctggtcttggtcggaggggaaaggaggtggcaaccgagacggccggaacatcatattcaggggtaaacaaggccgaaacagagcgggttcaaatacaaccggagagggagacgaaaattaccgaagataagaagagagaagaaaccattgcagaaatccaaggaactgaagaagctcatggttcaacgtctaggaagaggtcacgagctgcagatatgcataacctctccgaaaggagacggagggaaaggatcaacgagaggatgaaaactctgcaagaactccttcctcgctgcagaaagactgataaagtttcaatgcttgaagatgttatcgagtacgtgaaatcgctacagctgcaaatacagatgatgtcgatgggacatggtatgatgccaccgatgatgcatgaggggaatacgcaacagttcatgccccacatggccatggggatgaagggtatgaaccggcctcctcctttcgtaccgttccccggcaaaacttttcctaggccgggtcatatggcaggtgtaggtccatcatacccagcattgcgctacccttttccagacacacaagcctctgacctatccagagtccatgtaccaagtctgcactctaacccggtgccaaaccagcctcggtttccggcttacataaatccctatagccagtttgttggtctccaccagatgcaacaacctcctcttccattgcagggtcaaccaacatcacagcctagtttcagccacgcaagtactagcaagtaacttggggatcaggacaaccaaccaacaagttagtaggaatcaggaacagccagaggcttttcttgccggatacattaatggtcaagattctgacagatggatctccattgtgttattgcaagttgatgttgaagagttaaaaaaaaaggatctgttctctaagaaaagcacaattttgaaggtgctaacatgcaaatgtttttcagaaaatgaaaatctatttcttcccggaaaaaaaaa

SEQ ID NO: 1680 - protein, 535 aa, Arabidopsis thaliana
  G2771,HLH/MYC domain coordinates 345-402
MGEDDIVELLWNGQVVRTSQPQRPSSGKPSPTPPILRGSGSGSGEENAPLPLPLLQPPRPLHHQNLFIREEEMSSWLHYSYTGVTSTPATHPQSSVSLPPPPPIAPYISGLDFGLKLGVKMMWWNSYGKAAKSFKASRHRDPFLLPFSAAAEVGEEDEMASWLYHPLRQDYFSSGVASTSATRPQSSASLAPTPPPPSVPYGQIPVERRTENFMNFLRLRGNIFSGGRVEAGPVVIESTQIGSSATPSSSAAESCVIPATHGTESRAAAITGVSRTFAVPGLGRRGKEVATETAGTSYSGVNKAETERVQIQPERETKITEDKKREETIAEIQGTEEAHGSTSRKRSRAADMHNLSERRRRERINERMKTLQELLPRCRKTDKVSMLEDVIEYVKSLQLQIQMMSMGHGMMPPMMHEGNTQQFMPHMAMGMKGMNRPPPFVPFPGKTFPRPGHMAGVGPSYPALRYPFPDTQASDLSRVHVPSLHSNPVPNQPRFPAYINPYSQFVGLHQMQQPPLPLQGQPTSQPSFSHASTSK

SEQ ID NO: 1681 - DNA, 1089 bp, Arabidopsis thaliana
  G2774,family:HLH/MYC
atgcaacttcgacattaaattccaaagtaaactacacaattaagaacatgacggaagagtttgagatcgcaggaatctccaccggagcttggtggagctcgccaacaaacaccgccgcagtattctctggctactcgctgccatgttccactgagattagccctgatgtcacaaatttcggatggcaaaacttcgataacaagattaacgatcataatgatggttgtatgaacatgcataatagtttcttcgaaggactattaatcgatcctaacgatcaattactaccggatccatggtccaaaagtacaattcctaacgctaaatctgagctccttgaaaacttcccattcttagataacatgttcttggtcgattcagaagctgaatctttgttggatcatgaaatcagaaaccataagtcgtctaaggagcaaattacacaagactacaagaatcttacttcaaaggcacaattagaagagaacagcgatgagtattcaccgcgattactaaaaagaccgagactcgagacactatctccattgccaagcttcaaagttcgtaaagaaaaactcggagatagaatcactgcgcttcagcaactggtttctccatttggcaagacagatacagcttctgttctcaacgaagctgtagagtacataaagtttcttcaagaacaagtcactgtattgagtaatccagaacagaacaccataggatctgttcaacaacagcagtgttcaaacaagaaatctatcaatactcaaggagaagtagaagaagacgaatgtagtccaagaagatatgtagatctttcgagccgtggactatgtctaatgccgatctcagcttcatatcccgtggctgcagctgcggcttcggctgcagagatgaacgtacatctggtttctggcatcttccattctttgtaaacttataaactaaatacgtagatacataaacaaacaaagtaatcttccgcaaacaggggatcttgtaaagttttatgtccctttttaatttatacagaaatgtaaatgtcctgtaatacttcaaaatcatatattgtttgtttgcgtacgt

SEQ ID NO: 1682 - protein, 296 aa, Arabidopsis thaliana
  G2774,HLH/MYC domain coordinates 158-215
MTEEFEIAGISTGAWWSSPTNTAAVFSGYSLPCSTEISPDVTNFGWQNFDNKINDHNDGCMNMHNSFFEGLLIDPNDQLLPDPWSKSTIPNAKSELLENFPFLDNMFLVDSEAESLLDHEIRNHKSSKEQITQDYKNLTSKAQLEENSDEYSPRLLKRPRLETLSPLPSFKVRKEKLGDRITALQQLVSPFGKTDTASVLNEAVEYIKFLQEQVTVLSNPEQNTIGSVQQQQCSNKKSINTQGEVEEDECSPRRYVDLSSRGLCLMPISASYPVAAAAASAAEMNVHLVSGIFHSL

SEQ ID NO: 1683 - DNA, 1144 bp, Arabidopsis thaliana
  G2776,family:HLH/MYC
actagttctccacaaatctctcttctctctctctcttctcctagaagctgattttcagaggcaacagcaatgagtatcttatccacaagatggttttctgagcaggaaatagaagaaaatagcataattcaacagtttcacatgaactcaatagtgggagaggtccaagaagctcaatacatttttccacactctttcacgaccaacaatgatccctcttatgatgatttgatcgaaatgaaaccaccaaagatccttgagacaacttacatatcaccttcttctcatcttcctccaaattcaaagccccatcatattcaccgtcattcttcctcaagaattctctctttcgaagattatggttcaaatgatatggaacacgagtactctcccacctacctaaactcaatctttagcccaaaattagaggctcaagtgcaaccacaccagaagagtgatgagtttaatcgaaaagggaccaagagggctcaaccgttttcaagaaaccaatccaatgctcaggatcacataatagccgaaagaaaacgtagagagaagcttactcaaagattcgtagctctttccgctctagttcctggccttaaaaagatggacaaggcttctgtgttgggagatgcattaaagcatataaagtatctccaagaaagagtgggagagttggaggaacagaagaaagaaagaagattggaatcaatggttcttgtgaagaagtctaagctgatcttggacgataataatcaatcattctcttcttcttgtgaagatggcttctcggacttggatcttcccgagatcgaggtaagattctcggatgaagatgttctaatcaagatcctttgcgagaagcaaaagggtcatcttgccaagattatggccgagattgagaaacttcatatcttgataactaattcaagtgtattgaattttggaccaactcttgatatcaccattatagctaagaaggagagtgatttcgacatgacactcatggatgttgtaaagagcttaaggtctgctttgtcgaatttcatatgattgtattaactttcatgcttctcgtcaatttctactgtgggagatcttgttgaacacatggacgaaacataagtggtttgccatgaaa

SEQ ID NO: 1684 - protein, 328 aa, Arabidopsis thaliana
  G2776,HLH/MYC domain coordinates 145-202
MSILSTRWFSEQEIEENSIIQQFHMNSIVGEVQEAQYIFPHSFTTNNDPSYDDLIEMKPPKILETTYISPSSHLPPNSKPHHIHRHSSSRILSFEDYGSNDMEHEYSPTYLNSIFSPKLEAQVQPHQKSDEFNRKGTKRAQPFSRNQSNAQDHIIAERKRREKLTQRFVALSALVPGLKKMDKASVLGDALKHIKYLQERVGELEEQKKERRLESMVLVKKSKLILDDNNQSFSSSCEDGFSDLDLPEIEVRFSDEDVLIKILCEKQKGHLAKIMAEIEKLHILITNSSVLNFGPTLDITIIAKKESDFDMTLMDVVKSLRSALSNFI

SEQ ID NO: 1685 - DNA, 2493 bp, Arabidopsis thaliana
  G2777,family:HLH/MYC
tggctgatcttttttttttccgatcagatcgaagagtttttatctcgtaattcgaactttttatttggtttctctgacttagagatctccaagcttcacgtaatttgctgtcgaagaagatctatcgattccacgaatttggtgacttctgccgattctcccgtttgaattctgtggaattcgctgagaaaagttgcggcggaggctgatttaggttaaatcgagcagaatttgaccaaattcgaggatttttatcggtaaaaagatacagagaaagcataattcagcaacttcagagctcaattccgcttcttcaaccatcgaaaaccacaatatctcttgaatcagctgctacaagtcgcagatctgagctgctagccaatttttgcgataattcccgcgcacagattagtaatagaataatttaaaaagaattcaaaaaccgtcgaagctctgtcgttcatggagcttcctcaacctcgtcccttcaaaacccaagggagaaaaccaacacatgattttttatcgctctgcagtcattcaaccgtccacccagatccaaagccaacaccaccaccttcttctcaaggtagtcacttgaaaacccatgattttcttcaaccgttagaatgtgttggtgctaaagaagacgtaagtaggattaactctaccactacagcgtccgagaagccaccgccccctgctccacctccaccgttgcagcacgtgcttcccggtggtatagggacttatacgattagccccattccttacttccatcatcatcatcagagaattcctaagccggagttgtcaccaccaatgatgttcaatgctaatgagagaaacgttttggatgagaattctaactctaattgcagctcgtacgccgctgcatcaagcgggttcactctgtgggatgaatctgcttctgggaagaagggacagacaaggaaggagaatagtgttggggagagagtaaacatgagagctgatgttgcagcaactgtgggacaatggccagtggcggagagacggtcccagtctttgacaaacaaccatatgagcggtttcagttctctctcttcctctcaagggtctgtgcttaagagccagagcttcatggacatgataaggtcagcaaaaggaagttcacaggaagatgatttagatgatgaagaagattttatcatgaagaaagaaagctcctcgactagccagagccatagagtggatttgagggtaaaagcagatgtgagaggctctcctaacgatcaaaagctgaacacacctaggtctaaacattctgctacagagcaacggagaaggagcaagatcaatgatagatttcagatgttgagacaactaatacctaacagcgaccaaaagcgggataaggcctccttcttactagaggttatcgagtatattcaattcttacaagagaaagcagacaagtatgtgacctcttaccaaggatggaatcacgaacctgcgaagctattgaattggcagagtaacaacaaccaacagctagtacctgaaggagttgcttttgctccaaaattggaagaagagaaaaacaacattccggtttcggtccttgcaactgcacaaggtgttgttattgatcatccaacaaccgcgacgacctctccatttccattgtcgattcaaagcaacagttttttctctcctgtgattgcgggtaatcccgtaccccagttccacgcaagagtcgcatcatcagaggctgtagagccaagtccgagttcccggagtcaaaaagaagaagaagatgaggaagttcttgagggtaacatcagaatttcaagtgtttactcacaaggattagtgaaaacactgagagaagcattggagaattcaggagtggacttaacgaaagcaagcatctccgttgaaatcgagctcgctaaacaatcctcgtcttcttccttcaaggatcatgaagttcgtgaaccggtttctcgaaccagaaacgacaatgtcaagcaaactcggaaaccaaaacggctcaagacgggacagtagaagttataaaaacaaaacccaaacacacaatccggtaaaagttaaacaccaaaattgattcctctgtttttttctttaaatcattttatctcaaaaagggattataatttattattatagttatatctttgatttttttcttttgtacatccgaaatcctgttatatatatctcgtgggtccataatcgtatgagacctaagaagactagggcgacccggttatgctaaccgcattttagaacatactcttttgaggaatatatcgttaaggaaggctttcaaagttttctggaagcgtccagtgttaagtgaaaacatttttcactctcttatatacttgatcatctcacactttttatatttgtttcttcctcttactttgttctatggttttcaatgtaattccctggaaaaaaaaaaaaaaaaaaaaaaaaaaaaaa

SEQ ID NO: 1686 - protein, 529 aa, Arabidopsis thaliana
  G2777,HLH/MYC domain coordinates 273-331
MELPQPRPFKTQGRKPTHDFLSLCSHSTVHPDPKPTPPPSSQGSHLKTHDFLQPLECVGAKEDVSRINSTTTASEKPPPPAPPPPLQHVLPGGIGTYTISPIPYFHHHHQRIPKPELSPPMMFNANERNVLDENSNSNCSSYAAASSGFTLWDESASGKKGQTRKENSVGERVNMRADVAATVGQWPVAERRSQSLTNNHMSGFSSLSSSQGSVLKSQSFMDMIRSAKGSSQEDDLDDEEDFIMKKESSSTSQSHRVDLRVKADVRGSPNDQKLNTPRSKHSATEQRRRSKINDRFQMLRQLIPNSDQKRDKASFLLEVIEYIQFLQEKADKYVTSYQGWNHEPAKLLNWQSNNNQQLVPEGVAFAPKLEEEKNNIPVSVLATAQGVVIDHPTTATTSPFPLSIQSNSFFSPVIAGNPVPQFHARVASSEAVEPSPSSRSQKEEEDEEVLEGNIRISSVYSQGLVKTLREALENSGVDLTKASISVEIELAKQSSSSSFKDHEVREPVSRTRNDNVKQTRKPKRLKTGQ

SEQ ID NO: 1687 - DNA, 1016 bp, Arabidopsis thaliana
  G2779,family:HLH/MYC
aaagaagttgtcagaaaaaaaaaaaaaaaaaagtgtcaagaagatcatatctcaattcattatattatggcaaatttcgagaatctttcttctgattttcagacaatagccatggatatatattcttccataactcaagctgcagatctaaacaacaacaacagtaaccttcattttcaaacatttcatccttcctctacttctctcgaatcgctcttccttcatcatcatcaacaacaattacttcactttcccggaaactctccagacagtagtaacaatttctcttcaacttcaagtttcctccatagtgatcacaacatcgtcgatgagaccaagaagagaaaagctttgttacctactttgtcttcatcagagactagcggcgtctccgataatacgaatgttattgccactgaaacaggttctttgagaagaggtaagaggttgaagaagaagaaggaagaagaagacgagaaagagagagaagttgttcatgtgagagccagaagaggccaagccactgatagccacagcttagcagaacgggttcggcgagggaaaataaacgagagattaagatgcttgcaagatatggtgcccggatgttataaggctatgggaatggctacgatgcttgacgagataattaattatgtccagtctctacagaatcaagtcgagttcctctcgatgaaactcactgcagcaagttcgttttatgactttaactcagagacagatgcagttgattccatgcagagagcaaaggcacgtgagacagtggagatggggagacaaacaagagatgggagtcctgtcttccatttatcaacatggtccctttgacttttgttttctcttttctcttttccttcttttttattgttttcgaaattattcttctatttatttggatgcgatatgtcatatatacgacccaacttgggataatatttgtaatctgtatacttgtaatttcgacgatataaatttattggtgacttataattgtc

SEQ ID NO: 1688 - protein, 260 aa, Arabidopsis thaliana
  G2779,HLH/MYC domain coordinates 148-206
MANFENLSSDFQTIAMDIYSSITQAADLNNNNSNLHFQTFHPSSTSLESLFLHHHQQQLLHFPGNSPDSSNNFSSTSSFLHSDHNIVDETKKRKALLPTLSSSETSGVSDNTNVIATETGSLRRGKRLKKKKEEEDEKEREVVHVRARRGQATDSHSLAERVRRGKINERLRCLQDMVPGCYKAMGMATMLDEIINYVQSLQNQVEFLSMKLTAASSFYDFNSETDAVDSMQRAKARETVEMGRQTRDGSPVFHLSTWSL

SEQ ID NO: 1689 - DNA, 1531 bp, Arabidopsis thaliana
  G2783,family:ACBF-like
atcaacaatctctcatctttagcattgttttgttatcttcttcttcatcacaatttttctacggtcagagattcaaaagagttctttctctctatcttattctccgatcatcatgatgcagcagccaccacccggaggtatccttccacatcacgctcctcctccttctgcgcaacaacagtacggttaccaacaaccttacgggattgctggagctgctccaccaccaccacagatgtggaatcctcaagcggcggcgccgccatcagttcagcctacgaccgctgacgagatccggactctttggatcggggacttacagtattggatggatgagaatttcctctacggttgctttgctcataccggagagatggtttctgctaaagtgattcgtaacaagcaaaccggtcaagttgaaggatacggtttcattgaattcgcatctcatgctgctgctgaaagagttctacaaacattcaacaacgctcctatcccgagctttcctgatcagctctttagactgaactgggcatcattgagttcaggagataaacgagacgattcaccggactacacgatatttgtcggtgatctggctgctgatgttacggattatatcttacttgagacgttcagagcctcttatccgtcagtgaagggtgcaaaggttgttattgacagagtcactggacgtacaaaaggatatgggtttgttaggttttctgatgaaagtgaacagatccgtgctatgacggagatgaatggcgttccttgttctactagacctatgagaattggtcccgctgctagcaagaaaggtgtaactggtcaaagagattcataccagagctctgctgcaggggtaacaactgataatgatccaaataacacaactgtttttgttggtggattagatgcatctgtcacggatgatcatctgaagaatgtctttagccaatatggtgagattgtgcatgtgaaaatacccgctggaaagcgctgtggattcgttcagttttccgagaagagctgtgcagaggaagctcttagaatgctgaatggagtgcaattaggcggaacaaccgtcaggctctcatggggccgaagtccttcgaacaaacagtcgggggatccgagccagttttactacggtgggtatggacaaggacaggagcagtatgggtacacgatgcctcaagaccctaatgcatattacggaggctactctggtggaggatacagcggtggttaccagcagacaccacaggcaggacagcaaccaccacaacagccaccacagcagcaacaagtcgggtttagctactaaccccgagagtattgcttgagttaatgtcactctgcttgttgtttgcgtactttgttatgaacttgtttctgcgtgccttgttatgaatattttcccaaacacagtttatttgtctttgcttttctctaggtgtgtgttgagtttttaactcttaataatgtttctgcgatgcttctgtttttaatgttttcatcacctttt

SEQ ID NO: 1690 - protein, 405 aa, Arabidopsis thaliana
  G2783,ACBF-like domain coordinates 63-124,151-235,262-318
MMQQPPPGGILPHHAPPPSAQQQYGYQQPYGIAGAAPPPPQMWNPQAAAPPSVQPTTADEIRTLWIGDLQYWMDENFLYGCFAHTGEMVSAKVIRNKQTGQVEGYGFIEFASHAAAERVLQTFNNAPIPSFPDQLFRLNWASLSSGDKRDDSPDYTIFVGDLAADVTDYILLETFRASYPSVKGAKVVIDRVTGRTKGYGFVRFSDESEQIRAMTEMNGVPCSTRPMRIGPAASKKGVTGQRDSYQSSAAGVTTDNDPNNTTVFVGGLDASVTDDHLKNVFSQYGEIVHVKIPAGKRCGFVQFSEKSCAEEALRMLNGVQLGGTTVRLSWGRSPSNKQSGDPSQFYYGGYGQGQEQYGYTMPQDPNAYYGGYSGGGYSGGYQQTPQAGQQPPQQPPQQQQVGFSY

SEQ ID NO: 1691 - DNA, 1366 bp, Arabidopsis thaliana
  G2784,family:DBP
caaaaacaaaaaaaaacaatggaactatcattagcattaacatcaacagaccataatccatcgccttcagaggcacatccagatactatggactttctgtctcgagaatggtgtaatttcgctgttcaatcacttcatccagaccctatcctctacgatcgttccattgttcccgtcgagacatcgatcgccaagtttcaaggcgactcaagtcctgtttcttgtgctatgatggatacgagcatgaagatggacgatccagattttaagccctcgatgccttcatggaaaaccaatgatgtgaagtcatggatatggatgcaacaagcaatgcacccggaattgagctacgaaggctttttccgcaagaaacttaaacttccatggaaaattacgccgtcgataaagaaatggtggaaagagataaaggcgaaacgaaaggaagaagtgaggctacagagagctgaagtccacgccgccgtgtcattggctggtcttgccgctgctctcgccgccgtggcttcagagaacgctggaaaagatggtggaaacggtcgacctagcacgagggagactgctgtggcttctgctgcggctgtggtggcggcacaatgtgcgcaaatggcagagacaatgggagcaaacagagaccagctcagcacgatgattggttcagccatgaccgggacaagtgttagtgagatactcactctcactgcctcagctacaacttcgttgagaggtgccgcgacgctgaaagcaagaagaggttgcaagattaatagattgaatggctctgcacctgtgttgcctattgaagactcttcttatttgcctcctgaattcgataagaacacatctgttcttgctaagggaacagatctcttcgtcgagacaccagatggggatttcaaggctaggacggtttctatggtcttaaacaaagatggaaaggtgattcttaaaatgaagaaacataatctactcaggactaagaaagaaagtattgtgacgaatgttcatgtggaactttacaaagattcagatagcgaagacaacaacatagaggacacttgttatctcattgtcctgaggacgaacagaggagctatcaagttagacatggccgacgattacaatcgttacaagacatgggtcacaacgatccaacacatgctcactctctcttcttcctccttaagtacaaattacgctctcactttctacaacaaaaactaaaaaaattcatcgccttgttcatcgtttttctctgtgtaattttactttatcccctcctctgttttcttatgtctctctcgcttgatcttataatgtaatgcataaacaacttgagaacttacgttct

SEQ ID NO: 1692 - protein, 406 aa, Arabidopsis thaliana
  G2784,DBP domain coordinates 139-260
MELSLALTSTDHNPSPSEAHPDTMDFLSREWCNFAVQSLHPDPILYDRSIVPVETSIAKFQGDSSPVSCAMMDTSMKMDDPDFKPSMPSWKTNDVKSWIWMQQAMHPELSYEGFFRKKLKLPWKITPSIKKWWKEIKAKRKEEVRLQRAEVHAAVSLAGLAAALAAVASENAGKDGGNGRPSTRETAVASAAAVVAAQCAQMAETMGANRDQLSTMIGSAMTGTSVSEILTLTASATTSLRGAATLKARRGCKINRLNGSAPVLPIEDSSYLPPEFDKNTSVLAKGTDLFVETPDGDFKARTVSMVLNKDGKVILKMKKHNLLRTKKESIVTNVHVELYKDSDSEDNNIEDTCYLIVLRTNRGAIKLDMADDYNRYKTWVTTIQHMLTLSSSSLSTNYALTFYNKN

SEQ ID NO: 1693 - DNA, 1040 bp, Arabidopsis thaliana
  G2789,family:AT-hook
ctttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaacgcggcc

SEQ ID NO: 1694 - protein, 265 aa, Arabidopsis thaliana
  G2789,At-hook amino acids 59-67,2nd cons. domain 67-208,DUF296 86-201
MDEVSRSHTPQFLSSDHQHYHHQNAGRQKRGREEEGVEPNNIGEDLATFPSGEENIKKRRPRGRPAGSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEEEEETEREIDGNAARAIGTQTQKQLMQDATSFIGSPSNLINSVSLPGEAYWGTQRPSF

SEQ ID NO: 1695 - DNA, 1128 bp, Arabidopsis thaliana
  G2790,family:HLH/MYC
actttctctttgttttctttctaacctctttccacgaaaagtcacgatgggagataccgcagaggatcaggacgaccgagctatgatggaagctgaaggagtaacgagcttctccgaacttcttatgttctctgacggcgttctcagctcctcttccgaccaccaacctgagggtaatgtcggcgatggtggagaagacagtttaggttttgtattctccggcaaaactggctcaagaatgctctgttttagtggaggctatcaaaacgacgacgagtcactcttcctagaaccttctgttccaacctccggagtctctgatcttgacccttcatgcattaagattgattgcaggaactcaaacgacgcgtgtacggtcgataaatctactaaatcatcaaccaagaagagaaccggaacgggtaatgggcaagagtcggatcaaaatcgaaaaccgggcaagaaagggaaacgaaatcaagagaaatcatcagttggaattgcaaaggtcaggaaagaaaggttaggggaaagaattgcagcgttgcagcagttggtttctccatacggcaagacagatgcagcttctgtgttgcatgaagcgatgggttacatcaaattcttacaagatcagattcaagtcctttgctctccttatctaatcaaccattctcttgacggtggagttgtcaccggagatgtaatggcggcgatgaaagcgaaagacttgagaagcagaggattatgtctagtacctgtctcatccaccgtacacgtggaaaattccaacggtgctgatttctggtcacctgctactatgggtcacactacgtcaccgtcgttacctcaaggattttaattaaacggtcgtaggctgatatatattagtagtattttagtagccttttttcttgggttttgtttttggctgaagaactattactagtaaatgttacacccagacatttttttgggattatctgggtggtataaaaaggttggaatcttttgtgtttgtaaaattagattgtctaagttttcttaaagtttctttgatgtcactgtcacagttgcgacgagtagtgatggtacttactgaaaggctaagcttattcacgctcttaaagt

SEQ ID NO: 1696 - protein, 270 aa, Arabidopsis thaliana
  G2790,HLH/MYC domain coordinates 141-198
MGDTAEDQDDRAMMEAEGVTSFSELLMFSDGVLSSSSDHQPEGNVGDGGEDSLGFVFSGKTGSRMLCFSGGYQNDDESLFLEPSVPTSGVSDLDPSCIKIDCRNSNDACTVDKSTKSSTKKRTGTGNGQESDQNRKPGKKGKRNQEKSSVGIAKVRKERLGERIAALQQLVSPYGKTDAASVLHEAMGYIKFLQDQIQVLCSPYLINHSLDGGVVTGDVMAAMKAKDLRSRGLCLVPVSSTVHVENSNGADFWSPATMGHTTSPSLPQGF

SEQ ID NO: 1697 - DNA, 1026 bp, Arabidopsis thaliana
  G2791,family:HLH/MYC
agaagaagagaagaagagatggaaaatggaaatggagaaggaaaaggagaattcataaaccaaaacaatgacttcttccttgattccatgtcaatgctctcctctctccctccttgttgggatccatctcttcctcctcctcctcctccgccacaatctcttttccacgctctagccgtcgacgcccccttccccgaccagttccatcatcctcaggagtcaggaggtccaacaatgggtagccaagaagggttacagccacaaggtacagtgtcgaccacgagcgcacctgttgttcgtcaaaagccaagagttcgagccaggagaggccaagccaccgatcctcacagtatcgctgagaggcttagaagggaacgcatcgcagagcgtatgaagtctctccaagaactggttcccaacaccaacaagacggataaggcatcaatgttggacgagatcatcgagtatgttaggttccttcagcttcaagtcaaagtactaagcatgagcagattgggaggtgcaggatcagttggtccacgcctcaatggtctctccgcagaggcaggaggacggctcaatgccctcactgcaccgtgcaatggcttaaatgggaatggaaacgctacaggatcgtccaatgagagcctaaggtcaacagaacaaagagtggcgaaactgatggaggaagacatgggatcagcaatgcaataccttcaagggaaggggctttgcttaatgccaatatctctcgcaaccgcgatatcatcatcaactactcactctcgtggatccctctttaaccccatctccagtgctgtagcagcagaggattcaaatgtaacagcaactgcagttgctgcacctgaagcctcgtctactatggatgatgtatctgcttccaaggcctgaaccatagaatactcatgtgtttcgttttctcagtttaagtcaaacgctaatctccctatctttttactattttctctgctaagcaacaataatataaaacagttgcaacaaaaa

SEQ ID NO: 1698 - protein, 297 aa, Arabidopsis thaliana
  G2791,HLH/MYC domain coordinates 102-159
MENGNGEGKGEFINQNNDFFLDSMSMLSSLPPCWDPSLPPPPPPPQSLFHALAVDAPFPDQFHHPQESGGPTMGSQEGLQPQGTVSTTSAPVVRQKPRVRARRGQATDPHSIAERLRRERIAERMKSLQELVPNTNKTDKASMLDEIIEYVRFLQLQVKVLSMSRLGGAGSVGPRLNGLSAEAGGRLNALTAPCNGLNGNGNATGSSNESLRSTEQRVAKLMEEDMGSAMQYLQGKGLCLMPISLATAISSSTTHSRGSLFNPISSAVAAEDSNVTATAVAAPEASSTMDDVSASKA

SEQ ID NO: 1699 - DNA, 1497 bp, Arabidopsis thaliana
  G2802,family:NAC
atgaacaagagtaatcctgctggttcggtgactggttcggatataatagacgccaagatcgaagaacatcaactttgtggatccaagaagtgtcctagctgcggccacaagctcgaaggcaaaccacaggattgggttggtttaccagcaggagtgaaatttgacccaacggatcaagaattgatagaacatttagaagcgaaagtgttagctaaagacttcaaatctcaccctctcattgacgaattcatcccaaccattgaaggcgaagacggcatttgctacactcatcccgagaaacttcctggagtgactagagatggtttaagccgacacttctttcatagaccatcaaaggcgtacacgacgggaacaagaaagcgaagaaagattcaaacagaatgtgacaataatttgcaaggaagtagtagctccggtgagacgaggtggcataagaccggtaagacaagaccggttatggtaaacggtaagcaaaaaggttgtaagaagattttggttttgtataccaattttggtaagaatcgaaaaccggagaaaaccaattgggtaatgcatcaatatcatttggggacacatgaggaagagaaagaaggagaacttgttgtgtctaagatcttttatcaaactcagcctaggcaatgcaactggtcgtcttctacatcgagcttgaacgctataggtggtggcggcggtgaagcgagtagcggcggaggcggcggagagtatcatatgaggagagatagtgggactactagtggtgggagttgttcttcgtctagagaaattattaatgttaatcctccgaatcgatccgatgaaataggcggcgttggtggtggcgttatggccgtagcagctgcggctgcggcggttgcagctgggcttccgagttatgcaatggatcagctcagctttgttccgtttatgaaaagctttgatgaggtggcgaggagggaaactcctcagactgggcacgctacatgtgaggatgtaatggcagaacaacatcgtcatcgtcatcaaccatcatcatcaacatcacatcatatggctcatgatcatcaccatcatcatcatcaacaacaacaacaacggcatcatgcattcaacataagccagcctacacatccgatatcaaccattatttctccatctacttcgcttcaccatgcctccattaatattcttgacgataatccttatcatgttcatagaatcttgctccccaatgaaaattaccagacacaacagcaactacgtcaagaaggagaagaagaacataatgatgggaagatgggaggaaggtcagcttccggattggaagaactcataatgggctgcacttcttctaccactcatcatgatgtaaaagatgggtcatcatcaatggggaaccaacaagaagcagaatggttgaagtactcaacgttttggccagcccctgactcttctgacaaccaagatcatcatgggtaa

SEQ ID NO: 1700 - protein, 498 aa, Arabidopsis thaliana
  G2802,NAC domain coordinates 48-196
MNKSNPAGSVTGSDIIDAKIEEHQLCGSKKCPSCGHKLEGKPQDWVGLPAGVKFDPTDQELIEHLEAKVLAKDFKSHPLIDEFIPTIEGEDGICYTHPEKLPGVTRDGLSRHFFHRPSKAYTTGTRKRRKIQTECDNNLQGSSSSGETRWHKTGKTRPVMVNGKQKGCKKILVLYTNFGKNRKPEKTNWVMHQYHLGTHEEEKEGELVVSKIFYQTQPRQCNWSSSTSSLNAIGGGGGEASSGGGGGEYHMRRDSGTTSGGSCSSSREIINVNPPNRSDEIGGVGGGVMAVAAAAAAVAAGLPSYAMDQLSFVPFMKSFDEVARRETPQTGHATCEDVMAEQHRHRHQPSSSTSHHMAHDHHHHHHQQQQQRHHAFNISQPTHPISTIISPSTSLHHASINILDDNPYHVHRILLPNENYQTQQQLRQEGEEEHNDGKMGGRSASGLEELIMGCTSSTTHHDVKDGSSSMGNQQEAEWLKYSTFWPAPDSSDNQDHHG

SEQ ID NO: 1701 - DNA, 528 bp, Arabidopsis thaliana
  G2805,family:NAC
atgatgaagtcaagacgtgaacaatcaatcgaagaagcaatcgtcgcaaattatttgaagatgatgatcgataacgtaaacgtttggcctcgccacttcctccgaagcgaagacgtgtactgcaagaatccgtggacgcttttcgttactagagatcctataatcctacacttcggacgatacttcttcgttaatcggagtgtgaattcaggtttaaccgatggatgtgaatacggttgttggagaatcatcggtcgtgatagagtgatcaagtcggtgacgaccgggaagattctagggttaaagaaggtttataagttctgtgaaactgatcggaaaccgaaatcggtttttaagttcttggaaaaggagaagagaagagtaagagatagacgaatctgggcgatggaagagtataggtttgcaagtacgtggaaacaagattacgtgatctgcaagattcgacgtctgtatccacaaccatttgactacatgttggcccagcacattcgaggttactataaatga

SEQ ID NO: 1702 - protein, 175 aa, Arabidopsis thaliana
  G2805,NAC domain coordinates 2-169
MMKSRREQSIEEAIVANYLKMMIDNVNVWPRHFLRSEDVYCKNPWTLFVTRDPIILHFGRYFFVNRSVNSGLTDGCEYGCWRIIGRDRVIKSVTTGKILGLKKVYKFCETDRKPKSVFKFLEKEKRRVRDRRIWAMEEYRFASTWKQDYVICKIRRLYPQPFDYMLAQHIRGYYK

SEQ ID NO: 1703 - DNA, 735 bp, Arabidopsis thaliana
  G2826,family:Z-C2H2
atggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattga

SEQ ID NO: 1704 - protein, 244 aa, Arabidopsis thaliana
  G2826,Z-C2H2 domain coordinates 75-95
MEELDFSSKTTTSRLKLFGFSVDGEEDFSDQSVKTNLSSVSPERGEFPAGSSGRSGGGVRSRGGGGGGGERKYECQYCCREFGNSQALGGHQNAHKKERQQLKRAQLQATRNAAANFSNAGSASQFLRNPIVSAFAPPPHLLSSSAVPQPMGGPWMYLPRVSPSQLHVSHGCVIQDGSGGAGAGGFSYEYGARDSGFGVVGAQMRHVQAHGPRPSVNGFSREVGTTFDDGLGLDLHLSLAPAGH

SEQ ID NO: 1705 - DNA, 1111 bp, Arabidopsis thaliana
  G2830,family:Z-C2H2
gccaggatttgaaattaactaaataacaaatatattgactttgaattcatgaatttcaatatattaccttttttgcacttcaaaaatatataaaaggatacatagggaaataatttagatacacttagagctacaaaatgtcttccatcccaaataggttcaatatttatggtggtgataccacaaaccatcgtgaatcgcttcccatcgaaatgaatcacaactctcgaatggttcgatccatgttcattacatctgatcgcatgaatcatagagatttgttttcttctcctccttctttctcttcttatcaaaattcacatatctcttcatcttctgttgggtttaataattcacatatgacttatcatatgctgaaaagaaattatgattctgtttcccgtgctgattatttctctactaaagatcattctcattttactcaagtatctttcactcaaaccatcacaaataagtatactactattgttccttccaatatatttgacactgttcactatgatattggtcgtgtcaaacgtgccatagattttagaaatatttggaatcctaaatctcatcttccaaaaaaatttaataggcaatgcgagattttgaatcctacccctcttaatatcgtctttccgcaccaggattcagctgatcgtcaacatttagacattattttctcgtcatcaaagcacaaccatgttttccaagatggtcgatccttgaagaaaatttccgaaccaaccaatctgtttgaaaaatctaattcttatgattctcaagaagatgagaaaatcgatgcttatcaatatgatggtcgtacacatagtctaccgtatacgaaatacggtccatatacatgtcccaggtgtaacggtgtgtttgatacttctcaaaaatttgctgcacatatgttatctcactacaataatgagacggacaaagaaagagaccaaagatttcgtgcaagaaataaaaaacgatatcgtaagtttatggacagtcttaaaatatcaaaacagaagatatgatccgtcgcgatgggacgatccgcggccgccggtggtgaggcagatttcagcgtgctggggcgatcgcggcc

SEQ ID NO: 1706 - protein, 300 aa, Arabidopsis thaliana
  G2830,Z-C2H2 domain coordinates 245-266
MSSIPNRFNIYGGDTTNHRESLPIEMNHNSRMVRSMFITSDRMNHRDLFSSPPSFSSYQNSHISSSSVGFNNSHMTYHMLKRNYDSVSRADYFSTKDHSHFTQVSFTQTITNKYTTIVPSNIFDTVHYDIGRVKRAIDFRNIWNPKSHLPKKFNRQCEILNPTPLNIVFPHQDSADRQHLDIIFSSSKHNHVFQDGRSLKKISEPTNLFEKSNSYDSQEDEKIDAYQYDGRTHSLPYTKYGPYTCPRCNGVFDTSQKFAAHMLSHYNNETDKERDQRFRARNKKRYRKFMDSLKISKQKI

SEQ ID NO: 1707 - DNA, 1367 bp, Arabidopsis thaliana
  G2832,family:Z-C2H2
ttttgtcggtttatgcagcactcgtcttcattcatagattttgatttgaggtaaactaaactcatcagatattaaaaatgggttctttacttctttcgatttcgtgtgtaaaggagaaacctttattgattctttcttgcttgtttgctgtttgatcatttgtctaagagaagaaggtcaaattttcaaatggaggaagggaaagagaattcgtttttgtgcaagtactgttacaagacgtttccttctgggaaagcactcggtggtcacattagaattcatacgaacgagaattcagttggttacaatggcaataagaagaagaggttggtggatcagagaaagatgatggctcagaaacataagcaacaacaacaagttggttgcagagaatgtggtagagtgttcgtttctttgaaagctcttagaggtcacatggcttgtcacggtgaggtaaagaagatgttgatggatgataatagccaatctgatactgaaagtgagacttcctcagctcctatgaggaaaagatccaagagggtggtcatgaaacaatcaaattctgaatctttgagtaatgggagctcgtcttttggttctgagattgaccaagaacgtagggatggggcttataatttgatgatgttgtcgagtgattctagtagtttcaagaaaagacgtaacatggtgatgaattctcttggtgagtcatctgacaacaactctgcgattgttgagaataagtcatcttcaggggatgagtttaagatcatgaatgtgaagaatgcagtagatgaccaatggagatctgctgatgatgatggagttagtctctgtgattcagatggctctgattctgattacttcatgaatggtccaagtaagtcggagtcagacatttctgttgacaggaacactggatttggatctggattcaacaactcattgatcaggttcaggaatagtaatgagggaggaacaaagtatgagctgagcaaaagcaagagagccttgttttcttatgaaactgattcatgtgcagacacaaacagcaagattcatcataggttcaaagatagcaaatcctcaatggttaagaaagaaggtggtgagaaggtgaagagcaaaggtcatgagtgcccaatttgcttcaggatgttcaaatcaggccaagctttaggtggtcacaagagatcacattccattgcaaaccacgcagctgaaatgcgtaaccaaatcgatctctatcttcctgtttcggatactgatgaatgaatcagaacctgagaactatagttctctctgatagtatttcatccccactttttgtttgttttctttgctccacattttagaactagatgaaa

SEQ ID NO: 1708 - protein, 361 aa, Arabidopsis thaliana
  G2832,Z-C2H2 domain coordinates 11-31,66-86,317-337
MEEGKENSFLCKYCYKTFPSGKALGGHIRIHTNENSVGYNGNKKKRLVDQRKMMAQKHKQQQQVGCRECGRVFVSLKALRGHMACHGEVKKMLMDDNSQSDTESETSSAPMRKRSKRVVMKQSNSESLSNGSSSFGSEIDQERRDGAYNLMMLSSDSSSFKKRRNMVMNSLGESSDNNSAIVENKSSSGDEFKIMNVKNAVDDQWRSADDDGVSLCDSDGSDSDYFMNGPSKSESDISVDRNTGFGSGFNNSLIRFRNSNEGGTKYELSKSKRALFSYETDSCADTNSKIHHRFKDSKSSMVKKEGGEKVKSKGHECPICFRMFKSGQALGGHKRSHSIANHAAEMRNQIDLYLPVSDTDE

SEQ ID NO: 1709 - DNA, 1986 bp, Arabidopsis thaliana
  G2834,family:Z-C2H2
ccattggtgctctccaagttccatctcaagcttttcttcttgtgggtgattcaatctctctctttctattttttttttcatttctgttgatttagtgatctttgatttgtgaaactttgtttttatcgtgtttgtttttgatttagggttttattttgttgtcggcgagttttgatttgatgattttgatgatttttttttgtttgaccgtttggtttttggatcttaagagttatgtgtgaagatttttttttgtttgtttgggtgaagaatttgtgttgatttcgataattttgagtttgattttgaatcttagtaatgaaatttgattctgtgaagtgtgtatgatgaactttgagctggtcctaattctgattctgataaagatttgatttttatggtttcttttgtaggttttgttgttctcttaattgaaaaacaagatcttgaactaaaaaatggaaactgaagacgatttgtgcaacaccaattggggaagctcttcttcgaaatcgcgagagccgggttcatcagactgtgggaattcgacattcgcaggttttacgtcccagcagaagtgggaagatgcttcaatcttggattatgagatgggtgtggagcctggattgcaagagagcattcaagcaaatgttgatttcttacaaggtgttagggctcaagcgtgggatccaaggacgatgttgagtaacctttcttttatggagcagaagattcaccagctgcaggatcttgttcatcttcttgttggtcgtggtgggcagcttcaaggtcgtcaagacgagctcgcggctcagcagcagcagcttataacgacggatcttacttccattatcatacagcttatttcaactgcaggtagtcttcttccatctgttaagcataatatgtcaacagctccgggtccattcactgggcagcccggttcagccgtgttcccttatgtaagggaggctaataacgttgcttcacagagtcagaacaataacaactgtggtgctcgagagttcgatttgcctaagccggttcttgttgatgagagggaaggtcatgttgtggaggaacatgagatgaaagatgaagatgatgtggaagaaggagagaaccttcctcccggttcgtatgagatattgcagcttgagaaagaagagattctcgcaccgcatactcacttctgcacgatatgtggcaagggtttcaagagagacgcgaatttgaggatgcatatgagagggcatggagatgagtacaaaacagcagctgctctggcgaaaccgaacaaagaatccgtacccgggtctgagccgatgctgatcaagaggtactcgtgcccattccttggttgcaaacgtaacaaggagcacaaaaagttccagcctttgaaaacgattctatgcgtgaagaatcactataaacgcacccactgcgataaaagcttcacttgcagccggtgccataccaagaaattctctgtcattgcagatcttaaaacccacgagaagcactgcgggaaaaacaagtggctttgttcctgtggtacaacattttcaaggaaagacaagttgtttggtcacatagctctgttccagggacacacgcctgcaatccctcttgaagagacaaaaccatcagccagtacatctactcagagagggagctctgaaggcgggaacaacaaccaaggaatggttggcttcaatcttggttctgcatcaaatgctaaccaagaaaccacacagcctggaatgactgatgggaggatatgttttgaggagtcgttctcaccaatgaactttgatacatgtaattttggagggttccacgagtttccgcgactgatgtttgatgattcagagagttcttttcaaatgcttattgcgaatgcctgtggtttctcgcccaggaatgttggtgagtctgtttcagatactagtctctaaggcattgccatatatatgataagttatg

SEQ ID NO: 1710 - protein, 499 aa, Arabidopsis thaliana
  G2834,Z-C2H2 domain coordinates 246-266,335-356
METEDDLCNTNWGSSSSKSREPGSSDCGNSTFAGFTSQQKWEDASILDYEMGVEPGLQESIQANVDFLQGVRAQAWDPRTMLSNLSFMEQKIHQLQDLVHLLVGRGGQLQGRQDELAAQQQQLITTDLTSIIIQLISTAGSLLPSVKHNMSTAPGPFTGQPGSAVFPYVREANNVASQSQNNNNCGAREFDLPKPVLVDEREGHVVEEHEMKDEDDVEEGENLPPGSYEILQLEKEEILAPHTHFCTICGKGFKRDANLRMHMRGHGDEYKTAAALAKPNKESVPGSEPMLIKRYSCPFLGCKRNKEHKKFQPLKTILCVKNHYKRTHCDKSFTCSRCHTKKFSVIADLKTHEKHCGKNKWLCSCGTTFSRKDKLFGHIALFQGHTPAIPLEETKPSASTSTQRGSSEGGNNNQGMVGFNLGSASNANQETTQPGMTDGRICFEESFSPMNFDTCNFGGFHEFPRLMFDDSESSFQMLIANACGFSPRNVGESVSDTSL

SEQ ID NO: 1711 - DNA, 1000 bp, Arabidopsis thaliana
  G2837,family:Z-C2H2
catggttcagagaaaactttatataagggctaattcaatgtcgttttgaaacatcaatccctagactaaagtgcgaaaatagtatgagtaatccgaacccagagaaaacgaaagtggatgttactgaggaagagaaagaggaatctgatgagcaatggagcgatgaagaaaccaatatgagagaaattgttctcggcctccctgctttgaatatcagcagtagaatatttggagagagtagtagtgtcgttgaggaagatgcagaaaaagcgcgtttgaatgagcaagcggttcttgcggcggggttgattttggctgcggcagaggaagcggttatgaaaggaatgaatgagggaagtgggagtggtgggaagaaaaagagtagaccaaggatatctacgcaaaccgatgacgaaggggatggtttgggtgaaggagaagcgaaaaagccgaagaagaaagcaaaggaattgactcatccaccgaaaggaccaccggtttgtcatatctgtggaagaggtttcggttcgtggaaggcagtgtttgggcatatgagggctcatagagatagaaactatcaagggtttcttcctcctcctacattctctgcgggggctgaaaggtttgtgattcccgggctaagatctgcttttactattgccactgtcggaggaggaagttctggtggtgtagcggtaggaggaagaagttccggtgatttttctggcagtggtggtggtgatgcgccaggatctgaaggtgggagaggttcaggtattgatttgaatgtggaacctgtggagcaagtagaggaagcgactgaatctggatgtattgccaagttcgatcttaataaatctccaccaaaagatgaagaggaagaggacaaacccaagtgaaagattttttcatactatttaataatttactataacacatagtatagttattattttcatatttcatatttgatatatttatctaacacattatgttgatt

SEQ ID NO: 1712 - protein, 271 aa, Arabidopsis thaliana
  G2837,Z-C2H2 domain coordinates 140-160
MSNPNPEKTKVDVTEEEKEESDEQWSDEETNMREIVLGLPALNISSRIFGESSSVVEEDAEKARLNEQAVLAAGLILAAAEEAVMKGMNEGSGSGGKKKSRPRISTQTDDEGDGLGEGEAKKPKKKAKELTHPPKGPPVCHICGRGFGSWKAVFGHMRAHRDRNYQGFLPPPTFSAGAERFVIPGLRSAFTIATVGGGSSGGVAVGGRSSGDFSGSGGGDAPGSEGGRGSGIDLNVEPVEQVEEATESGCIAKFDLNKSPPKDEEEEDKPK

SEQ ID NO: 1713 - DNA, 998 bp, Arabidopsis thaliana
  G2838,family:Z-C2H2
cgggaattaaatgcaagaaacatagaggagaccgtacttcgaagttgcaaatttaacactaagttgaagaatctagaaatagaaagccaaaatcttcctttacttcaactctacaatttcaatcttttctctgtacttagccatccagagtcataaccaccactatattaaaatgaagacttatgatttcatgaacgtcaactctttctctcctaaggaaagacccattcgcctctttggcttcgagtttggagcttctcatgaagaatctgagtccaaagacaattacaacgagaacaatgaaagcatcaaagacgataacaaagaaaaaagattcaagtgccactattgtttccggaacttccctacttcacaagccctaggcggccatcaaaacgctcacaagagagaacgtcaacaaactaaacgcttcaacctccattcaaacgcagccgctttcttccaccgccaacaaaaccacattgctgcttctaggctctacgaggatcgctatagccttgaagctgttcaaatcaacgacgcgagattagggttatgtcgtatgtataactcatctgcgagttttaatcgtgaccgttcatcttattataatagatatattccttggttcatcggtgatcaccagactagaccaacgtatgtcggtggtggtagcagcagccatggtctgttttacgagtccaagaagaatgtaccggaccacgtgagtttggatctacgcctctagttccattcttttagtatctctctctagctagttcttaaaaaaaaaaaaagagagactagttttttttccttctttcaaatactttttattttattttagtctacttgattaattatgaatttatgatagtgtatccccgtagatatcatgttatattaacagttaaacaattttatggagatgaactttaacttcagatagtttctttctgagatttaaagtcttaaatattatcgacgcattccaatct

SEQ ID NO: 1714 - protein, 191 aa, Arabidopsis thaliana
  G2838,Z-C2H2 domain coordinates 57-77
MKTYDFMNVNSFSPKERPIRLFGFEFGASHEESESKDNYNENNESIKDDNKEKRFKCHYCFRNFPTSQALGGHQNAHKRERQQTKRFNLHSNAAAFFHRQQNHIAASRLYEDRYSLEAVQINDARLGLCRMYNSSASFNRDRSSYYNRYIPWFIGDHQTRPTYVGGGSSSHGLFYESKKNVPDHVSLDLRL

SEQ ID NO: 1715 - DNA, 495 bp, Arabidopsis thaliana
  G2839,family:Z-C2H2
atggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttcttga

SEQ ID NO: 1716 - protein, 164 aa, Arabidopsis thaliana
  G2839,Z-C2H2 domain coordinates 34-60,85-113
MVARSEEVEIVEDTAAKCLMLLSRVGECGGGGEKRVFRCKTCLKEFSSFQALGGHRASHKKLINSSDPSLLGSLSNKKTKTATSHPCPICGVEFPMGQALGGHMRRHRSEKASPGTLVTRSFLPETTTVTTLKKSSSGKRVACLDLDSMESLVNWKLELGRTIS

SEQ ID NO: 1717 - DNA, 1274 bp, Arabidopsis thaliana
  G2846,family:HLH/MYC
tcgacccttcgtatagcaacgatctagtagaaagcttatactaaaactttctgattctcttaatatggcggaggagtttaaagctacggcatcgatttgtggtggcggaggtggcgcgtggtggaactcgccaaggagcgttatgtctccttcggatcatttcttgtcaccatgcttcggagcggctatcacttccaatgattttagctcgcaagagaatcatctcaaatctaggatgacttgtacggacaacaacaacatcgttttcgggcagcgagaggcggattctgacagtggaggaagtaccgtgacgatggactcgacgttgcagatgatgggtctagggttttcctcaaattgttcttcagattggaaccaaaccattttacaagaagacttaaactcaagcttcataaggagctcacaagatcaagatcatggccaaggattcttatccacaactacttcaccttatatacttaatccagcttgttcttcatctccatcaacttcttcgtcctcaagcttgatacgaaccttttacgatcccgaaccaagtccatacaactttgtctccaccacaagtggttcaatcaacgatcctcaactttcttgggctaataagacaaatcctcatcatcaagtagcttatggactaattaacagcttctctaacaacgcaaactctcgacccttttggaattcttcatcaaccactaacttaaacaacacgacgccgagcaattttgtaaccactccgcagataatatctactcgtttggaggacaaaaccaagaatctgaagacaagagctcagagtgagtctttgaagagagcaaaggataatgaatctgcggcgaagaaaccgagagtcaccacgccttcaccgttgccaactttcaaggtgagaaaagagaatctaagggaccagataacttcattacaacaactagtttcacctttcggaaagacagatactgcatctgttctccaagaagctatagagtacatcaagttccttcacgaccaagtcactgttctaagcactccatacatgaaacaaggtgcctcgaaccaacaacaacagcagatatctggtaaatcgaagagtcaagatgaaaatgagaatcacgaactaagaggacatggtctatgtctcgtcccaatatcaagcacgtttccggtggctaacgaaacaacagccgatttttggacaccaacgtttgggggcaacaatttcaggtgattaaagagagagggttgtggttgtcaag

SEQ ID NO: 1718 - protein, 393 aa, Arabidopsis thaliana
  G2846,HLH/MYC domain coordinates 267-324
MAEEFKATASICGGGGGAWWNSPRSVMSPSDHFLSPCFGAAITSNDFSSQENHLKSRMTCTDNNNIVFGQREADSDSGGSTVTMDSTLQMMGLGFSSNCSSDWNQTILQEDLNSSFIRSSQDQDHGQGFLSTTTSPYILNPACSSSPSTSSSSSLIRTFYDPEPSPYNFVSTTSGSINDPQLSWANKTNPHHQVAYGLINSFSNNANSRPFWNSSSTTNLNNTTPSNFVTTPQIISTRLEDKTKNLKTRAQSESLKRAKDNESAAKKPRVTTPSPLPTFKVRKENLRDQITSLQQLVSPFGKTDTASVLQEAIEYIKFLHDQVTVLSTPYMKQGASNQQQQQISGKSKSQDENENHELRGHGLCLVPISSTFPVANETTADFWTPTFGGNNFR

SEQ ID NO: 1719 - DNA, 1541 bp, Arabidopsis thaliana
  G2847,family:HLH/MYC
agcagtggtaacaacgcagagtacgcggggatcgattgctcaatttgtttgtctctctcttcttctttccttttctccaaaaactagagcctaaactaaagcatcgagaaacaacaaatcttaaaatcttttcatattctcggttagtagaaactaggaaaagagatgaatagaggagtgttggagagttcgccggttcaacatctcacggcggctggaaaccctaattggtggaataatgtcagccgcggcttgaggccaccaacgccgttgatgagtcacgagccgccgtctaccaccgcttttattccaagtctcttgccaaacttcttctcttctccgacttcctcttcatcttcttcaccttctttccctcctcctaatagtaaccctaacttctcttcttggcttgaaatgagtgatctgcctcttgatcagccatggagccttagtcaactcctcttgggtggattgatgatgggagaggaagagaaaatggagatgatgaaccatcatcatcatcaaaatcaacaccaaagttaccaagcgaagaggatacaaaattgggaagaacaagttttgaggcaccaagcttccatgaaacaagagagtagtaataataatagttatggaataatgtcctcaccaaactcacctccaaacaaatcttgtgctacaattatcaacaccaatgaagacaacaacaataacattcacagtggtcttaacttgtccgagtgtaatagctcagagatgattgggtcttcttttgctaataagaaaccaaaacttcaagttccttcatcacaatcaactctcaaggtgagaaaggagaaacttggaggcagaatagcatctcttcaccagctagtatctccctttggcaagactgacacagcctctgtcttgtcggaggctattggatacattagattcctccacagtcaaattgaggctttaagtctaccatactttggtactccctcgaggaacaatatgatgcaccaacatgcacaaagaaatatgaatggtatatttcctgaggaccctggtcagcttgtgaatgagtattgcatgaaaagaggagtttcattgtcatcgacggacaatcaaaaatcaaatcctaacgaagaaccgatgaaagatttgagaagtagagggctttgtcttgttcccatctcatgcacactacaagttggcagcgacaatggtgccgactattgggctccggcgttcggaaccactctccagtgaactattcactttctgttattttatttttggtcagccaaaaaaaaatagtagatgttataacatcatgagcaaccaatcaattgagaaaacatcaaaatgagtttccaaatttgattgctcatgatgctatactaaaaccgattggttttggcgtttggcctttgagcattttcagttgacgagtatgagatggcttgttgaatcatgtttttcttactttaataggaaactttatttattctcttaatgtatatgttggttctattttaattttattattgttataa

SEQ ID NO: 1720 - protein, 362 aa, Arabidopsis thaliana
  G2847,HLH/MYC domain coordinates 206-263
MNRGVLESSPVQHLTAAGNPNWWNNVSRGLRPPTPLMSHEPPSTTAFIPSLLPNFFSSPTSSSSSSPSFPPPNSNPNFSSWLEMSDLPLDQPWSLSQLLLGGLMMGEEEKMEMMNHHHHQNQHQSYQAKRIQNWEEQVLRHQASMKQESSNNNSYGIMSSPNSPPNKSCATIINTNEDNNNNIHSGLNLSECNSSEMIGSSFANKKPKLQVPSSQSTLKVRKEKLGGRIASLHQLVSPFGKTDTASVLSEAIGYIRFLHSQIEALSLPYFGTPSRNNMMHQHAQRNMNGIFPEDPGQLVNEYCMKRGVSLSSTDNQKSNPNEEPMKDLRSRGLCLVPISCTLQVGSDNGADYWAPAFGTTLQ

SEQ ID NO: 1721 - DNA, 1872 bp, Arabidopsis thaliana
  G2850,family:HLH/MYC
tcttaatctcttgggatttgtaagagaaactcttcaaaaatcatcattctttttcatctttctttacacacaaacacacatacacacacatatataatacagagatcaggtataataaatacttatatatatagcatcatcaactctcatacatatatggactctgctaatctccatcagcttcaagatcaattacagcttgtggggtcttcttcatcttcttcttccttagacaataactctgacccttcttgctatggagcttcatctgcccatcaatggagcccaggaggtatttctttgaatagtgtgagcttgagtcataattataacaatgagatgttaaacacaagagctcacaacaacaacaacaacaacaacacaagtgaatgtatgagtctctccagcatccacaatcactccttgatccaacaacaagactttcctttacaatggcctcatgaccaatcttcatatcaacatcatgaaggacttctcaagatcaaagaagagctttcctcatcaactatctcagaccatcaagaaggcatatccaagttcacagacatgttaaatagtccagtgataacaaactatttgaagatcaatgaacataaggactacactgagaagcttcttctcaagagtatgtcttctggattcccgatcaatggagactatggtagcagccttccctcttcttcttcttcctcttcaccttcgtctcagtcgcatagaggcaacttcagtcagatttacccaagcgtaaacatatcgagtttgagcgaatctcggaagatgagcatggacgacatgagtaacatctcaagaccatttgatataaacatgcaggtttttgatggaagattgtttgaaggaaatgtattagttcctccttttaacgctcaagagattagtagtcttgggatgagcagaggaagccttccttcttttggcctcccttttcatcatcatctgcagcaaacacttccccacctttcttcttcccctactcatcaaatggaaatgttcagcaatgaacctcaaacaagtgaagggaagaggcataacttcttgatggcaacaaaagcaggagaaaatgcttccaagaaaccgcgcgtggaatcacgctcctcttgcccacccttcaaggtgaggaaagaaaagttaggagacagaatagcagctctgcagcagttggtttcaccctttgggaagacagatacagcatctgtgttaatggaagcaattggatacatcaaattcctacagagccagatcgagactttaagcgtcccctacatgagagcatctaggaaccgacccggaaaagcctcccagctggtctcacaatcacaagaaggggatgaggaagagacgagagatcttagaagccgtgggctatgtctagtgccgttatcatgcatgacttatgttaccggagatggtggggatggaggaggcggtgttggtactggtttttggccaacgccacctggttttggtggcggaacttagccgtggacttaacaaaccgtaggactatgatgagtacatttatcggacttggaggtagagaataagaagaaatgttaaaggtggagtattagttctttaatctcttttggttttggtttattaattgaaattttcggttttgatagtggagcaaagttggtcgtcctgattagaaagaagtgttacaggatagaccagctttgatccatttaagattagtagtgagacttgacgatatgtttctacttacatgatgggctgtgggggctacataaaatatcaaatagctttggattattttgttaaatctcttttgtagataatgtgtcaatatctttaataaatgtattcctt

SEQ ID NO: 1722 - protein, 453 aa, Arabidopsis thaliana
  G2850,HLH/MYC domain coordinates 320-376
MDSANLHQLQDQLQLVGSSSSSSSLDNNSDPSCYGASSAHQWSPGGISLNSVSLSHNYNNEMLNTRAHNNNNNNNTSECMSLSSIHNHSLIQQQDFPLQWPHDQSSYQHHEGLLKIKEELSSSTISDHQEGISKFTDMLNSPVITNYLKINEHKDYTEKLLLKSMSSGFPINGDYGSSLPSSSSSSSPSSQSHRGNFSQIYPSVNISSLSESRKMSMDDMSNISRPFDINMQVFDGRLFEGNVLVPPFNAQEISSLGMSRGSLPSFGLPFHHHLQQTLPHLSSSPTHQMEMFSNEPQTSEGKRHNFLMATKAGENASKKPRVESRSSCPPFKVRKEKLGDRIAALQQLVSPFGKTDTASVLMEAIGYIKFLQSQIETLSVPYMRASRNRPGKASQLVSQSQEGDEEETRDLRSRGLCLVPLSCMTYVTGDGGDGGGGVGTGFWPTPPGFGGGT

SEQ ID NO: 1723 - DNA, 1346 bp, Arabidopsis thaliana
  G2851,family:HLH/MYC
aaaggtgatgaatagaggtgtgttggagagttcgccggttcagcagctgatggcagccggaaaccctaattggtggaacgtaagcggcggcatgaggccaccaccaccgttgatgggtcatcagcaggcgccgttgccaccacatatgactcctaataacaattatctccgaccacggatgatgcccactcccttcccgcacttcttgccatctccggcgacttcttcttcttcctcttcttcttcaccgtctttgcctaataaccctaatctctcttcttggcttgaaagcaatgatctccctcctgagtcttggagccttagccaacttcttttgggtggattgatgatgggagaggaagagagattggagatgatgaaccatcataatcatcatgatgaacaacaacaccatggttttcaagggaagataagattggagaattgggaagaacaagtgttaagccaccaacaagcttccatggtggctgttgacatcaaacaagagggtaacattaacaacaacaatggctatgtcatatcttccccgaactcacctcctaacaaatcttgtgttacaacaactaccacaacaagcctcaatagtaacgacgataacatcaacaacaataataatatgttggatttctctagcaatcacaatggtcttcacttgtcagaagggagacacactcctccggatcgatcctctgagtgtaacagcttagagattggtgggtctactaataagaagccaaggctccaaccttctccttcgtcacaatcaaccctcaaggtgagaaaggagaaactaggaggccgaatcgcagcgcttcatcagctagtatctccatttggaaagactgacacagcctctgtcctgtcggaagctattggatacattagattccttcagagtcaaattgaggctctgagtcatccatactttggtacgactgcctcggggaatatgaggcaccaacaacatttgcaaggagataggagttgcatatttcctgaggaccctggtcagctcgtgaacgatcagtgcatgaagagaagaggagcttcgtcgtcatctacggacaatcaaaatgcaagtgaagagcctaagaaagatctgagaagtcgaggtttatgtcttgtcccaatctcatgcacactccaagtaggcagcgacaacggcgcggactattgggctccagcacttggctccgccggtttccattgagccaatgaaattacgccacgtggaattccagcgttagagaaaaatgatataacatcacgagcagtcagtctactgagaaaacaacaaattgagtttccaaggctgattgctcatg

SEQ ID NO: 1724 - protein, 407 aa, Arabidopsis thaliana
  G2851,HLH/MYC domain coordinates 250-307
MNRGVLESSPVQQLMAAGNPNWWNVSGGMRPPPPLMGHQQAPLPPHMTPNNNYLRPRMMPTPFPHFLPSPATSSSSSSSSPSLPNNPNLSSWLESNDLPPESWSLSQLLLGGLMMGEEERLEMMNHHNHHDEQQHHGFQGKIRLENWEEQVLSHQQASMVAVDIKQEGNINNNNGYVISSPNSPPNKSCVTTTTTTSLNSNDDNINNNNNMLDFSSNHNGLHLSEGRHTPPDRSSECNSLEIGGSTNKKPRLQPSPSSQSTLKVRKEKLGGRIAALHQLVSPFGKTDTASVLSEAIGYIRFLQSQIEALSHPYFGTTASGNMRHQQHLQGDRSCIFPEDPGQLVNDQCMKRRGASSSSTDNQNASEEPKKDLRSRGLCLVPISCTLQVGSDNGADYWAPALGSAGFH

SEQ ID NO: 1725 - DNA, 1569 bp, Arabidopsis thaliana
  G2854,family:ACBF-like
tctctcttttgcccttacgtcctcgagctcaaccctttaattgcatctacgacagtcgtaccttttgctaggttatcgtcgtcatgatgcagcagccacctccagcttccaacggtgctgcaacagggccagggcagattccttccgaccaacaagcttacctccagcagcagcagtcgtggatgatgcagcaccagcagcaacaacaaggtcagccgcctgcaggatggaatcagcagtctgcaccgtcttctggtcaaccacagcagcagcagtatggtggtggtggatctcagaatccaggatcagctggtgagatccggtccctgtggatcggtgacttgcagccatggatggatgagaactatctcatgaacgtctttggtcttactggcgaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccagcttcatatcagaacactcaaggaaattcaggagaaagtgatccaactaacacaacaatttttgttggagctgtggatcaaagtgtaacagaagatgatttgaagtcagtttttggtcaatttggtgaactagttcatgtgaaaatacccgcaggaaaacgttgcggatttgttcaatacgccaatagggcatgtgctgagcaagcactttctgtgttgaacggaacacaacttgggggacaaagcattcgtctttcatggggtcgcagtccttccaacaaacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcagtgaagcatgatgtgtaagtcgtgatcgagctgaagttgtagaaagctgtaaccgtttgacaatggtgaatgaattattgaagtggatgtgtattagctcttcttgtctcagattctctcttcaactcttttttttttcttttggattatttttctttcgcgtggctattgttgagtgtccttgcaagtcataacaaaaagcttaaacccaagtgttttttgtcatgactaatatgaccatt

SEQ ID NO: 1726 - protein, 415 aa, Arabidopsis thaliana
  G2854,ACBF-like domain coordinates 110-250
MMQQPPPASNGAATGPGQIPSDQQAYLQQQQSWMMQHQQQQQGQPPAGWNQQSAPSSGQPQQQQYGGGGSQNPGSAGEIRSLWIGDLQPWMDENYLMNVFGLTGEATAAKVIRNKQNGYSEGYGFIEFVNHATAERNLQTYNGAPMPSSEQAFRLNWAQLGAGERRQAEGPEHTVFVGDLAPDVTDHMLTETFKAVYSSVKGAKVVNDRTTGRSKGYGFVRFADESEQIRAMTEMNGQYCSSRPMRTGPAANKKPLTMQPASYQNTQGNSGESDPTNTTIFVGAVDQSVTEDDLKSVFGQFGELVHVKIPAGKRCGFVQYANRACAEQALSVLNGTQLGGQSIRLSWGRSPSNKQTQPDQAQYGGGGGYYGYPPQGYEAYGYAPPPQDPNAYYGGYAGGGYGNYQQPGGYQQQQQ

SEQ ID NO: 1727 - DNA, 943 bp, Arabidopsis thaliana
  G2859,family:HLH/MYC
actttctattttcaccaattttcaaaaaaaaaataaaaattgaaactcagaaatggcgaatctctcttctgattttcagacatttacaatggatgatcccataagacaactagcagaactgagcaacacgcttcatcatttccaaacatttcctcctcctttctcttcttctctcgattctcttttctttcataatcaattccctgatcattttcccggaaaatctctcgagaataattttcatcaagggatattcttcccttctaatatccaaaacaacgaagagtcttcttcacaattcgataccaagaagagaaaatcattaatggaagctgtttctacgtcggagaacagtgtctctgatcaaactctctctacctcttctgctcaagtttccataaatggaaatatttcgacaaaaaataattcttcaaggagagggaagaggtcgaagaatagagaagaagagaaagagagagaagttgttcatgttagagctagaagaggccaagccactgatagccacagcatagcagaacgggttcgacgagggaaaataaacgagagattgaaatgcttgcaagatatagtccccggatgttataagacaatgggaatggctactatgcttgatgagataattaattacgtccagtccttacaaaatcaagtcgagtttttatctatgaagcttacagcagcaagttcgtattatgactttaactcggagactgatgctgtggaatccatgcagaaggcaaaggcacgtgaggcagtggagatgggtcaagggagggatgggagttctgtcttccattcatcatcgtggaccctttgacttttgttttttgctctcctttttttgtctttctaattttcttcctttttttggatttaaaaagatacttttaaagattaatttcaagaaatctcgatgtaaaaa

SEQ ID NO: 1728 - protein, 261 aa, Arabidopsis thaliana
  G2859,HLH/MYC domain coordinates 150-208
MANLSSDFQTFTMDDPIRQLAELSNTLHHFQTFPPPFSSSLDSLFFHNQFPDHFPGKSLENNFHQGIFFPSNIQNNEESSSQFDTKKRKSLMEAVSTSENSVSDQTLSTSSAQVSINGNISTKNNSSRRGKRSKNREEEKEREVVHVRARRGQATDSHSIAERVRRGKINERLKCLQDIVPGCYKTMGMATMLDEIINYVQSLQNQVEFLSMKLTAASSYYDFNSETDAVESMQKAKAREAVEMGQGRDGSSVFHSSSWTL

SEQ ID NO: 1729 - DNA, 1025 bp, Arabidopsis thaliana
  G2865,family:HLH/MYC
agttctgtcacgtgtaaaagagcttgtgaaacattacagcaaaccaaactatttgactaaagatgaaaacaacacctctcccgaggctgcattatttagtaagtcttctttgtttttttctttcttccaagattaaagaagacagacccaattatgtaagggcagtctctcctataaacctaactagttcattggaaaaaacaagagagaaaaaaaaacgattactgctgagatctaccatttctaaacctcaacccatgaatccttctaacaatcctaaaaagacaaggcaccagagtcatatgcctcaagaaagagatgaaacgaagaaggagaagaagcttctccaccgcaacatcgaacgacaaagaagacaagaaatggcgatccttttcgcctctcttcgtagtcagctacctctaaaatacatcaaggctctttcttcgcagggaaagagagccatgtcagatcatgtaaacggagcagtaagtttcatcaaagacacgcaaacaaggataaaagatctctccgcaagaagagacgagctaaagcgagagattggtgaccctactagtctaactggatccggatccggatctggatcaagtagatcggaaccagctagtgtcatggtgcaaccgtgtgtgagcggcttcgaggtggttgtgagcagcttagcatcaggtctcgaggcttggccactctcaagagttcttgaagttcttcacgggcaaggacttgaagtcatcagctctttaacagcacgagtcaacgagaggctcatgtacactatacaagtcgaggtaaatagctttgattgcttcgacttagcttggttgcagcagaagctaattgagcagttagtactttccacgactaggcactgaaaaaactaacatttgtcataagaatatgttcattgaatgatgcttttgtcccaatctctttgttttagtgtccgtaagggtgtgttcttttggtccttcactacttggagtgatttttttttttttttttaaaaaaaa

SEQ ID NO: 1730 - protein, 274 aa, Arabidopsis thaliana
  G2865,HLH/MYC domain coordinates 88-153
MKTTPLPRLHYLVSLLCFFLSSKIKEDRPNYVRAVSPINLTSSLEKTREKKKRLLLRSTISKPQPMNPSNNPKKTRHQSHMPQERDETKKEKKLLHRNIERQRRQEMAILFASLRSQLPLKYIKALSSQGKRAMSDHVNGAVSFIKDTQTRIKDLSARRDELKREIGDPTSLTGSGSGSGSSRSEPASVMVQPCVSGFEVVVSSLASGLEAWPLSRVLEVLHGQGLEVISSLTARVNERLMYTIQVEVNSFDCFDLAWLQQKLIEQLVLSTTRH

SEQ ID NO: 1731 - DNA, 519 bp, Arabidopsis thaliana
  G2866,family:IAA
atgggaagagggagaagctcatcgtcttcatcgatagagagcagctgcaaaagcaacccatttggtgtgtcttcgagtaatactcggaacctaagcacggacctgagactcgggctcagcttcggatcatcttccggacaatattacaacggtggagataaccatgaatatgatggagtcggtgcggcagaggaaatgatgatcatggaagaagaagagcaaaacgagtgtaatagtgtcggaagcttctacgtgaaagtgaacatggaaggagttcctattgggagaaagatcgatcttttatctcttaatggatatcatgatttgatcacaactctcgactacatgttcaatgcttcaatcctttgggctgaagaagaagatatgtgtagtgagaagagtcacgtgctaacgtacgcagacaaagaaggtgactggatgatggttggagatgttccttgggagatgttcttgtctagcgtgagaagactaaagatctcaagagcttatcactactga

SEQ ID NO: 1732 - protein, 172 aa, Arabidopsis thaliana
  G2866,IAA domain coordinates 84-100,139-168
MGRGRSSSSSSIESSCKSNPFGVSSSNTRNLSTDLRLGLSFGSSSGQYYNGGDNHEYDGVGAAEEMMIMEEEEQNECNSVGSFYVKVNMEGVPIGRKIDLLSLNGYHDLITTLDYMFNASILWAEEEDMCSEKSHVLTYADKEGDWMMVGDVPWEMFLSSVRRLKISRAYHY

SEQ ID NO: 1733 - DNA, 2304 bp, Arabidopsis thaliana
  G2869,family:ARF
atggaaagtggcaacgttgtgaatacacaacctgaattatcaggcataattgatggatccaagagttatatgtacgagcagttatggaaactctgtgcgggacctttgtgtgatattccaaaacttggagaaaaggtttattactttcctcaaggccatatagagcttgtgagttctctctctctatattctttctctcttctttctctctctctctctctctctctctctctctctctctctctctctctctctctctctcctttctctctcttctctctcttctctctctcgcctctttctctctctctctctctctctctccttctctctcatgttgaggcatctacaagagaagagttgaatgagttacaaccaatttgtgattttccttctaagcttcaatgtcgtgttattgctattcaacttaaggtggaaaacaatagtgatgagacttatgctgagatcactttgatgccagatacaactcaagttgtaatccctactcagaatcaaaatcaatttaggccattagttaattcctttacgaaggttttaacggcctcagatacaagcgttcatggtggattctctgttccgaaaaaacatgccattgaatgtctccctccgctggatatgtcacagcctctaccgacacaagaaattcttgctatagatcttcatggtaatcaatggagattcagacacatctatagaggtacagcgcaaagacatttgttaacaattggttggaatgcattcacaacatcaaaaaaattggttgaaggagatgttattgtattcgttaggggagagactggagagttacgagttggtatcagacgagcaggacatcaacaagggaatataccttcatcaatagtatcaatagaaagtatgagacatgggataattgcttctgcaaagcatgcttttgataaccaatgtatgttcattgtggtttacaagccaaggtcaagtcaatttattgtcagttacgacaaattcttagacgttgtgaacaataagttcaatgtcggttcaagatttacaatgcggtttgagggtgatgatttctctgaaagaagatcttttgggacaattattggagttagtgatttctctcctcattggaagtgttcagagtggcgcagcttagaagtgcagtgggatgaatttgcatcatttccgagaccaaaccaagtttcaccatgggacatcgaacatttaacgccttggtcaaatgtttccaggtcatcttttctcaagaacaagcgttcacgagaagttaatgaaatcggttcttcctcatcacatctcttgcctcctacattgacacaaggacaagaaattggacaacaaagcatggccaccccgatgaatatttctcttcgttatcgtgatattactgaagatgctatgactccttctagattgctaatgagctaccctgtccaaccaatggccaaactaaattacaataatgtggttacaccaatagaagaaaatataacaaccaatgcagtcgctagttttaggttgtttggagtctctctggccactccttcggtgatcaaagatcccgttgaacaaattggcttggagatttctagacttactcaggaaaaaaagtttggtcaaagccaaattttgagatcaccaacagagatccaaagcaagcagttcagttctaccagaacttgtaccaaagttcaaatgcaaggtgtaacaataggaagagctgtggatttaagtgttcttaatggatatgatcagttaatactagaattggagaagctcttcgatctcaaaggccaattgcaagctcgcaaccaatgggaaatagctttcacaaataatgaagaggataagatgcttgttggagaagatccatggcctgaattctgcaacatgcgtgggtacgtcgcctcaaactccaaggatgatcctgcaaaggttgctgctagcttcacctcccaggtcgtcatcatgaaccaccttggtcagattaaaaatggttacaccccagttcttgattgccacacctctcacattgcagtcaagttctctgagatcttgaccaagattgactggcgtactggtcatgagattgagaaggagccaaagtttttaaagaacagtgaggccgctattattaatatgactcccaccaagcctatggtggttgaggcttactctgcgtacccacccctgggacgttttgctattagggacatgaggcaaaccgttggtgttggagttatcaagagtgttgtcaagaaggacccaagtggagccaaatga

SEQ ID NO: 1734 - protein, 767 aa, Arabidopsis thaliana
  G2869,ARF domain coordinates 26-409
MESGNVVNTQPELSGIIDGSKSYMYEQLWKLCAGPLCDIPKLGEKVYYFPQGHIELVSSLSLYSFSLLSLSLSLSLSLSLSLSLSLSPFSLFSLFSLSPLSLSLSLSLLLSHVEASTREELNELQPICDFPSKLQCRVIAIQLKVENNSDETYAEITLMPDTTQVVIPTQNQNQFRPLVNSFTKVLTASDTSVHGGFSVPKKHAIECLPPLDMSQPLPTQEILAIDLHGNQWRFRHIYRGTAQRHLLTIGWNAFTTSKKLVEGDVIVFVRGETGELRVGIRRAGHQQGNIPSSIVSIESMRHGIIASAKHAFDNQCMFIVVYKPRSSQFIVSYDKFLDVVNNKFNVGSRFTMRFEGDDFSERRSFGTIIGVSDFSPHWKCSEWRSLEVQWDEFASFPRPNQVSPWDIEHLTPWSNVSRSSFLKNKRSREVNEIGSSSSHLLPPTLTQGQEIGQQSMATPMNISLRYRDITEDAMTPSRLLMSYPVQPMAKLNYNNVVTPIEENITTNAVASFRLFGVSLATPSVIKDPVEQIGLEISRLTQEKKFGQSQILRSPTEIQSKQFSSTRTCTKVQMQGVTIGRAVDLSVLNGYDQLILELEKLFDLKGQLQARNQWEIAFTNNEEDKMLVGEDPWPEFCNMRGYVASNSKDDPAKVAASFTSQVVIMNHLGQIKNGYTPVLDCHTSHIAVKFSEILTKIDWRTGHEIEKEPKFLKNSEAAIINMTPTKPMVVEAYSAYPPLGRFAIRDMRQTVGVGVIKSVVKKDPSGAK

SEQ ID NO: 1735 - DNA, 1461 bp, Arabidopsis thaliana
  G2884,family:GARP
atgcagccattaaatatggctgagatattggatcaccgtggagtcttgaccgacggtgatgatggtccatttagaaatctaacaaacttctatgatatgttttcaagcaactttcctgaaggtttgcgagtgttagtcttcgatgaagatccatcgtatcttctgatattggagagacatctccaaaagtttcaataccaagtgactatatgcaacgaagtgaacaaagctatgcatacactccgcaaccataggaataggttcgacctcgctatgatacaagtaaataatgcagaaggtgatatattccggtttctctcggaaatcggatcggaaatggatcttccaatcatcataatatctgaagacgattcagtgaagtcggtgaagaaatggatgattaacggtgctgccgactatcttataaaaccgataagacccgaagatctacggatagtattcaaacatttggtaaagaagatgagagaaaggaggagtgtggtgaccggagaggcagagaaagcagcaggtgagaaatcatcctctgtcggagattccaccataagaaaccctaacaagagtaaaagaagtagttgccttgaagcagaagtcaacgaggaggatcgtcatgatcataatgatcgtgcttgtgcttctagtgccaagaaaagacgagtcgtttgggacgaggagcttcaccaaaactttctcaacgccgtggattttcttggactcgaaagagctgttcccaaaaaaatattagatgttatgaaggttgattacatcagtcgagaaaacgtagccagtcatcttcagaaattccggctcatgctgaagaaggagaatgatgaaaagattaagaaagaggagatgaacaaatctttaataaccccacaaaatggaagaatgtatgttggagaagatccatcaaatttctacagaggaagaaatgatcatttcccaacacatcatgtcaacaatattcctcaaccttcttatgtgccgcaacacaccttgaaccctaacaatctcaacacacagctcataccatctctcggacatcattttgatcatcgaggctctattgtggttcccgatacaaacctagagatgaatcaacaattttttcaccaccaacagacctcggacttcacgccagaagagaatcttggtgataacaactttactgaggaagatttaatgatggcatcaacatattatttgagcgagccggatgatgcttcttttgaaaagaagaatgggcatgaagttgtgccatcgcccatatttcattcgccgttttcctctaataagtaccaacgtagttcctttcttgatcagcaagaaagtggaggacttagctacaatactgttttttctaatgatgaatccaacattgggatttgcaagaagggatcaagatgggtcaagatcggagccaagcatgaagacggaagatga

SEQ ID NO: 1736 - protein, 486 aa, Arabidopsis thaliana
  G2884,GARP domain coordinates 228-276
MQPLNMAEILDHRGVLTDGDDGPFRNLTNFYDMFSSNFPEGLRVLVFDEDPSYLLILERHLQKFQYQVTICNEVNKAMHTLRNHRNRFDLAMIQVNNAEGDIFRFLSEIGSEMDLPIIIISEDDSVKSVKKWMINGAADYLIKPIRPEDLRIVFKHLVKKMRERRSVVTGEAEKAAGEKSSSVGDSTIRNPNKSKRSSCLEAEVNEEDRHDHNDRACASSAKKRRVVWDEELHQNFLNAVDFLGLERAVPKKILDVMKVDYISRENVASHLQKFRLMLKKENDEKIKKEEMNKSLITPQNGRMYVGEDPSNFYRGRNDHFPTHHVNNIPQPSYVPQHTLNPNNLNTQLIPSLGHHFDHRGSIVVPDTNLEMNQQFFHHQQTSDFTPEENLGDNNFTEEDLMMASTYYLSEPDDASFEKKNGHEVVPSPIFHSPFSSNKYQRSSFLDQQESGGLSYNTVFSNDESNIGICKKGSRWVKIGAKHEDGR

SEQ ID NO: 1737 - DNA, 2152 bp, Arabidopsis thaliana
  G2885,family:GARP
agagtacgcgggggtactatattcctttgaagagaggagacttgcaaacgtattgcatcaaatatggagtttggaagcactgaagatggaaggcatgacaagtttcctgtaggaatgagggttcttgctgtggatgacaatccaacctgccttcggaaactcgaagagttgctgcttcgttgcaagtatcatgtgacaaagacaatggagtcgaggaaagctctggaaatgctgagagaaaacagcaacatgtttgatctggtgataagcgatgtagagatgccagacacggatggttttaagttgcttgaaattggtcttgaaatggaccttcctgtcatcactcatagcgactatgacagcgttatgaaaggtattatacatggcgcttgcgattatctggtcaagcctgttggactcaaggagcttcagaatatatggcatcatgttgtgaagaagaacattaaatcttacgcaaaactgctcccaccttctgaatctgattccgtcccaagcgccagcaggaaacggaaagacaaagtcaatgacagtggtgatgaagatgacagtgacagagaagaggatgatggtgaggggagtgaacaggatggtgacgggtcaggtacgcggaagaagccacgtgttgtttggtctcaggagcttcaccagaagtttgtcagtgccgttcagcaattgggcctcgacaaggctgttcccaaaaaaatacttgatctcatgagtatagaaggtctcactagggaaaacgtagccagtcatttgcagaagtacagactgtacttgaaaaagatagacgaaggtcagcagcaaaatatgaccccagatgcatttggaacaagagattcatcttactttcagatggctcaacttgatggacttagagattttactgccgcaagacaaattccaagctcaggactcttatcgcgttcccatctcaccaaactccaaccccctatgtattcatcgataaatctccaaggaatgaactcctccagcttcatccaacaggggcatcaccagaactcaagcaattcagctaatccgtttggaacatatcacagtactctgtcaccaagaatccagaacgtgaatctgtttcagcgaacttcatctccactagaacccctccagtttcctagaagcaagtcatacattggagattttaaaggcttaggggacagagctattggcggtagcttcctagatacttgtatgccatttggtagctctagcacctctttaccaagtgcttccaccaatcctctaatgttgcaagcaaactatacacaacccctgcatatagcctcagatggaattcagccttgcatcgagggaactccgtccaactctgcctccccaaacatcagtttccaaggcttatctagatttcctggtcatagctggcaagggaatttgaacacaaccagattcccaccgagttccttaccactaaatcttgctttcttgccggatcaagtgacatgtgcagggaacaatctgggagattgtacttctttggtttctgcagagaatcctggtggagagatgcagtgtgatcctcaattacttggcggcttcatgcagaacgtgaatccgttaggcggacagaaatgggagcaacagaactgcaccatgctgaacaatccattcggtaacattgagtatcctctacccgcagataacatggttttcagagacaacaattcaaccagaagcaaaggcttggatgagtcactgatgaacccaatagacaacagtcaagagtatgttggaaaagctactacaatgctggatccagagatgaagtcgggaaagccagagaatgacaaccagcatgatgtattcgatgacataatgaatgagatgatgaaacaggaggagaataacggaatggtgccagtggctactagatttggctttgattcatttcctccaccttagctagtcatctctttctctaccagttgcattaagtttctccacttgagaccattttcatgtgatttttttaaatttcttcccacattgtttcctccgactgtcaatagatcatagtacaccaacctgtttcatactctcttttatgaattggaattgaaagcgagcctgttacaaaaaaaaaaaaaaaaaa

SEQ ID NO: 1738 - protein, 632 aa, Arabidopsis thaliana
  G2885,GARP domain coordinates 196-243
MEFGSTEDGRHDKFPVGMRVLAVDDNPTCLRKLEELLLRCKYHVTKTMESRKALEMLRENSNMFDLVISDVEMPDTDGFKLLEIGLEMDLPVITHSDYDSVMKGIIHGACDYLVKPVGLKELQNIWHHVVKKNIKSYAKLLPPSESDSVPSASRKRKDKVNDSGDEDDSDREEDDGEGSEQDGDGSGTRKKPRVVWSQELHQKFVSAVQQLGLDKAVPKKILDLMSIEGLTRENVASHLQKYRLYLKKIDEGQQQNMTPDAFGTRDSSYFQMAQLDGLRDFTAARQIPSSGLLSRSHLTKLQPPMYSSINLQGMNSSSFIQQGHHQNSSNSANPFGTYHSTLSPRIQNVNLFQRTSSPLEPLQFPRSKSYIGDFKGLGDRAIGGSFLDTCMPFGSSSTSLPSASTNPLMLQANYTQPLHIASDGIQPCIEGTPSNSASPNISFQGLSRFPGHSWQGNLNTTRFPPSSLPLNLAFLPDQVTCAGNNLGDCTSLVSAENPGGEMQCDPQLLGGFMQNVNPLGGQKWEQQNCTMLNNPFGNIEYPLPADNMVFRDNNSTRSKGLDESLMNPIDNSQEYVGKATTMLDPEMKSGKPENDNQHDVFDDIMNEMMKQEENNGMVPVATRFGFDSFPPP

SEQ ID NO: 1739 - DNA, 1470 bp, Arabidopsis thaliana
  G2887,family:NAC
atggggaaaactcaactcgctcctggatttcgtttccatccgactgatgttgaactcgtgaggtattacttgaagaggaaaatactggggaaaaagctccttgtcgatgctattgctgaagttgacatttacaagtttgaaccccctgatttacctgatatgtcttttataagaagtggggatcttaagtggcacttcttctgccccagggaaaagaagtatgctagtggggtaagggcaaaccgtgcaactgagtgtggctactggaagaccacggggaaggagagaccagttctgtgcaattctgaggttgtgggaaagatcaaaactctggtttatcactttggcaagtcgcctcgtggggagcggactgattgggttatgcatgaatacaggcttgacgacaaagtactgacgcagatgaatgttcctcaggatacttatgtggtgtgtgttctgttcaagaaagatggtcctggacctagaaatggagctcaatatggagctccgtttaaggaagaggactggagtgatgaggaagtacgtactgatgttccttctactagtaatcccacaaaccttcttgagcctagcaaagaaaccactctggctttgactgccccagatgactccaataaggattgttttggtggcatgatatcagagtcatgtgtctcggatttcctaccagctacaactaataccaccagcgagcttccacatccaagtgatgcagctaccactcctatgtctactgcacctctggcagagaccgttcagacccccaacaatgatgacttatattcaatgttggatctatttgatgatgacgaagagttcttagggttcaacaataatgaggtaagatatgatcccggtgtctcagctccagtttgcttagaagaagaaggcattttcaacggactaccagagttgagcagcatgccaaggacggcctcttacgacctagttgaaaactcggagttatacctagagctacaagacctcactgctccattaaatccccaaactgggctacaagacctcactgctccatttaatcctcaaactgggctacaagacctcactgctccatttaatcatcaaactgggctacaagaccacactgctccatttaatcctcaaactgggctacaagaccacactgctccatttaatcatcaaactgggctacaagacctcactgctccatttaatcctcaaactgggctacaagacctcactgctccatttaatcctcaaactgggctacatgacctcacttctccatttaatcctcaaactgggctacaagacctcactgctccattaaatcctcaaactgggaatcgcaatgacccgagaagctcctcctttctgtataatcaaggccattttgacttctctggtggtaatgatgatgatccttatggcttttctgcttccatgagacatagaccaaaaatgtaa

SEQ ID NO: 1740 - protein, 489 aa, Arabidopsis thaliana
  G2887,NAC domain coordinates 4-180
MGKTQLAPGFRFHPTDVELVRYYLKRKILGKKLLVDAIAEVDIYKFEPPDLPDMSFIRSGDLKWHFFCPREKKYASGVRANRATECGYWKTTGKERPVLCNSEVVGKIKTLVYHFGKSPRGERTDWVMHEYRLDDKVLTQMNVPQDTYVVCVLFKKDGPGPRNGAQYGAPFKEEDWSDEEVRTDVPSTSNPTNLLEPSKETTLALTAPDDSNKDCFGGMISESCVSDFLPATTNTTSELPHPSDAATTPMSTAPLAETVQTPNNDDLYSMLDLFDDDEEFLGFNNNEVRYDPGVSAPVCLEEEGIFNGLPELSSMPRTASYDLVENSELYLELQDLTAPLNPQTGLQDLTAPFNPQTGLQDLTAPFNHQTGLQDHTAPFNPQTGLQDHTAPFNHQTGLQDLTAPFNPQTGLQDLTAPFNPQTGLHDLTSPFNPQTGLQDLTAPLNPQTGNRNDPRSSSFLYNQGHFDFSGGNDDDPYGFSASMRHRPKM

SEQ ID NO: 1741 - DNA, 1089 bp, Arabidopsis thaliana
  G2888,family:Z-C2H2
atggagctgacgcaacccataagagaaaacggagacccgcagggacaccagctaacagatccagatgcagaggtggtatctttgtcaccaagaacgttactagaatcagatcggtacgtgtgtgagatctgcaaccaagggtttcagagagatcagaatctacagatgcatagaagacgacataaagtgccatggaagcttctgaagagagacaagaaggatgaggaagtgaggaagagagtctacgtgtgtcctgagccaacatgtctccaccatgacccgtgccacgctcttggagatctggtcggaatcaaaaagcacttccgccgtaaacacagtgtccacaagcaatgggtttgcgagagatgctccaaaggctatgcagttcaatctgactacaaagcccatctcaagacctgcggttcacgcggtcactcctgcgactgtggccgcgttttctccagggttgagagtttcatagagcatcaagatacttgcaccatccggcaacctcaacccaccaaccaccgtcatctacagcagcacacgatgggccttgacgctccatcaagaaccacttcgacagcaagcttcggccctttattgcatggacttcctttgttaagacctccacgaccgtccaatcaacattcaccagcttttgcttaccctttcaatgcttcatcagctcctttcgaaagcctcgaacttcaactatccataggaatggcaagaacatcagcacaagcgaggcacaacgaaaagagagagacgagtttaacaaaggagagagcgaacgaggaggcaaggaaggcagaggaaacgagacaagaagcgaaaaggcagatagagatggcagaaaaggattttgagaaagctaagagaataagggaagaagcaaaaaccgagttggagaaggctcacgttgttagagaagaagcaatcaagaggattaatgcaacaatgatggagatcacttgccactcttgcaagcaactatttcagctgcctgttacggctgatgagagtacgtcgtctcttgttatgagttacgtttcctcggcgacaactgaaggagaatgcgagtga

SEQ ID NO: 1742 - protein, 362 aa, Arabidopsis thaliana
  G2888,Z-C2H2 domain coordinates 41-61,120-140
MELTQPIRENGDPQGHQLTDPDAEVVSLSPRTLLESDRYVCEICNQGFQRDQNLQMHRRRHKVPWKLLKRDKKDEEVRKRVYVCPEPTCLHHDPCHALGDLVGIKKHFRRKHSVHKQWVCERCSKGYAVQSDYKAHLKTCGSRGHSCDCGRVFSRVESFIEHQDTCTIRQPQPTNHRHLQQHTMGLDAPSRTTSTASFGPLLHGLPLLRPPRPSNQHSPAFAYPFNASSAPFESLELQLSIGMARTSAQARHNEKRETSLTKERANEEARKAEETRQEAKRQIEMAEKDFEKAKRIREEAKTELEKAHVVREEAIKRINATMMEITCHSCKQLFQLPVTADESTSSLVMSYVSSATTEGECE

SEQ ID NO: 1743 - DNA, 1140 bp, Arabidopsis thaliana
  G2893,family:MYB-(R1)R2R3
aaatcataaaagcctctctcttagtctatttttatctcacggctctctctcccctctctacacacacaaacacaaataaagcgtaaaactgaaatattttaattacaattagaaagagaacatattaatatgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctgggctaaagagagcaggaaaaagttgtagattgagatggttgaattaccttaaacccgacataaagcgtgggaatctcactcctcaagaacaacttttaatccttgagctccattctaaatggggtaataggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattaggttatattatatttatgtacttcttacaacttggaggggtttatcggtcttttattaaattttgattgttttggattccttaaaaatgtgttcttattatagtttttaatgaaaaaaatgtttaagcgcaaaaaaaaaaaaaaaaaaaaaaaaaaaaaa

SEQ ID NO: 1744 - protein, 283 aa, Arabidopsis thaliana
  G2893,MYB-(R1)R2R3 domain coordinates 19-120
MSNITKKKCNGNEEGAEQRKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQKQARQLNIDSNSHKFIEVVRSFWFPRLINEIKDNSYTNNIKANAPDLLGPILRDSKDLGFNNMDCSTSMSEDLKKTSQFMDFSDLETTMSLEGSRGGSSQCVSEVYSSFPCLEEEYMVAVMGSSDISALHDCHVADSKYEDDVTQDLMWNMDDIWQFNEYAHFN

SEQ ID NO: 1745 - DNA, 456 bp, Arabidopsis thaliana
  G2898,family:HMG
atgacgaagagagctcccaagtcagggcctttgtctccgtcgtgcagcggaggctctagtcggaacttagagttggctgtgaagtcaagtgaaggtgcaaggaggtctacaagactgagacttcagcctttgagaaagccaaagacaagccccaagaagaaacccgttaaactccaaacgaagatgcccaagaaacctgccactgctttcttctttttcctggatgatttccggaagcaatatcaagaggagaatccagatgtcaagtccatgcgcgagattgggaagacatgtggagagaaatggaaaacaatgacttacgaggaaaaggtaaagtattatgatatagctactgagaagagggaagaatttcaccgagcaatgacagaatataccaagagaatggaatcaggtgcccacgatgaatcagagaccgactcagactattctgaatag

SEQ ID NO: 1746 - protein, 151 aa, Arabidopsis thaliana
  G2898,HMG domain coordinates 59-131
MTKRAPKSGPLSPSCSGGSSRNLELAVKSSEGARRSTRLRLQPLRKPKTSPKKKPVKLQTKMPKKPATAFFFFLDDFRKQYQEENPDVKSMREIGKTCGEKWKTMTYEEKVKYYDIATEKREEFHRAMTEYTKRMESGAHDESETDSDYSE

SEQ ID NO: 1747 - DNA, 3252 bp, Arabidopsis thaliana
  G2907,family:PCGL
atggcggaagcaagacgattcagcccagttcatgaattagatgttggacaaatactctcagaagcacgacatcgatggcttcgtcctcctgaaatctgtgaaattttacagaattaccaaagatttcaaatttctactgagccacctactacaccatcaagtgggtctgtttttatgtttgatcgaaaggtgctcagatacttcaggaaagacggtcacaattggaggaagaaaaaagatggaaagactgtgaaggaagctcatgagaggttgaaggcgggaagcgttgatgttctacattgttactatgcgcatggacaggacaatgaaaactttcaaagacgcagttactggttgcttcaggaagaactttcccacatagtttttgttcactacctcgaagttaagggtagtagagtttctacttcttttaaccggatgcaaaggactgaagacgcggctcggtctcctcaagaaactggggacgccttgaccagtgaacatgatggttatgcttcttgcagcttcaatcaaaatgatcatagcaatcattcacaaactactgactcagcaagtgtcaatggttttcactctccagaacttgaagatgctgaatcagcatacaatcagcatggaagttccacagcttactctcatcaagaacttcagcagcctgcaacaggaggaaaccttactggttttgatccttactatcaaatctctttgacgcccagggatagttatcaaaaagagcttcgcacaatccccgtaactgattcttcaattatggtagacaaaagcaaaactatcaacagtcctggagtaacaaatgggttaaaaaacagaaaatccattgattcccaaacctgggaagagattctgggaaattgtggttctggagttgaagccttacctttgcagcctaacagtgagcatgaagtgctggaccaaatactcgaaagctcttttacaatgcaagattttgctagtctacaagagtccatggtcaaaagccagaatcaggagttaaattcaggacttacatctgatcgtaccgtgtggttccaaggacaagatatggagctaaatgctataagcaatctagcttcgaatgaaaaagctccatatctatctacgatgaaacaacatctgttacacggtgcattgggcgaagaaggtctgaaaaagatggacagtttcaatcgctggatgagcaaagaacttggagatgttggtgttatagctgatgcaaacgagtcctttactcaatcaagttcaagaacctactgggaagaagttgagagtgaggatgggtccaatggtcacaactctaggagggacatggatggatatgttatgagtccttccctctcaaaggaacagctctttagcatcaatgacttctctccaagctgggcttatgtgggttgtgaagtggtggtttttgtcactggaaaattcttaaagactcgggaggagactgaaattggcgagtggtcttgcatgtttgggcaaacagaagttccagcagatgttatatctaatggtattctccaatgtgttgctcctatgcatgaggctggaagagttcccttttatgtaacatgttccaacagattggcatgcagtgaagtgcgtgaattcgagtataaggttgccgagtctcaagtttttgatagagaagcagatgatgagtctactattgacattcttgaggcaagatttgttaaactgttgtgctcgaaatctgaaaatacaagccctgtttctgggaatgacagtgatttgtcacaattgagcgagaagattagtttactacttttcgagaacgatgaccagttggatcagatgctcatgaatgaaatctcccaagaaaatatgaaaaacaaccttttgcaggaatttctgaaagaaagcttacactcatggcttttacaaaagatagcagaaggtggaaaaggtccaagtgttttggatgaaggtggccaaggtgtattacattttgcagcttctcttggttacaactgggccttagaaccaacaataatcgctggtgtaagcgttgattttcgcgatgtaaatggttggaccgcacttcattgggcagctttctttggcagggagaggataattggttcactcatagctcttggtgctgctcctggaactttaactgacccaaatccagatttcccatcaggaagcacaccttctgatctagcctatgctaatggtcacaaaggaattgctggttatctctcagaatatgccttaagagctcatgtttctttgctcagtctaaatgataaaaatgccgaaactgttgagatggctcctagcccatccagctcatcattgacagactcgttgacagctgtacgtaacgctactcaggcagcagctcggattcatcaggttttcagggctcagtctttccagaagaagcaactaaaagaatttggagataaaaagcttggaatgtcggaggagcgtgctctttcgatgcttgctcctaaaacacacaaatcaggaagggcacatagtgatgattccgtgcaagccgctgctattcggattcagaacaagttccgaggttacaagggaagaaaagactatttgattaccagacaaagaatcatcaaaatacaggctcatgtgagaggttatcagtttaggaaaaactacagaaagataatttggtcagtgggggtattagagaaggtgatattacgttggagacggaaaggagctggtttgcgcgggtttaagtcagaagcacttgttgagaagatgcaagacggaacagagaaagaagaagatgatgattttttcaaacaaggaagaaagcaaacagaggataggctacaaaaagctcttgcaagagtgaaatccatggttcaatatcctgaagctagagatcaataccgtagattgctaaatgttgtcaacgacatccaagaaagcaaggttgaaaaagctcttgaaaattcagaagcaacttgttttgatgatgatgatgatctgatagatattgaagcattgttggaagatgatgacacattgatgttgcctatgtcctcatctttgtggaccagttaaatcactctcaagctttgttgtgatattgtgtcacagtattattgactcattaaacttgtaaattcttgtgtaatcactcttctcatatactgtaactgcattcatgactctaatttaaatgatatatatttgaaacataaatcaaacttatgt

SEQ ID NO: 1748 - protein, 1032 aa, Arabidopsis thaliana
  G2907,PCGL domain coordinates 12-120,854-923
MAEARRFSPVHELDVGQILSEARHRWLRPPEICEILQNYQRFQISTEPPTTPSSGSVFMFDRKVLRYFRKDGHNWRKKKDGKTVKEAHERLKAGSVDVLHCYYAHGQDNENFQRRSYWLLQEELSHIVFVHYLEVKGSRVSTSFNRMQRTEDAARSPQETGDALTSEHDGYASCSFNQNDHSNHSQTTDSASVNGFHSPELEDAESAYNQHGSSTAYSHQELQQPATGGNLTGFDPYYQISLTPRDSYQKELRTIPVTDSSIMVDKSKTINSPGVTNGLKNRKSIDSQTWEEILGNCGSGVEALPLQPNSEHEVLDQILESSFTMQDFASLQESMVKSQNQELNSGLTSDRTVWFQGQDMELNAISNLASNEKAPYLSTMKQHLLHGALGEEGLKKMDSFNRWMSKELGDVGVIADANESFTQSSSRTYWEEVESEDGSNGHNSRRDMDGYVMSPSLSKEQLFSINDFSPSWAYVGCEVVVFVTGKFLKTREETEIGEWSCMFGQTEVPADVISNGILQCVAPMHEAGRVPFYVTCSNRLACSEVREFEYKVAESQVFDREADDESTIDILEARFVKLLCSKSENTSPVSGNDSDLSQLSEKISLLLFENDDQLDQMLMNEISQENMKNNLLQEFLKESLHSWLLQKIAEGGKGPSVLDEGGQGVLHFAASLGYNWALEPTIIAGVSVDFRDVNGWTALHWAAFFGRERIIGSLIALGAAPGTLTDPNPDFPSGSTPSDLAYANGHKGIAGYLSEYALRAHVSLLSLNDKNAETVEMAPSPSSSSLTDSLTAVRNATQAAARIHQVFRAQSFQKKQLKEFGDKKLGMSEERALSMLAPKTHKSGRAHSDDSVQAAAIRIQNKFRGYKGRKDYLITRQRIIKIQAHVRGYQFRKNYRKIIWSVGVLEKVILRWRRKGAGLRGFKSEALVEKMQDGTEKEEDDDFFKQGRKQTEDRLQKALARVKSMVQYPEARDQYRRLLNVVNDIQESKVEKALENSEATCFDDDDDLIDIEALLEDDDTLMLPMSSSLWTS

SEQ ID NO: 1749 - DNA, 1059 bp, Arabidopsis thaliana
  G2913,family:ARID
ctctactaaaagtctctctatagcgatgtcatcggacaacgaatcgacaccgtctcaagcgacggtagaaatgatggcgacttcgccggcgaagattaaagagtatccagaaccattggctttacatgaagttgtcgtcaaggattcttctgtcttctgggatactctcaggcggtttcactcaattatgtccactaagttcatgattcctgtgattggaggaaaagaactagatttgcatgttttgtatgtggaagtcacgaggaggggaggttacgaaaaggtagtcgtagagaaaaaatggagggaagttggaggagtgtttagattctctgcgacaacaacaagtgcttcgtttgtcttaaggaaacattatctcaatcttctcttccattacgaacaagttcatctcttcactgctcgtggtcctcttcttcatcccatagctacatttcatgcaaatccctcaacgagcaaagaaatggcgctcgtcgaatatactcctccgagtataagatatcataatactcatcctccttctcaaggttcgtcgagtttcacagccataggtacaatagaaggcaaattcgattgtggttatctggtaaaagttaagttgggctcagagattcttaacggcgttctttatcattcggcccagcccggcccatcatcatctccaaccgctgttctaaacaatgccgttgtaccttatgttgaaactgggaggagacggcgtcgtttaggtaaaagacgaagaagcagacgcagagaagatccgaattacccgaaaccgaaccggagcggttacaatttcttctttgctgagaaacattgcaagctcaaatcactttatcccaacaaggagagagagtttacgaaacttatcggagaatcgtggagcaatctctctaccgaagaacgaatggtttatcaagacattggattgaaggataaggaaaggtatcagagggagttgaatgagtacagagaaacgttgagacttagggatggtgacatgacaaacggcaaggctttttaggtgatttagttaaaacg

SEQ ID NO: 1750 - protein, 338 aa, Arabidopsis thaliana
  G2913,ARID domain coordinates 43-127
MSSDNESTPSQATVEMMATSPAKIKEYPEPLALHEVVVKDSSVFWDTLRRFHSIMSTKFMIPVIGGKELDLHVLYVEVTRRGGYEKVVVEKKWREVGGVFRFSATTTSASFVLRKHYLNLLFHYEQVHLFTARGPLLHPIATFHANPSTSKEMALVEYTPPSIRYHNTHPPSQGSSSFTAIGTIEGKFDCGYLVKVKLGSEILNGVLYHSAQPGPSSSPTAVLNNAVVPYVETGRRRRRLGKRRRSRRREDPNYPKPNRSGYNFFFAEKHCKLKSLYPNKEREFTKLIGESWSNLSTEERMVYQDIGLKDKERYQRELNEYRETLRLRDGDMTNGKAF

SEQ ID NO: 1751 - DNA, 778 bp, Arabidopsis thaliana
  G2930,family:HLH/MYC
agcctcttttttgttcctcttgccgtcgtatatatatgtcttctcaaccgaatcatcagacttcaatatcaagtttactccatgatcgcttgcatatccctcctgcagaaacaatcgttgagaaagagtctgcagagaaggacacttgtcaatcacaaagaaaaaggaaagaaccagttttgcatgaggttgatggctcaagtagtggtgcagcaaagaaacaagaccataacgctaaggagcgtttaaggaggatgagacttcatgcctcttacctcactcttggcactcttcttcctgaccattcttcttcttcttcaaagaagaaatggtctgcaccatctataatcgataatgtaatcacttacattcccaagctacagaatgaagttggagagctaactctaagaaagcagaagcttgtggagttagagagacgaggtccttctattcgagcaatctcggttcttgaattgggggaatcaggttatgaggctgttgtacagatatgcttgaagaaagaaaacgaagatgagttctccaacttgcttcatgtaatggaggtgcaaggtttgagtgttttaagtgcttctacttctcaagtttgccgagagcaaagggtggtttgctacaacttccatgtcaagatggatgagaagccatgtgaaggtgatgactacatcacagtgttaaagaacaacatcatttcttcgcttcgtgacaacacaaagtgcaaatgatatatagtgaggtatagaatcaacagaatatctttgat

SEQ ID NO: 1752 - protein, 234 aa, Arabidopsis thaliana
  G2930,HLH/MYC domain coordinates 57-120
MSSQPNHQTSISSLLHDRLHIPPAETIVEKESAEKDTCQSQRKRKEPVLHEVDGSSSGAAKKQDHNAKERLRRMRLHASYLTLGTLLPDHSSSSSKKKWSAPSIIDNVITYIPKLQNEVGELTLRKQKLVELERRGPSIRAISVLELGESGYEAVVQICLKKENEDEFSNLLHVMEVQGLSVLSASTSQVCREQRVVCYNFHVKMDEKPCEGDDYITVLKNNIISSLRDNTKCK

SEQ ID NO: 1753 - DNA, 905 bp, Arabidopsis thaliana
  G2933,family:HLH/MYC
aaaaaacagaatcaataaccttgtccttgattaagcaaaaaatgtgtgcattagtcccttcatttttcacaaacttcggttggccgtcaacgaatcaatacgaaagctattacggtgccggagataacctaaataacggcacatttcttgaattgacggtaccacagacttatgaagtgactcatcatcagaatagcttgggagtatctgtttcgtcagaaggaaatgagatagacaacaatccggttgtggtcaagaagcttaatcacaatgctagtgaacgtgaccgacgcaagaagatcaacactttgttctcatctctccgttcatgtcttccagcttctgatcaatcgaagaagctaagtattcctgaaacggtttcaaagagcttaaagtacataccagagctgcaacagcaagtgaagaggctaatacaaaagaaggaagaaattttggtacgagtatcgggtcaaagagactttgagctttacgataagcagcaaccaaaggcggtcgcgagttatctctcaacggtttctgccactaggcttggtgacaacgaagtgatggtccaagtctcatcgtccaagattcataacttttcgatatcaaatgtgttgggtgggatagaagaagatgggtttgttcttgtggatgtttcatcatcaagatctcaaggagagaggctcttctacactttgcatcttcaagtggagaatatggatgattacaagattaattgcgaagaattaagtgaaaggatgttgtacttgtacgagaaatgtgaaaactcgtttaactaggtgactaattcatataatggtgtgtttatccactagttctcatttctttttagctgtgtccttttctcatatgaatctaacactgatctggaccaaaaaaaa

SEQ ID NO: 1754 - protein, 253 aa, Arabidopsis thaliana
  G2933,HLH/MYC domain coordinates 68-128
MCALVPSFFTNFGWPSTNQYESYYGAGDNLNNGTFLELTVPQTYEVTHHQNSLGVSVSSEGNEIDNNPVVVKKLNHNASERDRRKKINTLFSSLRSCLPASDQSKKLSIPETVSKSLKYIPELQQQVKRLIQKKEEILVRVSGQRDFELYDKQQPKAVASYLSTVSATRLGDNEVMVQVSSSKIHNFSISNVLGGIEEDGFVLVDVSSSRSQGERLFYTLHLQVENMDDYKINCEELSERMLYLYEKCENSFN

SEQ ID NO: 1755 - DNA, 1161 bp, Arabidopsis thaliana
  G2934,family:HLH/MYC
catagagaaccatctggttctttaaggcaccatcattcaacaagtaaacaataaaggaaattaaattatcacaagacagaaccacaaaatcctttggagatctgacactggtaaagctcaaagtgtcaaactatggatccttataagaatcttaatccaaaaggttaccagagacagagaccgtttagctcagccggcgagagtggcggcagcggcggctccggtacggcccatgaaacagatgacaataagaagaagaagaagcttctccaccgcgacatcgaacgccaaagaagacaagaaatggctacactctttgctactcttcgtactcacttacctcttaaatacatcaagggaaaaagagctgtgtcggatcatgtaaatggagcggtaaatttcattaaggacacggaagcacggattaaagaacttagtgcaagaagagacgagttaagtagagaaaccggccaaggatataaatcgaatccggatccaggaaaaactggatccgatgtaggcaaatcggagccggcgactgtgatggtgcaaccacacgtgagcggtttagaagtggtagtgagcagcaactcctcaggccccgaagctttgccactatcaaaagtgctcgagacaattcaggagaaagggcttgaagtcatgagctccttcactacaagagtcaatgataggctcatgcacactattcaagtagaggttaatagtttcggatgcatagacttattatggttgcagcagaagctagttgaggatttgatactttcgacggggtactaatcatgcagaaacataccattcgtagtcctaaagaacttcctcatcaaaaaatcaaagtcttcttgaaatttcgttatgagagcaaggtgcataggtgttaaagttcattcatggattgaggtgtagctttggtttaaacaagttcaagtgacttcatggggtagatcataacttcaccatgattcgccgccgtaaagaccaagggtctgatgttttcagtagagattttttttttctcacgggcaagccatttttttgtttccctttcattataacattttgtatcactccattgttaggttttcttgggttttctcgtatggaaaataagtttttctgtaatacatatccatgaatcattta

SEQ ID NO: 1756 - protein, 221 aa, Arabidopsis thaliana
  G2934,HLH/MYC domain coordinates 39-99
MDPYKNLNPKGYQRQRPFSSAGESGGSGGSGTAHETDDNKKKKKLLHRDIERQRRQEMATLFATLRTHLPLKYIKGKRAVSDHVNGAVNFIKDTEARIKELSARRDELSRETGQGYKSNPDPGKTGSDVGKSEPATVMVQPHVSGLEVVVSSNSSGPEALPLSKVLETIQEKGLEVMSSFTTRVNDRLMHTIQVEVNSFGCIDLLWLQQKLVEDLILSTGY

SEQ ID NO: 1757 - DNA, 540 bp, Arabidopsis thaliana
  G2958,family:IAA
atgtcaccggaggaatacgttagggtttggccggattccggtgatcttggaggaactgagctgaccctagctttgcctggcactccgacaaatgcatcggaaggtccaaaaaagttcgggaacaaacgtagattcctcgagaccgttgatttaaaactcggggaagcacacgagaacaattatatctcaagcatggtcactaatgaccagttggtgggctggccgccggtagcgacagcgaggaaaacagtgaggcggaaatacgtgaaagtggcgttggatggtgcggcctatctcagaaaggttgatcttgggatgtacgattgctatggacagcttttcaccgctctagaaaacatgtttcaggggataataacaatatgtagagtgacagagttggagaggaagggagagtttgttgctacttacgaggataaggacggtgacttgatgttagtcggagatgtgccgtggatgatgtttgtggaatcttgcaaacgtatgaggttaatgaaaaccggagatgctattggattatag

SEQ ID NO: 1758 - protein, 179 aa, Arabidopsis thaliana
  G2958,IAA domain coordinates 88-104,143-172
MSPEEYVRVWPDSGDLGGTELTLALPGTPTNASEGPKKFGNKRRFLETVDLKLGEAHENNYISSMVTNDQLVGWPPVATARKTVRRKYVKVALDGAAYLRKVDLGMYDCYGQLFTALENMFQGIITICRVTELERKGEFVATYEDKDGDLMLVGDVPWMMFVESCKRMRLMKTGDAIGL

SEQ ID NO: 1759 - DNA, 822 bp, Arabidopsis thaliana
  G2964,family:Z-C3H
gaaggataagaatcgcaaagctcatatcacaaaactttgagatctcatttcatctttcttcgattctacctactccgattcaatcgatcttatcgagacatggatgctcgtaagagaggacgccctgaagctgctgcctctcacaactccaatggcggattcaagaggtctaagcaagagatggaatcaatttcaactggtttaggaagcaaatccaagccatgcactaaatttttcagcacttctggatgtccatttggtgacaattgccacttcttgcactatgtgcccggtgggtacaatgctgcagcgcagatgacaaatctccgaccaccggtttctcaagtttccagaaatatgcaaggatctggtggtcccggcggcagattctcagggagaggagatccaggatcaggccctgtttcaatctttggtgcttctacttccaagatcagtgtagatgcttctttagccggtgccatcattggaaaaggtggaatccattccaaacagatatgccgtgaaacaggagcaaaattatcgattaaagatcatgaaagagacccaaacttgaagattatcgagctggaaggaacatttgaacagatcaatgtagcgagtgggatggtgagagagcttatagggaggcttggatcagtgaagaaacctcaagggattggtggtcctgaagggaaaccacatcctgggagcaactacaaaaccaagatctgtgataggtactctaaagggaactgtacatatggagatagatgccattttgctcatggtgaatctgagctgcgcaggtcaggaatcgcttag

SEQ ID NO: 1760 - protein, 240 aa, Arabidopsis thaliana
  G2964,Z-C3H domain coordinates 41-63,201-235
MDARKRGRPEAAASHNSNGGFKRSKQEMESISTGLGSKSKPCTKFFSTSGCPFGDNCHFLHYVPGGYNAAAQMTNLRPPVSQVSRNMQGSGGPGGRFSGRGDPGSGPVSIFGASTSKISVDASLAGAIIGKGGIHSKQICRETGAKLSIKDHERDPNLKIIELEGTFEQINVASGMVRELIGRLGSVKKPQGIGGPEGKPHPGSNYKTKICDRYSKGNCTYGDRCHFAHGESELRRSGIA

SEQ ID NO: 1761 - DNA, 1209 bp, Arabidopsis thaliana
  G2967,family:Z-C2H2
atggaagacgaacatcaagatctccataaacccattaatggagctttgcgagacctcaagattactcggtcacagaaagaaacagaaaagtctacgaaccaacagcaagatgttacttgttactatggtctaagggaaaactcgaagaagaaaacccaggaatctccggaaccaatgaagaagattttgtttcgatgcgaagaatgtggaaaagggtttcggtacgagaaatattttaagaatcatcgctcgatgatgcatttatcgccgaacgagaaggtttgtgaagaatccttgatgactctgtctcgtagccttgggtttgtgaagaagaagaaaagatcaagacttggtaggtctgggaagactttatttactacgtttcttgaaccgagttctatttttgatgcgactgatgaagaattagaagtggcggattgtttgattctattgtctaagagtgctcccaaggttgtagacgaattgaaaagtctttctgaggcagtacgtgttactcctgaaacacctgaaagtagctatgatttgggttgtttgctcaacaagaaaccgagaaaaggtggtgaattggaatctggggttttaagtaatgagcaaagacttatggaagaagggtttagtagttatggaacatcgaaagaaccagctagcttcttgagagacgaaaacagattggatcagcagaaacggagaaaagatggtgaatttgaatccggacttttgagtaatgagcaaagactgctagaagaagagattactactcctgtgacattcaaaggtccagcgagttccttgagacacaagtgtgctttggatcgaaatggaggtgaatttggtcctgagtttttgagtaatgagcaaacactgatggaagaaacatggaaagaaccagtgagtttcttagaagataagcatgaatttgatcagcggaaaatgcgagaagctggcgactttgaatctaggttttacagaattgagcttggagtaggagctatggagtgtacttcttcagatactgatatgctcacgcaatctgataagaagaacgttgagcatcgatgcaggttgtgcaacaagatattctcgtcttatcaagctctagggggtcatcagacgtttcatcggatgagcaaatgtaagaacaagaagaatggcatagaggaatcagttgaacccaggatgactctgtga

SEQ ID NO: 1762 - protein, 402 aa, Arabidopsis thaliana
  G2967,Z-C2H2 domain coordinates 66-88,358-385
MEDEHQDLHKPINGALRDLKITRSQKETEKSTNQQQDVTCYYGLRENSKKKTQESPEPMKKILFRCEECGKGFRYEKYFKNHRSMMHLSPNEKVCEESLMTLSRSLGFVKKKKRSRLGRSGKTLFTTFLEPSSIFDATDEELEVADCLILLSKSAPKVVDELKSLSEAVRVTPETPESSYDLGCLLNKKPRKGGELESGVLSNEQRLMEEGFSSYGTSKEPASFLRDENRLDQQKRRKDGEFESGLLSNEQRLLEEEITTPVTFKGPASSLRHKCALDRNGGEFGPEFLSNEQTLMEETWKEPVSFLEDKHEFDQRKMREAGDFESRFYRIELGVGAMECTSSDTDMLTQSDKKNVEHRCRLCNKIFSSYQALGGHQTFHRMSKCKNKKNGIEESVEPRMTL

SEQ ID NO: 1763 - DNA, 1122 bp, Arabidopsis thaliana
  G2969,family:Z-C2H2
atggcggctcgaaaactagggtcgttgttacgtcaatactttttctctctatgcttcctcttcctcggttgcttcttcttccctaaagacgcagactataaacaaaagagaagaaagaagaagcttagaagagtttcttcttcttctggttcatctctatcctcttcttggacgtatttaaaacgagttttcttatccacgacaaggatatccaaatcccgtaaccaaacacatcctaacgttactttaacatccgcaagatcatctcaaaactccctcgtcactctcgtccaacccgataccacaaaccaacccgacccggaaacacgtattcatcagcaaaccgaattcgagatctcctcttccgacgagattttcccttgtaactcgtgtggcgagattttcccaaaaatcaatctcctcgagaatcacatcgcgatcaaacacgccgtgtcggagctaatcgccggagaatcaagcacgaacatcgtcaagatcatattcaaatctggttggccggagcaaggtaattacaaatctccggtgatcaatcgaatcttaaaaatccacaacagttcaaagattctcaccagattcgaagagtatcgtgagttcgtgaaagctaaagccgctcgtagcaacggcggtggaagacggtgggacgatgaacgttgcgtcgccgacggaaacgaacttttacgattttactgctcgacgtttatgtgtgatttagggcaaaacggtaaatcaaatctctgtggtcatcagtattgtagtatctgtggtatcatcggatctggattctcgccgaagctcgacgggatcgcgacgttggcgacggggtggagaggacacgtggcggttccggaggaggttgaagaagagtttgggtttatgaatgtgaaacgggccatgttggtttgtcgggttgtagcgggtcgggtcgggtgtgatttgattgatgatgatgacgtggataagagtgatggtggagggtatgattctctggttgggcagagtgggaacaagagtggggctctgttgaggatcgacgatgatgagcttttggtttttaatccaagggctgtgcttccttgttttgttattgtgtatactgtgtaa

SEQ ID NO: 1764 - protein, 373 aa, Arabidopsis thaliana
  G2969,Z-C2H2 domain coordinates 128-150
MAARKLGSLLRQYFFSLCFLFLGCFFFPKDADYKQKRRKKKLRRVSSSSGSSLSSSWTYLKRVFLSTTRISKSRNQTHPNVTLTSARSSQNSLVTLVQPDTTNQPDPETRIHQQTEFEISSSDEIFPCNSCGEIFPKINLLENHIAIKHAVSELIAGESSTNIVKIIFKSGWPEQGNYKSPVINRILKIHNSSKILTRFEEYREFVKAKAARSNGGGRRWDDERCVADGNELLRFYCSTFMCDLGQNGKSNLCGHQYCSICGIIGSGFSPKLDGIATLATGWRGHVAVPEEVEEEFGFMNVKRAMLVCRVVAGRVGCDLIDDDDVDKSDGGGYDSLVGQSGNKSGALLRIDDDELLVFNPRAVLPCFVIVYTV

SEQ ID NO: 1765 - DNA, 999 bp, Arabidopsis thaliana
  G2972,family:Z-C2H2
atgtctcagagacttcatggttgcaaaacatgcgggagaaagtttggaactttaaaaggtgtgtatggtcaccagaggatgcattctggtaatcacaatagaatcgaagatgagaatggtttggaaaggatttggggtcttaagaagaagtctagggtttgctctgtttcagcttttgatcgattcaaaggatcttcttttatggctgagattgagaaacatgaggtgattgaagctgcattgaacttggttatgttgtgtcaaggagtttatgactttgcttctatcagtaatttgcctctaggtgatggtttcatggatttagagcttaaaccttgtcctttgagaaggaaactacagaaaaaatctcgctccagttataaatgcagtatatgtgagaagagttttgtgtgttctcaagctcttggtagtcaccagagacttcacagatggaaactagtgcctaaacctgagtacattgaagatgatagttcactgttagactcatcagaagctaagaagattgtttcaaaaccatcaagctttgaacatgctcaggaggagaagatcttacaatgtgttgagccgaaactagagttccacgaacagcttgctcactcgggtttcgacaagtttgatacttgcagtaaaatcaggttcagtgcattaccttctcctccagaagctaagaagattgtttcacaaccaccaagctttgaagtctctgtggatgaaaagatcttatatcgtgctgagccaaaactaaacttcagcgaaccgcttgctcactcgtgtttcgacaattctagtagctatagaagcataatatgtggcaagagttttgtgtgttcacaagcattaggtggtcaccaaacacttcacagatcgattaaaggccaattagcgggtactgaagatggtaattcactctctgtgactgactcagaagctagcaagattgttgcacaaccatcaagctacaagtctcaggggatataa

SEQ ID NO: 1766 - protein, 332 aa, Arabidopsis thaliana
  G2972,Z-C2H2 domain coordinates 8-32,129-149,277-294
MSQRLHGCKTCGRKFGTLKGVYGHQRMHSGNHNRIEDENGLERIWGLKKKSRVCSVSAFDRFKGSSFMAEIEKHEVIEAALNLVMLCQGVYDFASISNLPLGDGFMDLELKPCPLRRKLQKKSRSSYKCSICEKSFVCSQALGSHQRLHRWKLVPKPEYIEDDSSLLDSSEAKKIVSKPSSFEHAQEEKILQCVEPKLEFHEQLAHSGFDKFDTCSKIRFSALPSPPEAKKIVSQPPSFEVSVDEKILYRAEPKLNFSEPLAHSCFDNSSSYRSIICGKSFVCSQALGGHQTLHRSIKGQLAGTEDGNSLSVTDSEASKIVAQPSSYKSQGI

SEQ ID NO: 1767 - DNA, 1331 bp, Arabidopsis thaliana
  G2979,family:E2F
gaaatttctcgtcctctttctctgttttttgtttctggggaaaatgtcttctgcgattgttgtttctcaagatgcggaatcgcttggtctgcaaatttatagccgcaaggagaaatctcttggggttctcgtctccaatttcctgagactgtataaccgagacgatgtggatctcattgggctcgatgatgccgctgggcaattaggagttgaaaggcggcgtatctatgatgtggtcaatatattggagagtattgggattgtggcaagaagagggaagaatcaatactcgtggaaaggttttggagagattcctcgttctctagatgaactcaaggaagaagggatgagagagaggttaggttactcaagttcaaacaattcagacaaggtttcaaatggttgtgaaagagaagaacctttaactttaacacctgatgatcaggagaactcatcatcctctaaaatggaccaaaagaaggaaaaatctctctggcttctcgcacagaattttgtgaagatgtttctatgttctgatgatgatctcatcacacttgatagtgctgcaaaagccttgctgagcgactctccagattcagtccatatgcgaactaaagttagaagactttacgacattgcaaatgtatttgcctcgatgaatttaatcgagaagactcatataccagtgactaggaaaccagcatataggtggttagggtccaaaagcatagctgaaagaggattaagcttatttaattccggagaaccgaagcgggtatttggaacagagatcacaaacttgagggcaaagagaaacaaaacatattgttcatcaatccgcaagcaaattggatataagaaacatgacgaggaaaacacagagcaggaatcgaaaccagctgcaagtaaatatgtgtttggcccgttctccccaataggagcatctaagacgaacaacgacaaagtcggaaagggaaggttactagagatcgaggcccttgcttctacctaccaaccacagtattgcaatcaagaaataactggtcttcttgggcatttcacggaggcatggaagaaatggtatgcagaggttgatcggaataaataacattactgaggtcacatgttttctctgggtacatgagagcacataactcatccaacatatagctttagtctttgtttgccttaaacaatagtaagaaacagagtattgttattgttaataaaagtcacacccaacaaattccgagtgactttgttctatacttgattcgaattcctatcctctccttaacttaatataaatgtttaatccatccaaaaaaaaa

SEQ ID NO: 1768 - protein, 354 aa, Arabidopsis thaliana
  G2979,E2F domain coordinates 192-211
MSSAIVVSQDAESLGLQIYSRKEKSLGVLVSNFLRLYNRDDVDLIGLDDAAGQLGVERRRIYDVVNILESIGIVARRGKNQYSWKGFGEIPRSLDELKEEGMRERLGYSSSNNSDKVSNGCEREEPLTLTPDDQENSSSSKMDQKKEKSLWLLAQNFVKMFLCSDDDLITLDSAAKALLSDSPDSVHMRTKVRRLYDIANVFASMNLIEKTHIPVTRKPAYRWLGSKSIAERGLSLFNSGEPKRVFGTEITNLRAKRNKTYCSSIRKQIGYKKHDEENTEQESKPAASKYVFGPFSPIGASKTNNDKVGKGRLLEIEALASTYQPQYCNQEITGLLGHFTEAWKKWYAEVDRNK

SEQ ID NO: 1769 - DNA, 1158 bp, Arabidopsis thaliana
  G2981,family:E2F
atgacaactactgggtctaattctaatcacaaccaccatgaaagcaataataacaacaataaccctagtactaggtcttggggcacggcggtttcaggtcaatctgtgtctactagcggcagtatgggctctccgtcgagccggagtgagcaaaccatcaccgttgttacatctactagcgacactacttttcaacgcctgaataatttggacattcaaggtgatgatgctggttctcaaggagcttctggtgttaagaagaagaagaggggacagcgtgcggctggtccagataagactggaagaggactacgtcaatttagtatgaaagtttgtgaaaaggtggaaagcaaaggaaggacaacttacaatgaggttgcagacgagcttgttgctgaatttgcacttccaaataacgatggaacatcccctgatcagcaacagtatgatgagaaaaacataagacgaagagtatatgatgctttaaacgtcctcatggctatggatataatatccaaggataaaaaagaaattcaatggagaggtcttcctcggacaagcttaagcgacattgaagaattaaagaacgaacgactctcacttaggaacagaattgagaagaaaactgcatattcccaagaactggaagaacaatatgtaggccttcagaatctgatacagagaaatgagcacttatatagctcaggaaatgctcccagtggcggtgttgctcttccttttatccttgtccagactcgtcctcacgcaacagtagaagtggagatatcagaagatatgcagctcgtgcattttgatttcaacagcactccatttgagctccacgacgacaattttgtcctcaagactatgaagttttgtgatcaaccgccgcaacaaccaaacggtcggaacaacagccagctggtttgtcacaatttcacgccagaaaaccctaacaaaggccccagcacaggtccaacaccgcagctggatatgtacgagactcatcttcaatcgcaacaacatcagcagcattctcagctacaaatcattcctatgcctgagactaacaacgttacttccagcgctgatactgctccagtgaaatccccgtctcttccagggataatgaactccagcatgaagccggagaattga

SEQ ID NO: 1770 - protein, 385 aa, Arabidopsis thaliana
  G2981,E2F domain coordinates 155-173
MTTTGSNSNHNHHESNNNNNNPSTRSWGTAVSGQSVSTSGSMGSPSSRSEQTITVVTSTSDTTFQRLNNLDIQGDDAGSQGASGVKKKKRGQRAAGPDKTGRGLRQFSMKVCEKVESKGRTTYNEVADELVAEFALPNNDGTSPDQQQYDEKNIRRRVYDALNVLMAMDIISKDKKEIQWRGLPRTSLSDIEELKNERLSLRNRIEKKTAYSQELEEQYVGLQNLIQRNEHLYSSGNAPSGGVALPFILVQTRPHATVEVEISEDMQLVHFDFNSTPFELHDDNFVLKTMKFCDQPPQQPNGRNNSQLVCHNFTPENPNKGPSTGPTPQLDMYETHLQSQQHQQHSQLQIIPMPETNNVTSSADTAPVKSPSLPGIMNSSMKPEN

SEQ ID NO: 1771 - DNA, 1267 bp, Arabidopsis thaliana
  G2982,family:E2F
tgtttgtttatagcgggaactctcacccaaagtaatttcatctccgattttttttttttggttgttgttcgcatctctgtgtaataaaaagagtaaaaccaaaaccctagaaaaaaaatctccatctttttttattccgccattggaagatcgatcactgagaaggatgagtatggagatggagttgtttgtcactccagagaagcagaggcaacatccttcagtgagcgttgagaaaactccagtgagaaggaaattgattgttgatgatgattctgaaattgggtcagagaagaaagggcaatcaagaacttctggaggcgggcttcgtcaattcagtgttatggtttgtcagaagttggaagccaagaagataactacttacaaggaggttgcagacgaaattatttcagattttgccacaattaagcaaaacgcagagaagcctttgaatgaaaatgagtacaatgagaagaacataaggcggagagtctacgatgcgctcaatgtgttcatggcgttggatattattgcaagggataaaaaggaaatccggtggaaaggacttcctattacctgcaaaaaggatgtggaagaagtcaagatggatcgtaataaagttatgagcagtgtgcaaaagaaggctgcttttcttaaagagttgagagaaaaggtctcaagtcttgagagtcttatgtcgagaaatcaagagatggttgtgaagactcaaggcccagcagaaggatttaccttaccattcattctacttgagacaaaccctcacgcagtagtcgaaatcgagatttctgaagatatgcaacttgtacacctcgacttcaatagcacacctttctcggtccatgatgatgcttacattttgaaactgatgcaagaacagaagcaagaacagaacagagtatcttcttcttcatctacacatcaccaatctcaacatagctccgctcattcttcatccagttcttgcattgcttctggaacctcaggcccggtttgctggaactcgggatccattgatactcgctgaccgagcttctattcccaaattcttcaagaagaagaagtaatgatctaattggtatactaaaaaattatacatctggtttagtgttcaattgagagagactgtaaaatcaattcataggccaacaaatgtttgtttatccaattttcctttttattcgaacttgatgcgatatttcaacggaaacagaaactattgttttaaaccaaaaaaaaaaaaaaaaaa

SEQ ID NO: 1772 - protein, 292 aa, Arabidopsis thaliana
  G2982,E2F domain coordinates 107-124
MSMEMELFVTPEKQRQHPSVSVEKTPVRRKLIVDDDSEIGSEKKGQSRTSGGGLRQFSVMVCQKLEAKKITTYKEVADEIISDFATIKQNAEKPLNENEYNEKNIRRRVYDALNVFMALDIIARDKKEIRWKGLPITCKKDVEEVKMDRNKVMSSVQKKAAFLKELREKVSSLESLMSRNQEMVVKTQGPAEGFTLPFILLETNPHAVVEIEISEDMQLVHLDFNSTPFSVHDDAYILKLMQEQKQEQNRVSSSSSTHHQSQHSSAHSSSSSCIASGTSGPVCWNSGSIDTR

SEQ ID NO: 1773 - DNA, 750 bp, Arabidopsis thaliana
  G2983,family:HB
atgaaggttcatgagttttcgaatgggttttcttcatcgtgggatcaacatgactcgacatcatcccttagcctaagctgcaaacgcctccgtcctctcgcccctaagctctccggcagccctccctcccctccttcttcttcctccggcgtcacttcagccacttttgaccttaaaaacttcattagacccgatcaaaccggtccgacaaaatttgaacacaaacgagaccctcctcatcaaacgcacccgggagggacaaggtggaacccgactcaagaacagatagggatacttgagatgttgtacaaaggtggaatgcgtactcctaatgctcaacagattgagcatatcacattgcaactcggtaagtacgggaaaatcgaagggaaaaatgtgttctattggttccagaaccacaaagcccgcgagagacagaagcagaagaggaacaacctcatcagcctaagttgccaaagcagcttcacgaccactggtgtctttaatccgagtgtaactatgaagacaagaacatcatcgtcactagacattatgagagaaccaatggtggagaaggaggagttagtggaagagaatgagtacaagaggacatgtaggagctggggatttgagaacttggagatagagaacaggagaaacaaaaatagtagtactatggcaactacttttaataaaatcattgacaatgtaaccctcgagctttttcctctccatcctgaagggagatga

SEQ ID NO: 1774 - protein, 249 aa, Arabidopsis thaliana
  G2983,HB domain coordinates 88-148
MKVHEFSNGFSSSWDQHDSTSSLSLSCKRLRPLAPKLSGSPPSPPSSSSGVTSATFDLKNFIRPDQTGPTKFEHKRDPPHQTHPGGTRWNPTQEQIGILEMLYKGGMRTPNAQQIEHITLQLGKYGKIEGKNVFYWFQNHKARERQKQKRNNLISLSCQSSFTTTGVFNPSVTMKTRTSSSLDIMREPMVEKEELVEENEYKRTCRSWGFENLEIENRRNKNSSTMATTFNKIIDNVTLELFPLHPEGR

SEQ ID NO: 1775 - DNA, 1011 bp, Arabidopsis thaliana
  G2989,family:ZF-HB
taagcttaacataaaccctaatattttcttgatttttttcaagaaaataaaaacataaagatgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtgaagaagaaaacat

SEQ ID NO: 1776 - protein, 312 aa, Arabidopsis thaliana
  G2989,ZF-HB domain coordinates 50-105,192-255
MLEVRSMDMTPKSPEPESETPTRIQPAKPISFSNGIIKRHHHHHHNNNKVTYKECLKNHAAAIGGHALDGCGEFMPSPSSTPSDPTSLKCAACGCHRNFHRRETDDSSAVPPPSLLPSSTTTAAIEYQPHHRHHPPPPLAPPLPRSPNSSSPPPISSSYMLLALSGNNKTAPFSDLNFAAAANHLSATPGSRKRFRTKFSSNQKEKMHEFADRIGWKIQKRDEDEVRDFCREIGVDKGVLKVWMHNNKNSFKFSGGGATTVQRNDNGIGGENSNDDGVRGLANDGDGGGGRFESDSGGADGGGNVNASSSSS

SEQ ID NO: 1777 - DNA, 1107 bp, Arabidopsis thaliana
  G2990,family:ZF-HB
agtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcggata

SEQ ID NO: 1778 - protein, 334 aa, Arabidopsis thaliana
  G2990,ZF-HB domain coordinates 54-109,200-263
MMDMTPTITTTTTPTPKSPEPESETPTRIQPAKPISFSNGIIKRHHHHHHPLLFTYKECLKNHAAALGGHALDGCGEFMPSPSSISSDPTSLKCAACGCHRNFHRRDPDNNNDSSQIPPPPSTAVEYQPHHRHHPPPPPPPPPPRSPNSASPPPISSSYMLLSLSGTNNNNNNLASFSDLNFSAGNNHHHHHQHTLHGSRKRFRTKFSQFQKEKMHEFAERVGWKMQKRDEDDVRDFCRQIGVDKSVLKVWMHNNKNTFNRRDIAGNEIRQIDNGGGNHTPILAGEINNHNNGHHGVGGGGELHQSVSSGGGGGGFDSDSGGANGGNVNGSSSS

SEQ ID NO: 1779 - DNA, 914 bp, Arabidopsis thaliana
  G2991,family:ZF-HB
aagtttacaaaacatttcttcttcttgtttttcgaaaccctaaatgttttgagttgtcatggatgtaatagctactacaactactatagtatccgacttggattcacgacaacccgaaatcgaagctccgatccggatccagcccgcgaagcctatttctttctcaaacggcaaacgctgccaccaccatcatcttgcatctgaagcggttgcggttgcgacttataaagaatgtctaaagaatcacgcagcaggtatcggcggtcacgctttagacggatgcggcgagtttatgccgtcaccgtcgtttaactccaatgaccccgcttcactaacgtgcgctgcttgtggttgccaccgtaacttccaccgccgtgaggaggatccatcttctctctctgccatcgtccctgcgatcgaatttcgacctcacaaccgtcaccagcttcctccaccgcctcctcctcatctggcggggattcgtagtccagacgacgatgattcagcttctccaccgccgatctcgtcttcttacatgcttctcgcactctctggaggaagaggaggagctaacacggcggttccaatgtctaggaaacgttttaggacgaagtttagtcagtatcagaaggagaagatgttcgagttctcggagagagttgggtggaggatgccgaaagctgatgacgtggtggttaaggagttttgtcgggagattggagttgataaaagcgttttcaaagtgtggatgcataacaacaagatttcaggacgcagcggcgctagaagagctaacggcggagtagtagtaggaggagtaggagatagtcgtcagagtgttgttccgacaaatgggtcgttttcttcgacgtgaggaaaagaatggaaagcgttgaaaaagcgtcgtcgtttta

SEQ ID NO: 1780 - protein, 271 aa, Arabidopsis thaliana
  G2991,ZF-HB domain coordinates 54-109,179-242
MDVIATTTTIVSDLDSRQPEIEAPIRIQPAKPISFSNGKRCHHHHLASEAVAVATYKECLKNHAAGIGGHALDGCGEFMPSPSFNSNDPASLTCAACGCHRNFHRREEDPSSLSAIVPAIEFRPHNRHQLPPPPPPHLAGIRSPDDDDSASPPPISSSYMLLALSGGRGGANTAVPMSRKRFRTKFSQYQKEKMFEFSERVGWRMPKADDVVVKEFCREIGVDKSVFKVWMHNNKISGRSGARRANGGVVVGGVGDSRQSVVPTNGSFSST

SEQ ID NO: 1781 - DNA, 729 bp, Arabidopsis thaliana
  G2992,family:ZF-HB
atggatttgtcttccaaaccacaacaacaacttctaaactctcttcccatcgccggagaactaactgtcaccggagaaatgggtgtttgttacaaagagtgtttgaaaaaccacgcggctaatctcggcggccatgctctcgacggttgcggcgagtttatgccgagtcccacggctacttccaccgatccttcttctctccgttgcgctgcttgtggctgccaccgtaacttccaccgccgtgacccttccgagaatctcaacttcctcaccgcgcctccgatttcttctccctccggcactgagtcgccgccgtctcgtcacgtgtcttctcctgttccttgctcttactacacctcagctcctccacatcacgtgattctctctctcagctccggtttccctggaccgtcagatcaagatccaacggtggttaggtcagagaacagttcaagaggagcaatgaggaaacgaacaagaaccaaattcacgccggagcagaagatcaagatgagagccttcgcagagaaagctggttggaaaatcaacggatgtgatgaaaagtcggtgagagagttttgtaacgaagttgggattgagagaggagttcttaaagtgtggatgcataacaacaagtactcacttctcaatggcaagatcagagagatcgaacatggcctgtgtctgaacactcacagcaatgatggtgatgggtcttcatcttcttga

SEQ ID NO: 1782 - protein, 242 aa, Arabidopsis thaliana
  G2992,ZF-HB domain coordinates 29-84,156-219
MDLSSKPQQQLLNSLPIAGELTVTGEMGVCYKECLKNHAANLGGHALDGCGEFMPSPTATSTDPSSLRCAACGCHRNFHRRDPSENLNFLTAPPISSPSGTESPPSRHVSSPVPCSYYTSAPPHHVILSLSSGFPGPSDQDPTVVRSENSSRGAMRKRTRTKFTPEQKIKMRAFAEKAGWKINGCDEKSVREFCNEVGIERGVLKVWMHNNKYSLLNGKIREIEHGLCLNTHSNDGDGSSSS

SEQ ID NO: 1783 - DNA, 1144 bp, Arabidopsis thaliana
  G2993,family:ZF-HB
tctctttctctctctctctctctctctctttatcttctttcttcaaagtctatcactttataaaaccctaattaaatctctaaactccttagcctctctctattctcagaaccttgtggttattctcaagaaaggtttcattttgagataaagtttgctgctctttctggttgtggatagatcaaaagaatggagattgcaagtcaagaagatcctattccaataaacactagttatggtaatagtggaggtgggcatgggaacatgaaccatcatcatcatgccaattctgcaccatcatctctcaacattactacttcaaacccactactagtctcctcaaatagtaatggtcttggtaaaaatcatgatcattctcatcatcatcatgtgggttacaacatcatggttaccaacatcaagaaagagaagcctgtggtgataaagtacaaggaatgcctaaagaaccatgcagctaccatgggaggcaatgccattgatggttgtggagagtttatgccaagtggtgaagaaggttccattgaagctctcacttgctcagtttgcaactgccatagaaactttcatagaagagaaaccgaaggtgaagagaaaacattcttttccccttacctcaaccaccaccaaccacctccgcagcagagaaaactcatgttccaccacaagatgatcaaatcaccattaccacaacaaatgataatgcctattggcgttacaaccgctggatccaactcagagtcagaggatcttatggaggaagaaggcggaggaagcttgacattccggcagccaccaccaccaccatcaccgtatagttacggacataatcagaagaaaaggtttaggacaaagtttacacaagagcaaaaggagaagatgattagttttgcggaaagagttggttggaagattcagagacaagaggaatctgttgttcaacagctttgtcaagagattggaattaggagaagagttcttaaagtttggatgcacaacaacaaacaaaatctctccaagaagagcaacaacgttagtaacaatgtcgacctttctgctggtaataacgacattactgaaaatcttgcttctactaatccttagttaagttcagattgttgttata

SEQ ID NO: 1784 - protein, 310 aa, Arabidopsis thaliana
  G2993,ZF-HB domain coordinates 85-138,222-285
MEIASQEDPIPINTSYGNSGGGHGNMNHHHHANSAPSSLNITTSNPLLVSSNSNGLGKNHDHSHHHHVGYNIMVTNIKKEKPVVIKYKECLKNHAATMGGNAIDGCGEFMPSGEEGSIEALTCSVCNCHRNFHRRETEGEEKTFFSPYLNHHQPPPQQRKLMFHHKMIKSPLPQQMIMPIGVTTAGSNSESEDLMEEEGGGSLTFRQPPPPPSPYSYGHNQKKRFRTKFTQEQKEKMISFAERVGWKIQRQEESVVQQLCQEIGIRRRVLKVWMHNNKQNLSKKSNNVSNNVDLSAGNNDITENLASTNP

SEQ ID NO: 1785 - DNA, 1083 bp, Arabidopsis thaliana
  G2994,family:ZF-HB
ccccaaaccaagaaacaatttgcaaagagaaagcaaaaggtttttgaagaagacccaattaaaaaagatggaaattgcaagtcaagaagatcatgatatgcccatcccattaaacactacatttggtggtggtggtagtcatggtcacatgatccatcatcatgatcatcatgctgctaattctgctcctccaactcacaacaacaacaatactactcaaccacctccaatgccgttacatggtaatggtcatggcaacaattatgatcatcatcatcatcaagatcctcatcatgttggttacaacgctatcatcaagaagcctatgataaagtacaaggagtgtctcaagaaccatgcagcagctatgggaggcaatgctactgatgggtgtggagagtttatgccaagtggtgaagatggctccattgaggctctcacttgctcagcttgcaattgccacaggaacttccatagaaaagaagtggaaggcgaactcgcagccaccgccatgtccccttaccaccaacaccctccacaccgaaaactcatgctcaaccaccaaaagatcagatcagctatgccacaccaaatgatcatgcccattggagtctctaactaccggtacatgcataacaactccgagtccgaggactttatggaggaagatggcgtaaccaccgcatctagatcgctaccaaacctgccatacaaccagaagaagaggttcaggacaaagttcacgccggaacagaaggagaagatgcttagttttgctgagaaagttgggtggaaaatacaaaggcaagaagattgtgttgttcaaaggttttgtgaagagattggagtgaagagaagagtgcttaaggtttggatgcacaacaacaagatccatttctccaagaagaacaacattaacctcgaagacaacgacaacgaaaagatcaacaatctcaacaatgttgatctgtccggtaataacgacatgactaagatcgtcccatgatataattaataacgttatttttatatgatctttgataattatttagttatctttatgttagctactagggttttaat

SEQ ID NO: 1786 - protein, 312 aa, Arabidopsis thaliana
  G2994,ZF-HB domain coordinates 88-141,218-281
MEIASQEDHDMPIPLNTTFGGGGSHGHMIHHHDHHAANSAPPTHNNNNTTQPPPMPLHGNGHGNNYDHHHHQDPHHVGYNAIIKKPMIKYKECLKNHAAAMGGNATDGCGEFMPSGEDGSIEALTCSACNCHRNFHRKEVEGELAATAMSPYHQHPPHRKLMLNHQKIRSAMPHQMIMPIGVSNYRYMHNNSESEDFMEEDGVTTASRSLPNLPYNQKKRFRTKFTPEQKEKMLSFAEKVGWKIQRQEDCVVQRFCEEIGVKRRVLKVWMHNNKIHFSKKNNINLEDNDNEKINNLNNVDLSGNNDMTKIVP

SEQ ID NO: 1787 - DNA, 886 bp, Arabidopsis thaliana
  G2996,family:ZF-HB
gtttcacatttctcgacttcttgaatggagtttgaagacaacaacaacaacaacgacgaagagcaagaagaggatatgaatcttcatgaggaagaagaagacgacgacgccgtttacgactctcctcctctctctcgtgttctccccaaagcctcgacagaaagtcatgaaaccaccggaactacttccacaggcggtggcggaggattcatggttgttcacggcggtggagggagcaggtttaggttccgtgagtgtctcaagaaccaagcggtgaacataggaggacacgcggtcgatggttgtggtgagtttatgccagctggaatcgaaggtaccatcgacgctctaaaatgcgccgcttgtggctgtcaccgtaacttccaccgcaaggaattaccttacttccatcacgcgccgccacaacatcagcctcctcctcccccgccagggttttaccgtcttccagctccggttagctaccgaccaccaccgtcacaagctcctcctcttcagctcgctcttccccctccacaaagagagagatcagaagatccaatggagacgtcttcagctgaagcaggaggagggattaggaagaggcataggactaagtttacggctgagcaaaaggaaaggatgttagctttagctgagaggattggatggagaattcagagacaagacgatgaagtgattcagagattttgtcaggagactggtgttccgagacaagttcttaaggtttggttacataacaacaaacacactcttggtaagtcgccttcaccacttcatcatcatcaggctcctcctcctccaccaccacagtcttcgtttcatcatgaacaagaccaaccatgaatcttgaatttctttgatcact

SEQ ID NO: 1788 - protein, 279 aa, Arabidopsis thaliana
  G2996,ZF-HB domain coordinates 73-126,191-254
MEFEDNNNNNDEEQEEDMNLHEEEEDDDAVYDSPPLSRVLPKASTESHETTGTTSTGGGGGFMVVHGGGGSRFRFRECLKNQAVNIGGHAVDGCGEFMPAGIEGTIDALKCAACGCHRNFHRKELPYFHHAPPQHQPPPPPPGFYRLPAPVSYRPPPSQAPPLQLALPPPQRERSEDPMETSSAEAGGGIRKRHRTKFTAEQKERMLALAERIGWRIQRQDDEVIQRFCQETGVPRQVLKVWLHNNKHTLGKSPSPLHHHQAPPPPPPQSSFHHEQDQP

SEQ ID NO: 1789 - DNA, 895 bp, Arabidopsis thaliana
  G2997,family:ZF-HB
atactcttaactctcatgaattattggtctctctattatagttttttaagtaacaatctaattgtagtacggatgtctcttgagatgttcaagaattaagaaataaagaaagagggatcggagaatgaattttgaggatcaagaagaagatatggagatgtcaggtgttaatcccccctgcggttacgactctctaagcggtgagggagccacatctagtggtggtggaggagtaggaaggagtaaaggagttggagcgaagataaggtatagagagtgcttgaagaaccatgctgttaacataggtggccacgccgtggacggttgttgcgagtttatgccttccggtgaagatggaacgctcgacgctcttaagtgtgcagcttgcggctgccaccgcaacttccaccgcaaggaaaccgaaagcatcggcggtagagcccacagagttcccacgtactacaaccgcccgccgcagccgcatcagccgcctggatatcttcatctaacatctcccgcggcgccttacaggccacccgcggcatcgggggacgaggaggatacatcaaatcctagcagcagcggcgggaccacgaagaggtttagaacgaagttcacggcggaacagaaagagaagatgttagcctttgcggagaggttggggtggagaattcagaagcatgatgacgtggcggttgagcagttctgtgcggagactggtgttaggagacaagtgcttaaaatctggatgcataacaacaagaactctcttggtaagaaaccctaattttgctcgagacatgatttaaaacactagaggatcataattgtttctttttttggtatgactcttctgtaactacttctgcttattagttatgttattttttcctgg

SEQ ID NO: 1790 - protein, 220 aa, Arabidopsis thaliana
  G2997,ZF-HB domain coordinates 47-100,157-220
MNFEDQEEDMEMSGVNPPCGYDSLSGEGATSSGGGGVGRSKGVGAKIRYRECLKNHAVNIGGHAVDGCCEFMPSGEDGTLDALKCAACGCHRNFHRKETESIGGRAHRVPTYYNRPPQPHQPPGYLHLTSPAAPYRPPAASGDEEDTSNPSSSGGTTKRFRTKFTAEQKEKMLAFAERLGWRIQKHDDVAVEQFCAETGVRRQVLKIWMHNNKNSLGKKP

SEQ ID NO: 1791 - DNA, 930 bp, Arabidopsis thaliana
  G2998,family:ZF-HB
atggatatgagaagccatgaaatgatagagagaagaagagaagacaatggcaacaacaatggtggtgttgttattagtaacatcattagtactaatattgatgataattgcaatggtaataacaacaacactcgtgtctcttgcaactctcaaaccctagatcaccaccaatccaagtctccctcttcgttttccatctccgccgcagctaaacccaccgtaagataccgtgagtgtctaaagaatcatgcggcgagcgtcggcggaagtgttcacgacggatgcggcgagtttatgccgagtggtgaagaaggaacaatcgaagctctcagatgcgctgcttgtgattgtcaccgtaatttccaccggaaagaaatggacggcgttggaagctcggatttgatctctcaccaccgtcatcaccactaccaccataaccaatacggtggaggaggagggagaagacctccgccgccgaatatgatgcttaacccactcatgcttcctccgccaccgaattatcagccgattcaccaccacaagtatggaatgagtcctcccggaggaggaggaatggtgacgccgatgagcgttgcttacggcggtggaggaggaggagctgagtcgtctagtgaagatctgaatctgtacggacaatcaagcggagaaggagctggtgcggcggcgggacaaatggcgttttcgatgtcgtcgtctaagaaaagattcaggacaaagttcacgacggatcagaaggagaggatgatggactttgcggagaagctagggtggaggatgaacaagcaagacgaagaagagcttaagagattctgcggcgagatcggagtgaagagacaagtcttcaaagtttggatgcataacaacaagaacaatgctaagaaaccaccaacaccaacaactactctctaa

SEQ ID NO: 1792 - protein, 309 aa, Arabidopsis thaliana
  G2998,ZF-HB domain coordinates 74-127,240-303
MDMRSHEMIERRREDNGNNNGGVVISNIISTNIDDNCNGNNNNTRVSCNSQTLDHHQSKSPSSFSISAAAKPTVRYRECLKNHAASVGGSVHDGCGEFMPSGEEGTIEALRCAACDCHRNFHRKEMDGVGSSDLISHHRHHHYHHNQYGGGGGRRPPPPNMMLNPLMLPPPPNYQPIHHHKYGMSPPGGGGMVTPMSVAYGGGGGGAESSSEDLNLYGQSSGEGAGAAAGQMAFSMSSSKKRFRTKFTTDQKERMMDFAEKLGWRMNKQDEEELKRFCGEIGVKRQVFKVWMHNNKNNAKKPPTPTTTL

SEQ ID NO: 1793 - DNA, 891 bp, Arabidopsis thaliana
  G2999,family:ZF-HB
tattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 1794 - protein, 262 aa, Arabidopsis thaliana
  G2999,ZF-HB domain coordinates 80-133,198-261
MEVREKKDEKMEMTRRKSSALDHHRLPPYTYSQTANKEKPTTKRNGSDPDPDPDLDTNPISISHAPRSYARPQTTSPGKARYRECQKNHAASSGGHVVDGCGEFMSSGEEGTVESLLCAACDCHRSFHRKEIDGLFVVNFNSFGHSQRPLGSRHVSPIMMSFGGGGGCAAESSTEDLNKFHQSFSGYGVDQFHHYQPKKRFRTKFNEEQKEKMMEFAEKIGWRMTKLEDDEVNRFCREIKVKRQVFKVWMHNNKQAAKKKDL

SEQ ID NO: 1795 - DNA, 1064 bp, Arabidopsis thaliana
  G3000,family:ZF-HB
atgggtgataggaaacaaacacacatacgtcatcatcatccttaatttctatttctccttcttcttcatcatcaatatcaatctcatcttccactactcctcccctctaacaataagcagcatctctataatccctaagattcacaatggagcttggaggaaaatgcaatgcaattacaaccacaacaatgatctcaacagaagtaaagccacatacggatccggaaccagaagccaaacccgaatcagatccatccatggctttattcccgatcaagaaagaaaaccaaaaaccaaagacacgtgtcgaccaaggagctaagtaccgggaatgtcagaagaaccacgcggcctcaaccggaggacacgtggtggacggatgctgcgagttcatggccggcggagaagaaggtacactcggtgctttaaaatgcgccgcctgtaactgtcaccggagcttccaccggaaagaagtgtacggacacaggaacagtaaacaagatcatcagctgatgataactccggcgttttacagcagtaacagctcgtacaagccacgtgtaatgcatccaacgggtgagattggacggaggacttcatcttcaagcgaggatatgaagaagattctgagtcatcgtaaccaaaacgttgatgggaaaagtttgatgatgatgatgatgaggaagaagaagagagtgaggacaaagatcaatgaagaacaaaaggagaagatgaaggaatttgcagagagattagggtggaggatgcagaagaaagatgaagaagagattgataagttttgtaggatggtgaatctgaggagacaagtttttaaggtttggatgcataataacaagcaagcaatgaagagaaacaatagtaacattagtgaatagtttgatgatctgataaaagtgaaataaatttttacaatcctgttttgcttttatatataatttttgcccttcaaattattcaaaatcttgagtataaatctgtggaatcttgtatgttttgattgttttatattgtatctgggattatttttttcttttactaaaaaa

SEQ ID NO: 1796 - protein, 249 aa, Arabidopsis thaliana
  G3000,ZF-HB domain coordinates 58-111,181-244
MELGGKCNAITTTTMISTEVKPHTDPEPEAKPESDPSMALFPIKKENQKPKTRVDQGAKYRECQKNHAASTGGHVVDGCCEFMAGGEEGTLGALKCAACNCHRSFHRKEVYGHRNSKQDHQLMITPAFYSSNSSYKPRVMHPTGEIGRRTSSSSEDMKKILSHRNQNVDGKSLMMMMMRKKKRVRTKINEEQKEKMKEFAERLGWRMQKKDEEEIDKFCRMVNLRRQVFKVWMHNNKQAMKRNNSNISE

SEQ ID NO: 1797 - DNA, 721 bp, Arabidopsis thaliana
  G3002,family:ZF-HB
ccctaaacgcaaaaatcattactcaaaaaaaaacaaagtctctctcttctaattagagagccaagaagatgcagagtacttgtgtctacagagaatgcatgcgcaaccacgccgcgaagctcggctcttacgccatcgatggctgccgtgaatactctcaaccatccaccggcgatctctgcgtcgcctgtggttgccaccgcagctaccaccgtcgtatagacgtcatatcttctcctcaaatcaatcacacgcgcttcccgttcacgagcttaaggcgcgtgaagcagctggcgaggctgaaatggaaaacggctgaggaaagaaatgaggaggaggaggatgacacggaggagacttcgacggaagagaagatgacggtgcagaggcggaggaagtcaaagttcacggcggagcagagagaggcgatgaaagattacgcggcgaagttgggatggacgttgaaggataagagagcgcttagagaagagataagagtcttctgtgaagggattggtgttactcgttatcattttaaaacttgggttaacaataataaaaagttttatcactaactaattaactaatatccttaattgagataatactataatttagttccaatttcattttcatcccttctgtgttaatttctcctccttgatcgcttattttaatggattattattttatcaaaaaaaaaaaaaaaaaaaaaaaaaaa

SEQ ID NO: 1798 - protein, 168 aa, Arabidopsis thaliana
  G3002,ZF-HB domain coordinates 5-53,106-168
MQSTCVYRECMRNHAAKLGSYAIDGCREYSQPSTGDLCVACGCHRSYHRRIDVISSPQINHTRFPFTSLRRVKQLARLKWKTAEERNEEEEDDTEETSTEEKMTVQRRRKSKFTAEQREAMKDYAAKLGWTLKDKRALREEIRVFCEGIGVTRYHFKTWVNNNKKFYH

SEQ ID NO: 1799 - DNA, 912 bp, Arabidopsis thaliana
  G3003,family:Z-C2H2
atggagtcaccaccactatacgagatatcctcaagctcttcttctgaaaaacctagacaccatttccaatcccttgatctcttccctaacctcaaccaaaactcttgtatcaacaataccctaattgagcctttaccgcttattgatcgcataaacttgaactcaaacctagacctaaaccctaatcccttgtatgcggaagaaggagagcaagaggaggaagaagaagaagaagaagaccgtgaagtggacgtggacttacacatcggccttcctggttttggtaaaccaagcaatgatgctaaacagctgaagaagagaaatgggaaggagatcgccacatatgacgccggaaaaggcatcgagaatgaactttccggaaaggcatactggatcccggcgccggagcaaattctcatagggttcactcatttttcttgccatgtatgcttcaagacattcaatcgctacaacaatcttcagatgcacatgtggggacatggttcacaatacaggaaaggaccggagtcactgaaaggcacacagccacgagccatgttagggatcccttgttactgctgcgttgaagggtgcaggaacaacattgaccatcctcgttccaagccactgaaagactttaggacgctccaaacgcactacaaacgcaaacacggacacaaacccttctcgtgtcgcctttgcggtaagcttttggctgtcaagggcgattggcgaacacatgagaagaattgtggaaaacgttgggtttgcgtttgcggttctgattttaaacacaaacgttcccttaaggaccatgttaaggcgtttgggtctggtcatgggccttatccaactggtttgtttgaagagcaggcttctaattcatctgtctccgagactttttttttttaa

SEQ ID NO: 1800 - protein, 303 aa, Arabidopsis thaliana
  G3003,Z-C2H2 domain coordinates 131-280
MESPPLYEISSSSSSEKPRHHFQSLDLFPNLNQNSCINNTLIEPLPLIDRINLNSNLDLNPNPLYAEEGEQEEEEEEEEDREVDVDLHIGLPGFGKPSNDAKQLKKRNGKEIATYDAGKGIENELSGKAYWIPAPEQILIGFTHFSCHVCFKTFNRYNNLQMHMWGHGSQYRKGPESLKGTQPRAMLGIPCYCCVEGCRNNIDHPRSKPLKDFRTLQTHYKRKHGHKPFSCRLCGKLLAVKGDWRTHEKNCGKRWVCVCGSDFKHKRSLKDHVKAFGSGHGPYPTGLFEEQASNSSVSETFFF

SEQ ID NO: 1801 - DNA, 1416 bp, Arabidopsis thaliana
  G3008,family:EIL
atggtggaagtcgaagaattggaaccacttagtccaatggacgatgaagaagaagagataagctatgatgacctcaaaagacgcatgtggaaagaccgaaacctcatggaaaaaaagctcaagcaacagaaacgacacagcaacgacgtcgtttcgtttacaacacaccgagccgaagcttcacggcgcaagaagatggctcgttctcaagattcagtgttgaagtacatgatgaagatcatggaggtgtgtaaagctaaaggttttgtatacggaattgtaccggaaaagggtaaaccaataaccggttcttccgatagcttaagacgttggtggaaagaaaacgttcagttcgaccaaaacgctccagacgctatcacagattacttagcactcgcggctgctgctgctgcagcagagctaatcgataagtcctcatcatcctcgagcttattacacatgttacaggaactgcaagacacgacactagggtcgttactatcagcgttaatgcaacattgcatgccgccacagcggcggtttccgttagagaaaggaattgctccgccatggtggccgacggggacggagctttggtggggagaacaaggagcggcacatgagcacggtgcaccgccatatcgaaagccgcacgatttgagaaaatcttggaaagttagtgttctcgcggctgtgattaaacacatgtcgccgaatttgggaagagtgagacgtctggcgagacaatctaaaagtttgcaagataaaatgatggctaaagagactgatacttggtctcgtgtcttaaaccaagaagaagctcttctcaatatcaaagacctcaagatctcggaagatcaggacgatcaagaatcgtcggggtctaagagaaaaagtgagtctatggaaccgtctaagagtgtttacacttgccaaaactcgagttgtcctaaaagtgatgtgagttttggattcggggacaagaactcgaggacgggtcatgagatccagtgtctttatgggtcgaaccaagaaccgagccagagcggtgaatatacatcttccttgcttgaaacggttccaagtattgttactaattcgactagtgaagatgattattacaatgtgagctcgcgtgcactggacaagcgagatgatgatgatcatagcattaatgggaattggatggaatatttctggttagaaaagatgcagcaggagtttcattgctctaggagattcgaagatgatgagggtactggaacggactttgaccaactcacagaatctgatcgatcggacaacgtgaatttgaaccaacttacaaaatctgatcgatcggacaacgtgaaccggagtgctttttcagtttgggacatgggttgcgaggacaaagacatatacatgttcgattaa

SEQ ID NO: 1802 - protein, 471 aa, Arabidopsis thaliana
  G3008,EIL domain coordinates 10-275
MVEVEELEPLSPMDDEEEEISYDDLKRRMWKDRNLMEKKLKQQKRHSNDVVSFTTHRAEASRRKKMARSQDSVLKYMMKIMEVCKAKGFVYGIVPEKGKPITGSSDSLRRWWKENVQFDQNAPDAITDYLALAAAAAAAELIDKSSSSSSLLHMLQELQDTTLGSLLSALMQHCMPPQRRFPLEKGIAPPWWPTGTELWWGEQGAAHEHGAPPYRKPHDLRKSWKVSVLAAVIKHMSPNLGRVRRLARQSKSLQDKMMAKETDTWSRVLNQEEALLNIKDLKISEDQDDQESSGSKRKSESMEPSKSVYTCQNSSCPKSDVSFGFGDKNSRTGHEIQCLYGSNQEPSQSGEYTSSLLETVPSIVTNSTSEDDYYNVSSRALDKRDDDDHSINGNWMEYFWLEKMQQEFHCSRRFEDDEGTGTDFDQLTESDRSDNVNLNQLTKSDRSDNVNRSAFSVWDMGCEDKDIYMFD

SEQ ID NO: 1803 - DNA, 1133 bp, Arabidopsis thaliana
  G3017,family:HLH/MYC
tctgatcatcaaaataatcaagggtttgtgttttacccttccggggaaaccattgaagatcataattctttgatggatttcaatgcttcatcattcttcacctttgataatcaccgaagccttatctctcccgtgaccaacggtggtgccttcccggtcgtggacgggaacatgagttacagctatgatggctggagtcatcatcaagtggatagtattagccctagagtcatcaaaactccaaatagctttgaaacaacgagcagttttggattgacttcaaactccatgagtaaaccggccacaaaccatggaaatggagactggttatactctggttcaactattgtaaacatcggttcaaggcacgagtccacgtcccctaaactggctggcaataaacggcctttcacgggagagaacacacaactttcaaagaagccgagtagcggtacgaatggaaagatcaagcctaaggcaacaacttcacctaaagatccacaaagcctagcagccaagaaccgaagagaaaggataagcgaacgcctcaaggtattgcaagaacttgtaccgaatggtaccaaggtggatttggtaactatgcttgagaaagcaattggctatgtaaagtttcttcaagtacaagttaaggtacttgcagccgatgagttttggccggcacaaggagggaaagctccggacatttctcaagttaaagaagctattgacgcaatcctctcatcatcacaacgagatagtaactcaactagagaaacaagtatagcagaataattccgaccaaaacaaaaagtatagcagaataattagttactaaatgtatcggcattaattataataccaaacaagtcatcacttttgaattcggtttaaaaaatagttaattggtgacgttacagatcgagaagttattgattcctttaaggctttaattatgtaagagccaacacattgaagtcaccgacgatatgtcagacgtcggtccacacgagcatggaatcttatagtagattagatatgtaatagttatatatgtggaggtatgtttctatttttgtatgttttgtaattctccaagtatgcgtaatgtgatgttgcaaaagtttggtttctga

SEQ ID NO: 1804 - protein, 239 aa, Arabidopsis thaliana
  G3017,HLH/MYC domain coordinates 136-193
MDFNASSFFTFDNHRSLISPVTNGGAFPVVDGNMSYSYDGWSHHQVDSISPRVIKTPNSFETTSSFGLTSNSMSKPATNHGNGDWLYSGSTIVNIGSRHESTSPKLAGNKRPFTGENTQLSKKPSSGTNGKIKPKATTSPKDPQSLAAKNRRERISERLKVLQELVPNGTKVDLVTMLEKAIGYVKFLQVQVKVLAADEFWPAQGGKAPDISQVKEAIDAILSSSQRDSNSTRETSIAE

SEQ ID NO: 1805 - DNA, 713 bp, Arabidopsis thaliana
  G3021,family:HLH/MYC
tctctttctttgtctctctcatattctaagtttgctatatatgtaactttctcccttgtagactttcatttgcagcaaaaatagtttctcatatggagaggcaaatcataaacaggaagaaacgagtgttttctcttgaaccaaacaagaaccctagtgcagttttcacgagaaaatacacaagccacttggttcctgcactcaagaagctcaacatgaacaagaactcttcaaaacaaaccgtgaagcatgaagtagatatggctttggctttgtctgctcaagaatttgcatggagccgtttcttgctgcagaagctatcgtcctcatcgaatccaaccactaccactagttcttcttccgatggaattcggattcttgaaagacccgataaagaaggcggaaacgaagaaggagggatagaggagagactgagggaattgaagaagcttttgccaggtggggaagagatgaatgtggaagaaatgttgagtgagattggtaactacattaaatgtcttgagttgcagacgattgctctcaagtccattgttcaagatagtacttgacttttagtttaagtgtataatttatagtttgtttcatgttttttttgttgtctttaaacgaaaatcatctgtgtttttttttttctcttgatttctttaagaacaagagcatgtattatagtgtttttcttttttccttttctt

SEQ ID NO: 1806 - protein, 158 aa, Arabidopsis thaliana
  G3021,HLH/MYC domain coordinates 91-148
MERQIINRKKRVFSLEPNKNPSAVFTRKYTSHLVPALKKLNMNKNSSKQTVKHEVDMALALSAQEFAWSRFLLQKLSSSSNPTTTTSSSSDGIRILERPDKEGGNEEGGIEERLRELKKLLPGGEEMNVEEMLSEIGNYIKCLELQTIALKSIVQDST

SEQ ID NO: 1807 - DNA, 1202 bp, Arabidopsis thaliana
  G3032,family:GARP
gtaacaacgcagagtacgcggggaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaa

SEQ ID NO: 1808 - protein, 346 aa, Arabidopsis thaliana
  G3032,GARP domain coordinates 285-333
MTNLDEFLEELSSIESHSQKIVKIDEHLKKLDEETKEDEDEDAAKIIQDRSTAREAEIALLMDLRQNFLPPPSMSSSSLQPPSSSTLAPSSSSSLQPPAPLIDFFRSSVSYSHQPPSSSTLATSSSPSLQPPSMSSSSLQPPASLREFFTSSVSYSHQPSSSSTLATSSFFPSSMPYSVRPPDSSDRPSLREFFPSSPSSSIQPPESSSSKRARLSNIFPSPLSSSPSPFVNPFLRPQAQEPTIPNFINPIPQISPGLPALFPNPNPNPNPNPIPNPIRNPDLVWTNRLQLVFDDAVVRLGGLFSATPKAINELISEEGLTGDQIRSHLQVLRDRQKAIADKLALE

SEQ ID NO: 1809 - DNA, 1634 bp, Arabidopsis thaliana
  G3044,family:HLH/MYC
attctcaacttttctctgatttgctcgtgtgtttacttcaattcctcagttcttgtgtagaaagttgagtttcatgtgatcaaaattggggctttactacttttaagagaatgagtgacaaagacgagtttgccgcaaagaagaaggatttggtcaatacgccagtggatttgtatcctccggagaatccaatgttgggtccttctccgatgatggattcattcagagaaactctttggcatgatggtggtttcaatgtccacacagatgcagacacttcctttagaggtaataataatattgatatacctcttgaaatgggttggaatatggctcagttccctgcagattcaggattcattgagcgtgctgcaaagttttctttttttggatgtggtgaaatgatgatgaaccaacaacaatcatctcttggagttccagattcaactggcttgtttcttcaagatacacagattcctagtggatccaaactagataatggtcctcttactgatgcatctaagttagtgaaagagagatcgattaataatgtatcagaggattctcaatctagtggaggtaatggtcatgatgatgctaagtgtgggcaaacatcttccaaggggtttagtagtaagaagaggaaaagaattgggaaggattgtgaagaagaagaagataaaaagcaaaaggatgagcaaagtccaacttcaaatgcgaacaagacaaacagtgagaagcaaccttctgattctttaaaggatgggtatattcacatgagggcacgaagaggccaggctactaatagtcacagtcttgctgaaagagtaagaagagaaaaaatcagtgaaaggatgaagttcttgcaagatcttgtgccaggttgcgacaaggtgactggtaaggcagttatgctcgatgaaatcattaactatgtgcaatcacttcaatgccaaatcgagtttttatcgatgaaactttcggctgtgaatcctgtgctcgattttaacctcgaaagcctccttgcaaaagatgctcttcaatcatctgcaccgacatttccccacaacatgtcgatgctttatcctcctgtatcgtatctctctcaaacaggattcatgcaaccgaacatttcctcaatgtcgctattgagtggaggattaaaacggcaggaaacacatggatatgaaagtgatcaccacaatcttgtccacatgaaccatgaaaccggcactgcacctgatcatgaagatacaacagctgacatgaaggtggagccgtagatgtttcttcttcactttgtactcagctttagctgctgatatagtgcgccgcggtcgagaattttattaacttcgaacagaagagtgaaaacgaaacagaggaggaagcagattttgtctttgaaatattgacagctcccggagaaagagtcgagagtaagaatcaacaatgttgtgtaatgaatagctactgtctgcttcttttgtagctattgtctgcttcttttttgtacatataaatccatgcaagggaagaggaatgttaattcaacacatgtgcacaacatgatcatcacatatgtacttcaacttgatcaatcggaattagctctacttgtcaaaaaaaaaaaa

SEQ ID NO: 1810 - protein, 390 aa, Arabidopsis thaliana
  G3044,HLH/MYC domain coordinates 226-284
MSDKDEFAAKKKDLVNTPVDLYPPENPMLGPSPMMDSFRETLWHDGGFNVHTDADTSFRGNNNIDIPLEMGWNMAQFPADSGFIERAAKFSFFGCGEMMMNQQQSSLGVPDSTGLFLQDTQIPSGSKLDNGPLTDASKLVKERSINNVSEDSQSSGGNGHDDAKCGQTSSKGFSSKKRKRIGKDCEEEEDKKQKDEQSPTSNANKTNSEKQPSDSLKDGYIHMRARRGQATNSHSLAERVRREKISERMKFLQDLVPGCDKVTGKAVMLDEIINYVQSLQCQIEFLSMKLSAVNPVLDFNLESLLAKDALQSSAPTFPHNMSMLYPPVSYLSQTGFMQPNISSMSLLSGGLKRQETHGYESDHHNLVHMNHETGTAPDHEDTTADMKVEP

SEQ ID NO: 1811 - DNA, 543 bp, Arabidopsis thaliana
  G3054,family:Z-C3H
atgagtcatcggcgagattacggcagtgatgcagttcacgtgagaatcacccacgaccctccgcctgagaattgttttccaaattccggcgacagttccgtctgggccactgaggatgattacagccgtgtctgggccataaactctgatggcgcagagtctccgagcaagaagacacgatcttcctcctcctccgagatcgggaaatcgttcttcaagacgaagctttgcttcaaattccgcgccggaacttgtccctactccgcgagctcttgccactttgctcacagcgcggaggagctccgtcttcctccgccgccgccgcccaattggcaggagacggtgacagaggcttcaagaaacagagaaagctttgcggttagtttaggccctcgtggcaatgttgctcagactctcaagtctccgaattggaagacaaggatttgcaataagtggcagactactggctattgtccttttggttctcactgccattttgctcatggaccttcaggtaaagctacggcctttttcatctattag

SEQ ID NO: 1812 - protein, 180 aa, Arabidopsis thaliana
  G3054,Z-C3H domain coordinates 77-96,149-168
MSHRRDYGSDAVHVRITHDPPPENCFPNSGDSSVWATEDDYSRVWAINSDGAESPSKKTRSSSSSEIGKSFFKTKLCFKFRAGTCPYSASSCHFAHSAEELRLPPPPPPNWQETVTEASRNRESFAVSLGPRGNVAQTLKSPNWKTRICNKWQTTGYCPFGSHCHFAHGPSGKATAFFIY

SEQ ID NO: 1813 - DNA, 1155 bp, Arabidopsis thaliana
  G3055,family:Z-C3H
atgagtcatcaccggcgagattccggcggagatgtagttcacgtgattcccacaaacaatcctccgccggataattggtttccgaatctcggcgatagtgctgtttgggcgacggaagatgattacaatagagcttgggctatgaatcccgataacacctccggcgacaacaatggtccaccgaacaagaagactcgaggctctccgtcgtcttcatcagccacgactacttctgctgcgagcaatcgtactaaagcgattgggaaaatgttcttcaagacgaagctttgttgcaagtttcgtgctgggacttgtccgtatataacgaattgtaactttgctcatacggtggaggagcttcgtcgtccaccgccgaattggcaggagattgtggcggctcatgaggaggagagatctggtggtatgggaactcctacagtttctgtggttgagattccacgggaggagtttcagatcccgtctttggtgtcatcgacggctgagagtgggagatcttttaaaggaagacattgtaagaagttttatactgaagaaggatgtccttatggagaaagttgtacgtttctgcatgatgaggcttcgaggaatagagagagtgttgctattagcttaggacctggtggttatggaagtggtggtggtggtggaagtggcggtggttctgttggtggtggtggtagtagtagcaatgtagtagtgcttggtggtggtggtggaagtggaagtggaagtgggattcagattttgaagccttcaaattggaagacaaggatttgcaacaaatgggagattactgggtattgtccatttggtgctaagtgtcattttgctcatggagctgcagagttacatagatttggcggaggactcgtggaagaagaaggcaaagatggagtatcacccaatccggacacaaagcaaacagtacaaaaccccaaaggactatcagacacaacaacacttctatctccaggagtacctcataatgcagatgccagttaccacactggagttgcattgcaacgagcgtctagtgcggttacacaaaagcctggaattagaactcatcagaagtggaaaggaccggcgaaaatcagtcggatatacggtgattggatcgacgatattgaatga

SEQ ID NO: 1814 - protein, 384 aa, Arabidopsis thaliana
  G3055,Z-C3H domain coordinates 97-115,178-197,266-287
MSHHRRDSGGDVVHVIPTNNPPPDNWFPNLGDSAVWATEDDYNRAWAMNPDNTSGDNNGPPNKKTRGSPSSSSATTTSAASNRTKAIGKMFFKTKLCCKFRAGTCPYITNCNFAHTVEELRRPPPNWQEIVAAHEEERSGGMGTPTVSVVEIPREEFQIPSLVSSTAESGRSFKGRHCKKFYTEEGCPYGESCTFLHDEASRNRESVAISLGPGGYGSGGGGGSGGGSVGGGGSSSNVVVLGGGGGSGSGSGIQILKPSNWKTRICNKWEITGYCPFGAKCHFAHGAAELHRFGGGLVEEEGKDGVSPNPDTKQTVQNPKGLSDTTTLLSPGVPHNADASYHTGVALQRASSAVTQKPGIRTHQKWKGPAKISRIYGDWIDDIE

SEQ ID NO: 1815 - DNA, 978 bp, Arabidopsis thaliana
  G3059,family:Z-C3H
gaattgtcaccgggaaaaatggaaaacaaaatcgcgccgtttagttacagcggaagctccgccggaaattcatccagtggcggcgtcgtttcgtcgtctctctactctgatcaactctacaagtcgactcgcaacataatgcaacagcgtcaagatatggtgaatcgcgaggcgttgtgttacacgcgtctccatgaggcttcgcttgaagcagaagcgcttcgtctagagaacactgaactccgatcgatgaatcttcgtctcaagaatgagctcaacagtctcatcagatcttcgatccagaaccgatttgatcatcgatctccgcttcggatgcttagcaatctttcgatcggaggtaatgacgccgacgaagtggagaatcagaaccgtacggttaatcgcgatgacgtcaatgataagagtccgacgagtgttatggagaatgaggatctgaatcgctcttcgcttccaaagagcatctctgtgagatctaatggctactctaaggcaagtcagggaggtggtggtgcggctgctcaaagtggaaaacctcgtggaaccgtcactaagcctgggacttgtggtcaagtcagtactacgcagaaggtgtatgtgcgaggaggagggaagaaagaagatcaggaggaagagatagaagtggaggtgtacaatcaagggatgacaaagacagagctgtgcaacaaatggcaagagacagggacatgcccatatggtgaccattgccagttcgctcacggcattaaggaactccgtccagtgatccgccatccccgttacaagactgaggtttgcagaatggttcttgctggtgataactgtccttatggtcaccgttgccacttccgccactcactatctgagcaggagaagctcgttgctgctggtttcaaacccaagtcatccctcaagctgatcacatgacctgaccctggtttcaagtcctccttcaagctg

SEQ ID NO: 1816 - protein, 308 aa, Arabidopsis thaliana
  G3059,Z-C3H domain coordinates 219-287
MENKIAPFSYSGSSAGNSSSGGVVSSSLYSDQLYKSTRNIMQQRQDMVNREALCYTRLHEASLEAEALRLENTELRSMNLRLKNELNSLIRSSIQNRFDHRSPLRMLSNLSIGGNDADEVENQNRTVNRDDVNDKSPTSVMENEDLNRSSLPKSISVRSNGYSKASQGGGGAAAQSGKPRGTVTKPGTCGQVSTTQKVYVRGGGKKEDQEEEIEVEVYNQGMTKTELCNKWQETGTCPYGDHCQFAHGIKELRPVIRHPRYKTEVCRMVLAGDNCPYGHRCHFRHSLSEQEKLVAAGFKPKSSLKLIT

SEQ ID NO: 1817 - DNA, 747 bp, Arabidopsis thaliana
  G3060,family:Z-C3H
atggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctag

SEQ ID NO: 1818 - protein, 248 aa, Arabidopsis thaliana
  G3060,Z-C3H domain coordinates 42-61,219-237
MDTRKRGRPEAGSFNSNGGGYKKSKQEMESYSTGLGSKSKPCTKFFSTSGCPFGENCHFLHYVPGGYNAVSQMTNMGPPIPQVSRNMQGSGNGGRFSGRGESGPGHVSNFGDSATARFSVDASLAGAIIGKGGVSSKQICRQTGVKLSIQDHERDPNLKNIVLEGTLEQISEASAMVKDLIGRLNSAAKKPPGGGLGGGGGMGSEGKPHPGSNFKTKICERFSKGNCTFGDRCHFAHGEAELRKSGIV

SEQ ID NO: 1819 - DNA, 1365 bp, Arabidopsis thaliana
  G3061,family:Z-C2H2
atgattccacataatcatgaccgcctctcattctctagctttgtccatgaccaagagcacatcacccctaatccttaccctaactctcagcctgcagcctccactaaaacacccaagaaaaagagaaaccttccaggaaatccagatccaaatgcagaagtcatctctctatctccaaaatccctcatggcgacaaatcggttcttttgtgaaatttgtaacaaggggtttcagagagaacagaaccttcagctccacaaaagaggccacaacctgccatggaagctgaagcagaaaacgaacaagaatcaggtgaagaagaaagtttatatatgccctgagaagagttgcgtccatcatgatccagctcgagccctaggagaccttactggaataaagaagcactttagcaggaaacatggagagaagaagtggaaatgcgataagtgttccaagaagtatgctgtgatatccgattggaaagctcataacaagatttgtggtagcagagagtttagatgtgattgtggtactcttttctccaggaaggacagtttcatctcacatagatccttctgtgatgtcttagctgaagaaagttctaaattcttctcagttccttcaccattagccgccaattcgaccatcgccactgtcactgataccaacaatccaattctcattcaatcacaattggatcaatcttccacaggtacggccgatcttaacgtcaacaacaatcacaccaccctatttggacaaaagttcaccaactccaacccaacccaacaacaacccaatgctttggcgttgtcctcaccaccatcacctcgtagtacatctgattcggttcataatctatggaagttacaagaagaggaatgtgcacaccagtggttactcaatgaatatatgaacaataacaaaaacatattccataagggaatattcaagaatcaagaagatgagataaagaagggaaatatctacagcggctcaaacccaaccgatggaaacatagcatccttgttctcgtataatcaagaagcagtgaatatggcttcattttcggcaacaacattgcttcaaaaggtagctcaaacgggaacaccatcaagctccgaaactagcaccaccatgtttgggcaaatgacttcctccatcttcaacaatacgatgctaaactcctattgtttaacggcgaagaataatgaagaagagttgaccagagactttcttggtgtgggaagtagtgaggaccaacaacgtctacatcgtcatcgcttcccatcaagcgtgccattgacggcgaaccatgatattcccaagttggccgcaaccattgtaggcaggaagcaaccatag

SEQ ID NO: 1820 - protein, 454 aa, Arabidopsis thaliana
  G3061,Z-C2H2 domain coordinates 73-90,174-193
MIPHNHDRLSFSSFVHDQEHITPNPYPNSQPAASTKTPKKKRNLPGNPDPNAEVISLSPKSLMATNRFFCEICNKGFQREQNLQLHKRGHNLPWKLKQKTNKNQVKKKVYICPEKSCVHHDPARALGDLTGIKKHFSRKHGEKKWKCDKCSKKYAVISDWKAHNKICGSREFRCDCGTLFSRKDSFISHRSFCDVLAEESSKFFSVPSPLAANSTIATVTDTNNPILIQSQLDQSSTGTADLNVNNNHTTLFGQKFTNSNPTQQQPNALALSSPPSPRSTSDSVHNLWKLQEEECAHQWLLNEYMNNNKNIFHKGIFKNQEDEIKKGNIYSGSNPTDGNIASLFSYNQEAVNMASFSATTLLQKVAQTGTPSSSETSTTMFGQMTSSIFNNTMLNSYCLTAKNNEEELTRDFLGVGSSEDQQRLHRHRFPSSVPLTANHDIPKLAATIVGRKQP

SEQ ID NO: 1821 - DNA, 1296 bp, Arabidopsis thaliana
  G3067,family:Z-C2H2
atggaagcttcaagcacaagaagcgagaagaagaagaagaagaagacgatacagagagaaaacaccgatactcaaaagaaaaaaaagctacccagtgtttggttttcacttaagaaatctctcccctgcaaatctgatgtctccgatgtccacattccgagatccaaaaaagagctagctcccatatccactaagagaacaacaacctcctccggcggcggggtcggcggcaggtccggttgttcaagatccatagccaatcttaaagacgtaatccatggaaaccaacggcatttagagaagccgctttgctctagccctcgttctataggaagcagcgagtttctcaatcccattactcacgatgtaatctttagcaactccacctgcgagctcaagatcaccgccgccggagcaacagaattcgtcgggaatcttagaccagggacgccggtcaattactcttcttcacgccgtagccaaacttcgagaaaggcttcttctttagatagagaaggattagggtttcaccagagcagaagagagaatgatagagaagccgccattaacggagacaattcctctgtttcttgccataaatgcggcgagaaatttagcaaactcgaagctgcagaagctcatcatctaaccaaacacgccgtgactgagctaatggaaggagactcgtcgaggagaatagtggagataatctgcagaacaagctggttaaagacagagaatcaaggagggagaatcgatcggattttgaaagtacacaacatgcaaaaaaccttagcgagattcgaagaatacagagatacagtgaagatcagagcaagcaagttacaaaagaaacatccgagatgtatcgccgacggaaacgagcttctcaggtttcacggcaccactgtggcttgcgctttggggataaacgggtcgacgagtctgtgttcgtcggaaaagtgttgcgtttgtcggattatacgaaatgggttctcggcgaaacgggagatgaataacggaattggggtttttactgcgtcgacgagtgagagggcgtttgagtctattgtgattggagatggtggtggtggtgatcggaaggcgttgattgtgtgtcgagtgattgccgggagggttcatcggccggtggagaatgtagaggagatgggtgggttgttgagtgggtttgattcattggctggtaaagttgggttgtacacaaatgttgaggagctctatttgctcaattctcgagctttgcttccttgttttgtgctaatctgcaaaccttaa

SEQ ID NO: 1822 - protein, 431 aa, Arabidopsis thaliana
  G3067,Z-C2H2 domain coordinates 198-219
MEASSTRSEKKKKKKTIQRENTDTQKKKKLPSVWFSLKKSLPCKSDVSDVHIPRSKKELAPISTKRTTTSSGGGVGGRSGCSRSIANLKDVIHGNQRHLEKPLCSSPRSIGSSEFLNPITHDVIFSNSTCELKITAAGATEFVGNLRPGTPVNYSSSRRSQTSRKASSLDREGLGFHQSRRENDREAAINGDNSSVSCHKCGEKFSKLEAAEAHHLTKHAVTELMEGDSSRRIVEIICRTSWLKTENQGGRIDRILKVHNMQKTLARFEEYRDTVKIRASKLQKKHPRCIADGNELLRFHGTTVACALGINGSTSLCSSEKCCVCRIIRNGFSAKREMNNGIGVFTASTSERAFESIVIGDGGGGDRKALIVCRVIAGRVHRPVENVEEMGGLLSGFDSLAGKVGLYTNVEELYLLNSRALLPCFVLICKP

SEQ ID NO: 1823 - DNA, 2040 bp, Arabidopsis thaliana
  G3070,family:Z-C2H2
atgcgtggggtttggctttatctcaagaagtctcttagctgctgcaaggcacagaagtcaactgtagcttgtgatccagacaagatccaaattcagaagaaggagaatccatctggatgctcaagaagatcaatgtcgaatctgagagatgtctttgtaactaatggagatgaaggagctatgcagaatgtaagctgctgcagctcacggtctcttgagagctccaggtttgtaaacacagtgaaatttgaggagaatgcaggttattcagacagattcaaaggtttgcttagcggagcatcttcttctgatttacttcccggtcgttgttcagagagatttgatgttgttggctctgacatctgcggtttcggagttcttgcttgtcaaaaatgtcatgagagagtcagagatcttgacgcgtttgaagcacattacctctctaaccactctgtcgttagactcttagcaggagatttctcaagaacaactgtggaactaatctgcaacacaggctattctcacaagctaggcaaaatgaaagggaacaacatttcagcgatctttaaaatccagaacttgcagagagttgttgcagactttgaagattacagagagctcgtgaaaataagagcaaacaagctttcaaagaagcactctcgttgtatggctgatggcaacgagtttcttgggttccacggtacaactctttcttgcactctcggtttcagtaacagctcttcaaacctctgtttctcggatcactgtgaagtttgtcatattctaagacatggtttcagtcctaaaacaagaccagatgggataaaaggagttctcacagcatcaactagctctacagctcttgaatctatcgaaaccgatcaaggaagaaatagaggttcattgatagctgttgtgctatgtagagtgattgcagggagggttcataaacctatgcagacgtttgaaaattctttagggttttctgagtttgattcactagctttgaaagttaaaaatgttgggctttccccaaaattgaaagatggaaaacttgctggacaagtctatgcccagcctctatatttaaagggtgaagaagactgtaacttgttctccctccggaaacctctgtttgtaagatactattctcttctctccccaatcacactttgttctttttttttttttttgatgatagacgccctagtgttgggtgcttgtcatctcgacgctgaaccttgcggattgggtatgggaaaactcatgattgcaattagtagtgataattcgatgtgggttttggagaagaaggcccctgtggagttggtggaaggaggaaagggaattgtaggagcatcccatgggtgggtagctactttgaaagacggagtagtgtgtctccaagatgatctaaacccaagcacatcgaattcagacccgaaacgcatctcattgcctagtctaagagttgagatgttctgcataccttcttctggaggtcacgttactggatcgtgggatctccacaaacacaagttgcagagggtgcgatttcgaaaccttgctaagttgacaaagaaggaatggaagcttttggattcgtgtagcaggagcgaacatttggtggagtcagcagaaaatgaaactttcttggttaagtggtacaggaagaaaagcaaagatttgaagagaatgatgacaacaaaggctgaaatgctaaaaaaaaaaaaaaaaaaaaaaaaaaaaaaaaaagaaggaaatgctgtttacactcgagacattggagatctctgcattttcctctcaaaatctgaatctttctgtgtctctgcaactagtagctacaaatccgttccttccctagtccgtaaccacgtctatgtccaggcttacgacgagtatggattcatggatatcgccaagccttttgacgattcctgggtcattcctgcctcacctgatgcgaacccgaatcctttctatattccacctcaaactatagaatatactttatctacgatgcacccggatctatga

SEQ ID NO: 1824 - protein, 679 aa, Arabidopsis thaliana
  G3070,Z-C2H2 domain coordinates 129-150
MRGVWLYLKKSLSCCKAQKSTVACDPDKIQIQKKENPSGCSRRSMSNLRDVFVTNGDEGAMQNVSCCSSRSLESSRFVNTVKFEENAGYSDRFKGLLSGASSSDLLPGRCSERFDVVGSDICGFGVLACQKCHERVRDLDAFEAHYLSNHSVVRLLAGDFSRTTVELICNTGYSHKLGKMKGNNISAIFKIQNLQRVVADFEDYRELVKIRANKLSKKHSRCMADGNEFLGFHGTTLSCTLGFSNSSSNLCFSDHCEVCHILRHGFSPKTRPDGIKGVLTASTSSTALESIETDQGRNRGSLIAVVLCRVIAGRVHKPMQTFENSLGFSEFDSLALKVKNVGLSPKLKDGKLAGQVYAQPLYLKGEEDCNLFSLRKPLFVRYYSLLSPITLCSFFFFLMIDALVLGACHLDAEPCGLGMGKLMIAISSDNSMWVLEKKAPVELVEGGKGIVGASHGWVATLKDGVVCLQDDLNPSTSNSDPKRISLPSLRVEMFCIPSSGGHVTGSWDLHKHKLQRVRFRNLAKLTKKEWKLLDSCSRSEHLVESAENETFLVKWYRKKSKDLKRMMTTKAEMLKKKKKKKKKKKEGNAVYTRDIGDLCIFLSKSESFCVSATSSYKSVPSLVRNHVYVQAYDEYGFMDIAKPFDDSWVIPASPDANPNPFYIPPQTIEYTLSTMHPDL

SEQ ID NO: 1825 - DNA, 882 bp, Arabidopsis thaliana
  G3074,family:CAAT
atgaggaagaagctcgatactcggttcccagctgctcgtattaaaaagattatgcaagctgatgaggatgttggcaagatagctttggcagtgcctgtcttagtctcaaaatctttggagttgttcttgcaagacctttgtgatcgtacatatgaaattacccttgaaagaggtgccaagactgtgagctcattgcacctaaaacattgtgtggaaagatataacgtgtttgattttctgagggaagttgtgagtaaggtgcctgactatggccattcccaagggcaaggacatggtgatgttaccatggatgatcgcagcatctccaagagaaggaagcccatcagcgatgaagtgaatgacagtgacgaggaatataagaaaagcaaaacgcaagagatagggagtgctaagaccagtggcaggggtggtagaggaagagggcgaggaagaggtcgtggtggacgagctgcaaaagcagccgaaagagagggtctcaaccgcgagatggaagtagaagccgccaattctggacagccaccaccagaagacaatgtcaagatgcatgcgtcagagtcatcaccacaagaggatgagaagaaaggcatcgacggcacagcagcatcgaacgaagacaccaagcaacaccttcaaagtcccaaagaaggcattgactttgatctcaacgctgaatccctcgacctaaacgagaccaaactggcaccagccacaggcacaaccacaaccacaactgcagcaacagactctgaggagtattcgggctggcctatgatggacataagcaaaatggatccagcacagcttgctagtctgggtaagaggatagacgaggatgaggaagattatgacgaagaaggctaa

SEQ ID NO: 1826 - protein, 293 aa, Arabidopsis thaliana
  G3074,CAAT domain coordinates 3-86
MRKKLDTRFPAARIKKIMQADEDVGKIALAVPVLVSKSLELFLQDLCDRTYEITLERGAKTVSSLHLKHCVERYNVFDFLREVVSKVPDYGHSQGQGHGDVTMDDRSISKRRKPISDEVNDSDEEYKKSKTQEIGSAKTSGRGGRGRGRGRGRGGRAAKAAEREGLNREMEVEAANSGQPPPEDNVKMHASESSPQEDEKKGIDGTAASNEDTKQHLQSPKEGIDFDLNAESLDLNETKLAPATGTTTTTTAATDSEEYSGWPMMDISKMDPAQLASLGKRIDEDEEDYDEEG

SEQ ID NO: 1827 - DNA, 621 bp, Arabidopsis thaliana
  G3075,family:CAAT
atggtgtcgtcaaagaaacccaaggagaagaaggcgaggagcgatgtcgtcgtcaataaagcgagtggtcggagtaaacgcagctccggttccagaacgaagaagacgtcgaacaaggttaacattgtgaagaagaagccggagatttacgagatctcagaatcatcgagcagtgactctgtggaagaagcaataagaggcgatgaggcgaagaaaagtaacggcgtcgtgagcaagaggggtaacggaaagagtgtaggaattccgacgaagacgagtaaaaatcgagaagaggacgatggaggcgcggaagatgctaagatcaagtttccgatgaatcggattcggcggatcatgagaagcgataattctgctcctcagattatgcaggatgctgtatttcttgtcaacaaagccacggagatgttcattgagcggttttctgaagaagcttatgatagttccgtcaaggacaaaaagaaattcatccactacaaacacctctcatccgtagtgagtaacgaccagagatacgagttccttgcagatagtgttcccgagaaacttaaagcagaggccgcgttggaggaatgggaaagaggcatgacagatgcaggctga

SEQ ID NO: 1828 - protein, 206 aa, Arabidopsis thaliana
  G3075,CAAT domain coordinates 111-192
MVSSKKPKEKKARSDVVVNKASGRSKRSSGSRTKKTSNKVNIVKKKPEIYEISESSSSDSVEEAIRGDEAKKSNGVVSKRGNGKSVGIPTKTSKNREEDDGGAEDAKIKFPMNRIRRIMRSDNSAPQIMQDAVFLVNKATEMFIERFSEEAYDSSVKDKKKFIHYKHLSSVVSNDQRYEFLADSVPEKLKAEAALEEWERGMTDAG

SEQ ID NO: 1829 - DNA, 690 bp, Arabidopsis thaliana
  G3076,family:bZIP-ZW2
atgagaaacctagtagaagaaaagttcctagagttctatgagagttgggttattcaacttgagctatatcttcatcaacttttaattgctcataacaataacactatgagtgagaccgagcttcgacatttgatctcgaagctaactacacatcacaaagcttattatacagccaaatgggcagccataagagaagatgtcttagcttttttcggatcagtttggttaaacccgttagagaatgcttgctcttggttaaccggatggaaaccgtcgatggtgtttcggatggttgataggctgaggaagtcgagagtggtgcttgtggaggctcaggtgaagaaattggaggagctgagagttaagaccaagttcgatgagcaaaaaattgagagagagatggagcggtatcaggtggctatggctgatcggaaaatggtagagctggcgaggcttggatgtcacgtcggaggagaatcggtgatggtggtggaggcagcggtgagaggattatcgatgggtcttgagaaaatggtgaaggctgcggattgtgtgcggctgaaaacgcttaaaggtatattagacattttaactccaccgcaatgcgttgagtttttggcagcggcggctacgtttcaggttcagttacgtcggtggggaaaccgaagacattatgtcactcactcctga

SEQ ID NO: 1830 - protein, 229 aa, Arabidopsis thaliana
  G3076,bZIP-ZW2 domain coordinates 70-100,182-209
MRNLVEEKFLEFYESWVIQLELYLHQLLIAHNNNTMSETELRHLISKLTTHHKAYYTAKWAAIREDVLAFFGSVWLNPLENACSWLTGWKPSMVFRMVDRLRKSRVVLVEAQVKKLEELRVKTKFDEQKIEREMERYQVAMADRKMVELARLGCHVGGESVMVVEAAVRGLSMGLEKMVKAADCVRLKTLKGILDILTPPQCVEFLAAAATFQVQLRRWGNRRHYVTHS

SEQ ID NO: 1831 - DNA, 914 bp, Arabidopsis thaliana
  G3083,family:bZIP-ZW2
caaaatatgagccaagagacagcgatagcaagcttcaagaaattccaacagtcatggatcgagcagctacgaaaccacctgaaccacctccgctccgcccaaaaccatcaccggaactctgctaccggtgatgaggaacggttaagggaggctgtggacagagtgatggaacactttagagaatatcacagggccaagtgggctgcgacggataaagacgtcatcgaagttatggcttctccttgggcttcagctcttgaacggtcgcttcagtgggtcggtggttggcgaccaaccaccttgttccatctggtttacactgagtcgagtattttatttgagtctcgtatcgttgatatacttcgtggctttcgcaccggtgatctcagtgatctctccccttctcagttcaggacggtaagtgagctacaatgtgagaccgtgaaggaagagaatgcgataacggaagagttgtcggagtggcaagacgatgcgagtgaccttgtcatggggacatcgtcagatcccgaccagaggatccgacggctagcagaaatcgtccaccgaactgatgatctgcgactgagaacgatcacacgtgtggtggaggtcttgagtccgctccaacaagcggagtttcttgtcgctgcggctgagcttcgtacaggcgttgctggttgggggactagccacgaccgtcgtcgaagttccgaagtttaaagctaactaaaaccggtctaaaggtaatgagaatcgaggaagaaaaatagtttttggatattaattatatgtttttaccatgtttttggttatccagactgagtttggttttacatggttatgaaaacaaaaaaaactcatatgttatgtctctacggttgcaataaagatcaacccacgtgtggtgcttgtta

SEQ ID NO: 1832 - protein, 237 aa, Arabidopsis thaliana
  G3083,bZIP-ZW2 domain coordinates 75-105,188-215
MSQETAIASFKKFQQSWIEQLRNHLNHLRSAQNHHRNSATGDEERLREAVDRVMEHFREYHRAKWAATDKDVIEVMASPWASALERSLQWVGGWRPTTLFHLVYTESSILFESRIVDILRGFRTGDLSDLSPSQFRTVSELQCETVKEENAITEELSEWQDDASDLVMGTSSDPDQRIRRLAEIVHRTDDLRLRTITRVVEVLSPLQQAEFLVAAAELRTGVAGWGTSHDRRRSSEV

SEQ ID NO: 1833 - DNA, 558 bp, Arabidopsis thaliana
  G3084,family:IAA
atgtattgcagcgatcctccccatcccttgcacttagtggcatcagacaaacaacaaaaagaccacaaactgatcctttcctggaagaaaccaacaatggactcagacccactcggtgttttcccaaattctcccaagtatcatccatattactcgcagaccacggagtttggtggcgtaatcgatttaggtctcagcctgagaaccatacaacatgagatttaccactcatctggccaaagatattgtagtaatgaaggatacagacggaagtggggttatgtaaaggtcaccatggatggtttggtggtaggtcgcaaggtctgtgttcttgatcatggaagctattcaactcttgctcatcaactcgaggacatgtttgggatgcagagtgtgtcgggattgaggttgttccagatggagtctgagttctgtttggtctacagagacgaagaaggtctgtggagaaatgctggggatgttccatggaatgagttcatagaaagcgtggagcggctgagaatcacaagaagaaacgatgctgtacttcccttttaa

SEQ ID NO: 1834 - protein, 185 aa, Arabidopsis thaliana
  G3084,IAA domain coordinates 94-110,148-177
MYCSDPPHPLHLVASDKQQKDHKLILSWKKPTMDSDPLGVFPNSPKYHPYYSQTTEFGGVIDLGLSLRTIQHEIYHSSGQRYCSNEGYRRKWGYVKVTMDGLVVGRKVCVLDHGSYSTLAHQLEDMFGMQSVSGLRLFQMESEFCLVYRDEEGLWRNAGDVPWNEFIESVERLRITRRNDAVLPF

SEQ ID NO: 1835 - DNA, 1621 bp, Arabidopsis thaliana
  G3086,family:HLH/MYC
aagtttctctcacgttctcttttttaattttaatttctcgccggaaacaatctcatctcccggcgaacgaaacttccggtgtggtactgcaaacggagaaaaaaataaccaaagaagagagaaactcaaaagctactaagatggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtgaaactagaagtgggagtatgcgcgagtgctagccagggagggagttgtgcatagaagtatcggttcggcctttggagaaaagtcgaagatagcaaagtagagaagagatcatgaacaaagctaaatttggtggtggtggtgaaaagggtttttgtaaagttggaacctttttttggtagggaagaaagtagcaaggttgtgtaatggtccgaactccaatgctattgtatgttcttacatccaaaaaaaagaaaagcagaagagaagtgatgtacaatgagaagcttattttattgtaactcaagaataattcaggtaattagtttaaaaaaaaaaaaaaaa

SEQ ID NO: 1836 - protein, 379 aa, Arabidopsis thaliana
  G3086,HLH/MYC domain coordinates 307-365
MESEFQQHHFLLHDHQHQRPRNSGLIRYQSAPSSYFSSFGESIEEFLDRPTSPETERILSGFLQTTDTSDNVDSFLHHTFNSDGTEKKPPEVKTEDEDAEIPVTATATAMEVVVSGDGEISVNPEVSIGYVASVSRNKRPREKDDRTPVNNLARHNSSPAGLFSSIDVETAYAAVMKSMGGFGGSNVMSTSNTEASSLTPRSKLLPPTSRAMSPISEVDVKPGFSSRLPPRTLSGGFNRSFGNEGSASSKLTALARTQSGGLDQYKTKDEDSASRRPPLAHHMSLPKSLSDIEQLLSDSIPCKIRAKRGCATHPRSIAERVRRTKISERMRKLQDLVPNMDTQTNTADMLDLAVQYIKDLQEQVKALEESRARCRCSSA

SEQ ID NO: 1837 - DNA, 684 bp, Arabidopsis thaliana
  G3091,family:PLATZ
atggcgatcgaggatcaagagaacacaatccgtgaaatcaaacctaagaacagaagaatcatgggagctggtggtccggaggaagaggagaaccggtggccgccatggttgaaacctttgcttaaagagcaattctttgttcattgcaagtttcatggagactctcataagagtgaatgcaatatgtattgcttagactgcaccaatggcccactttgctctctttgtcttgctcatcacaaggatcatcgcaccattcagataaggagatcttcttatcatgatgttataagggtgaatgagatacaaaagtatcttgatataggtgggatccaaacctatgtgatcaatagtgctaaagtcgtcttcctgaatgagaggcctcagcctaggcctgggaaaggagtgaccaatacctgcaaggtttgctatcgtagcctcgttgatgatagcttccgcttctgctctcttggctgcaagattgctggaacatcaagaggctttgaaaagggaagggagaacctgctaatggaaacagaggattcaagtagcagcattgcaattgggaagaacattacaaatctccagagtttcagcccatcaacacctccacttactacatctagtaactgcagaatcgtcaagcgaagaaagggaattcctcaccgatctccaatgggataa

SEQ ID NO: 1838 - protein, 227 aa, Arabidopsis thaliana
  G3091,PLATZ domain coordinates 34-131
MAIEDQENTIREIKPKNRRIMGAGGPEEEENRWPPWLKPLLKEQFFVHCKFHGDSHKSECNMYCLDCTNGPLCSLCLAHHKDHRTIQIRRSSYHDVIRVNEIQKYLDIGGIQTYVINSAKVVFLNERPQPRPGKGVTNTCKVCYRSLVDDSFRFCSLGCKIAGTSRGFEKGRENLLMETEDSSSSIAIGKNITNLQSFSPSTPPLTTSSNCRIVKRRKGIPHRSPMG

SEQ ID NO: 1839 - DNA, 738 bp, Arabidopsis thaliana
  G3094,family:PLATZ
atggaatctggagaatttcctgcatggcttgaggttctgttaaaagacaagtttttcaacgcttgtttggatcatgaagatgataagaagaacgagaagaacatattatgtatcgattgttgtcttaccatctgtcctcactgtctctcttctcatacctctcatcgtcttcttcagataagaagatacgtgtatagagacgttttgagggttgaagatggttctaagctaatggattgctctttaattcagccatacacaacgaacagttcaaaagttgtgttcatcaatgaacggcctcagtctcgacaatttcgtggttccggtaacatttgtatcacctgtgaccggagtctccagtctccttacctcttctgctgtctctcctgcaagattagtgacgtcataatgagacaaagaggactctcagggtttctccgcgtctgcaacgttcttgatttaaccgacgaagtcacgacaacgacaccgagttccactctcgagcccaccgggtcgaaccgaacatcttccgagtcaagtggtaacgaaggagaagacatgttctggtgtcaggcgctcgcttgcaccgccactactgaaatcgttaggaagaaaagaagcagcttgtcgacgacttgcaggagagtcacggaggtggtttcaacgactaacacggaagctccggtgaactttttaaaccgtcggaagaatccgccgcaacgcgccccgctttattaa

SEQ ID NO: 1840 - protein, 245 aa, Arabidopsis thaliana
  G3094,PLATZ domain coordinates 7-143
MESGEFPAWLEVLLKDKFFNACLDHEDDKKNEKNILCIDCCLTICPHCLSSHTSHRLLQIRRYVYRDVLRVEDGSKLMDCSLIQPYTTNSSKVVFINERPQSRQFRGSGNICITCDRSLQSPYLFCCLSCKISDVIMRQRGLSGFLRVCNVLDLTDEVTTTTPSSTLEPTGSNRTSSESSGNEGEDMFWCQALACTATTEIVRKKRSSLSTTCRRVTEVVSTTNTEAPVNFLNRRKNPPQRAPLY

SEQ ID NO: 1841 - DNA, 738 bp, Arabidopsis thaliana
  G3095,family:PLATZ
atgggaccgatgatgatgagagcagaagaagataactacaatctaaatcctccaccatggctaatcccaatgctaagagcaaactacttcatcccttgttcaatccacgccgcttccaacaaaagcgagtgcaacatgttctgtcttgactgttcttctgaggccttttgctcttactgtttgctcaatcacagaaaccatcgtgtcctccagatacggagatcatcgtaccacaacgttgtgagagtaaacgagattcagaagtacatagacatatcttgtgttcagacatatataatcaacagcgcaaggatcgttttcttgaacgaacgtcctcagccaagaatcggcaaaggagtcaccaatacttgtgaaatctgttgcagaagccttctcgattctttccgtttctgctctctcggttgcaaacttggaggaatgaagcgtgatccaagtctaaccttctctttgagagggaagcatggaagagagtacgaaggtgagtgggaatctgatgaagcgactacaccaactaagatacgcaagacatgtgctttcaaccgtctgatgagtggtctttccatctccaccgttaaatgtgattacttgtcaggagatcaaccgtcttcgagctccggtgatgagagcggttttaaactttctccggggacaccgccgatatataatcaccggaattcaagtagacggaagggcgtcccacaccgtgctcctttctaa

SEQ ID NO: 1842 - protein, 245 aa, Arabidopsis thaliana
  G3095,PLATZ domain coordinates 16-151
MGPMMMRAEEDNYNLNPPPWLIPMLRANYFIPCSIHAASNKSECNMFCLDCSSEAFCSYCLLNHRNHRVLQIRRSSYHNVVRVNEIQKYIDISCVQTYIINSARIVFLNERPQPRIGKGVTNTCEICCRSLLDSFRFCSLGCKLGGMKRDPSLTFSLRGKHGREYEGEWESDEATTPTKIRKTCAFNRLMSGLSISTVKCDYLSGDQPSSSSGDESGFKLSPGTPPIYNHRNSSRRKGVPHRAPF

SEQ ID NO: 1843 - DNA, 684 bp, Arabidopsis thaliana
  G3111,family:RING/C3H2C3
caacaacaaaacctcttactcactccaatggctcgccttctctttcgtcttctcgtagaatccaacactccgtctccggcgattgataactccaccgccgcgttgaattctgatctcgtcgtcatcctcgctgctctcctctgcgccttgatttgcgttctcggcttaatcgccgtttctcgatgtgtctggctccgtcgtctcgcagccggaaacagaacagtctccggatctcaaactcaatctcctcaacctccggtggcagcggcgaacaaaggcctgaagaagaaagtccttcaatctctcccgaagcttacgttctcgccagagtcacctgagtcggagaaattcgcagagtgcgcgatctgtctagctgaattctctgccggcgacgagctccgagttttaccgcagtgtggtcacgggttccacgtggcttgcattgacacgtggctaggatctcactcgtcttgcccttcttgccgtcagatcttggttgttgccaggtgtcacaagtgtggaggtttacccggtagctctagctccggacttgaatccgaacccgaaatcgagatccgaatcaagcaaggcgaagatgaccccaactccttcttgccataatcattttagtttcccatttatttattagaaaactctataatttaatgcagatcattttagtgg

SEQ ID NO: 1844 - protein, 197 aa, Arabidopsis thaliana
  G3111,RING/C3H2C3 domain coordinates 111-152
MARLLFRLLVESNTPSPAIDNSTAALNSDLVVILAALLCALICVLGLIAVSRCVWLRRLAAGNRTVSGSQTQSPQPPVAAANKGLKKKVLQSLPKLTFSPESPESEKFAECAICLAEFSAGDELRVLPQCGHGFHVACIDTWLGSHSSCPSCRQILVVARCHKCGGLPGSSSSGLESEPEIEIRIKQGEDDPNSFLP

SEQ ID NO: 1845 - DNA, 579 bp, Oryza sativa
  G3380,family:AP2
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagcaagaggaataactactagctatatatgctgctaacctacttacaatcgcgatacatatcgaggtttggggattttcttctcacctgtgtgcagaggctgc

SEQ ID NO: 1846 - protein, 136 aa, Oryza sativa
  G3380,AP2 domain coordinates 18-82
MDGDGGGGWDDQGNGGGETTKYRGVRRRPSGKFAAEIRDSSRQSVRVWLGTFDTAEEAARAYDRAAYAMRGHLAVLNFPAEARNYVRGSGSSSSSRQHQQRQVIELECLDDQVLQEMLKGGDDQYRSAAGSKRNNY

SEQ ID NO: 1847 - DNA, 514 bp, Oryza sativa
  G3381,family:AP2
atcgatcatctgctacgaactcaccctatatatatatactccatcttaggagctgcttgatcgatcgacatatatataactaatggatcatcatcatcagcagcagcagcaggagggtgagctggtggccaagtacaggggcgtgcggcggcggccgtggggcaaattcgcggcagagatccgcgactcgagccggcacggcgtccgcgtgtggctgggcaccttcgacacagccgaggaggccgctcgcgcctacgaccgctccgcctactccatgcgcggcgccaacgccgtcctcaacttccccgccgacgcccacatctacgcccgtcaactacacaataataacgccgctgctggctcttcatcttcctcttccgccgccgccgcagcagccaggccgccgccgatcgagttcgagtacctcgatgaccacgtcctgcaggagatgctccgagaccacaccaccaacaagtagcttactactccactatatatgctgcctgctgcttgt

SEQ ID NO: 1848 - protein, 131 aa, Oryza sativa
  G3381,AP2 domain coordinates 14-78
MDHHHQQQQQEGELVAKYRGVRRRPWGKFAAEIRDSSRHGVRVWLGTFDTAEEAARAYDRSAYSMRGANAVLNFPADAHIYARQLHNNNAAAGSSSSSSAAAAAARPPPIEFEYLDDHVLQEMLRDHTTNK

SEQ ID NO: 1849 - DNA, 375 bp, Oryza sativa
  G3383,family:AP2
atggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatga

SEQ ID NO: 1850 - protein, 124 aa, Oryza sativa
  G3383,AP2 domain coordinates 9-73
MEDNRSKDTATKYRGVRRRPWGKFAAEIRDPERGGARVWLGTFDTAEEAARAYDRAAYAQRGAAAVLNFPAAAAAGRGGGAGGAASGSSSSSSAQRGRGDKIEFEYLDDKVLDDLLDDEKYRGK

SEQ ID NO: 1851 - DNA, 1291 bp, Oryza sativa
  G3388,family:AP2
ctagacactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgag

SEQ ID NO: 1852 - protein, 365 aa, Oryza sativa
  G3388,AP2 domain coordinates 66-129,181-274
MGVVSFSSTSSGASTATTESGGAVRMSPEPVVAVAAAAQQLPVVKGVDSADEVVTSRPAAAAAQQSSRYKGVVPQPNGRWGAQIYERHARVWLGTFPDEEAAARAYDVAALRYRGRDAATNFPGAAASAAELAFLAAHSKAEIVDMLRKHTYADELRQGLRRGRGMGARAQPTPSWAREPLFEKAVTPSDVGKLNRLVVPKQHAEKHFPLRRAASSDSASAAATGKGVLLNFEDGEGKVWRFRYSYWNSSQSYVLTKGWSRFVREKGLRAGDTIVFSRSAYGPDKLLFIDCKKNNAAAATTTCAGDERPTTSGAEPRVVRLFGVDIAGGDCRKRERAVEMGQEVFLLKRQCVVHQRTPALGALLL

SEQ ID NO: 1853 - DNA, 1068 bp, Oryza sativa
  G3389,family:AP2
gctaggctgttctctctttccattcgtcaagaactaccacgacgtcgacatcataatcgtcagagagctcgagaaattttttagtatctttgatccagatcgatcatggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaacacgcaagc

SEQ ID NO: 1854 - protein, 317 aa, Oryza sativa
  G3389,AP2 domain coordinates 64-129,177-266
MEQEAAMVVFSCNSGSGGSSSTTDSKQEEEEEEELAAMEEDELIHVVQAAELRLPSSTTATRPSSRYKGVVPQPNGRWGAQIYERHARVWLGTFPDEEAAARAYDVAALRFRGRDAVTNRAPAAEGASAGELAFLAAHSKAEVVDMLRKHTYDDELQQGLRRGSRAQPTPRWAREPLFEKAVTPSDVGKLNRLVVPKQQAERHFPFPLRRHSSDAAGKGVLLNFEDGDGKVWRFRYSYWNSSQSYVLTKGWSRFVREKGLRPGDTVAFSRSAAAWGTEKHLLIDCKKMERNNLATVDDDARVVVKLFGVDIAGDKTR

SEQ ID NO: 1855 - DNA, 1338 bp, Oryza sativa
  G3391,family:AP2
ggagagtaggagtgtgctagtgtgtgaggtctactgaaatggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacatgctccgcaagcacacctacttcgacgagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatagagttagcactattagctcgatcttctctagctagtgtcttttttgctcccatgcatcataattcaggtggtagctagcttagtcccttgttgatcctatctactaatctcacttggttttttttgttaatttattcgcccatgttcttgcttgctttgctgta

SEQ ID NO: 1856 - protein, 378 aa, Oryza sativa
  G3391,AP2 domain coordinates 79-148,215-300
MDSSSCLVDDTNSGGSSTDKLRALAAAAAETAPLERMGSGASAVVDAAEPGAEADSGSGGRVCGGGGGGAGGAGGKLPSSKFKGVVPQPNGRWGAQIYERHQRVWLGTFAGEDDAARAYDVAAQRFRGRDAVTNFRPLAEADPDAAAELRFLATRSKAEVVDMLRKHTYFDELAQSKRTFAASTPSAATTTASLSNGHLSSPRSPFAPAAARDHLFDKTVTPSDVGKLNRLVIPKQHAEKHFPLQLPSAGGESKGVLLNFEDAAGKVWRFRYSYWNSSQSYVLTKGWSRFVKEKGLHADGKLFIDCKLVRSTGAALASPADQPAPSPVKAVRLFGVDLLTAPAPVEQMAGCKRARDLAATTPPQAAAFKKQCIELALV

SEQ ID NO: 1857 - DNA, 356 bp, Oryza sativa
  G3393,family:MYB-related
cataaggtcataacaagggtctgaggatcttagctagcacaagatctcaactcggcatttcattggagtttttcacgcctaatggatagcagcagtggtagccagggaaagaattccaaaaccagtgatggttgtgaaacaaaagaagttaataacactgcacagaattttgttcatttcacggaagaagaggaagatctcgttttcagaatgcacaggcttgttgggaacaggtgggaacttatagctggaagaatccctggaagaacagcaaaagaggtagaaatgttctgggcagtaaagcaccagaatacataaggggggaaaaagggtgtatgccctaaaagtagcgtaca

SEQ ID NO: 1858 - protein, 78 aa, Oryza sativa
  G3393,MYB-related domain coordinates 31-75
MDSSSGSQGKNSKTSDGCETKEVNNTAQNFVHFTEEEEDLVFRMHRLVGNRWELIAGRIPGRTAKEVEMFWAVKHQNT

SEQ ID NO: 1859 - DNA, 1231 bp, Oryza sativa
  G3394,family:CAAT
ggccgcttctcttctccagcgtccgatctccccctctcgcctctccgcctcacctccgctccgcttcccacccccgcttcctctctctctcctctccccccccctctctctctctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggaggaggggggagccacgagagcgggagcccgagggggggagggggaggagggggaggtgggggtggggggggcccactcgtccggcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattcccaaaaaaaaaaaaaaaaaaaaaaaaaaaa

SEQ ID NO: 1860 - protein, 185 aa, Oryza sativa
  G3394,CAAT domain coordinates 38-126
MADGPGSPGGGGGSHESGSPRGGGGGGGGGGGGGPLVRQDRFLPIANISRIMKKAIPANGKIAKDAKETVQECVSEFISFITSEASDKCQREKRKTINGDDLLWAMATLGFEDYIEPLKVYLQKYREMEGDSKLTAKAGDGSVKKDVLGSHGGSSSSAQGMGQQAAYNQGMGYMQPQYHNGDVSN

SEQ ID NO: 1861 - DNA, 610 bp, Oryza sativa
  G3395,family:CAAT
tggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggatagtgaaaattttcagtaactggtgtcctctgtgagttattatccatctgttaaggaagaacccacattagggc

SEQ ID NO: 1862 - protein, 164 aa, Oryza sativa
  G3395,CAAT domain coordinates 19-108
MADAGHDESGSPPRSGGVREQDRFLPIANISRIMKKAVPANGKIAKDAKETLQECVSEFISFVTSEASDKCQKEKRKTINGEDLLFAMGTLGFEEYVDPLKIYLHKYREMEGDSKLSSKAGDGSVKKDTIGPHSGASSSSAQGMVGAYTQGMGYMQPQYHNGDT

SEQ ID NO: 1863 - DNA, 837 bp, Oryza sativa
  G3396,family:CAAT
gtcgagatccggcggccggtggcgtcctcctccctctccctcctccccaaccaacggcgctgatcccctccgccatctccgtccatctccgcctaaaaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtaggacgaggagtgtgatagcatctaggaaggagaaccatcgtttttagggaaagaacgctccagcatcctgttatgttgtaagcaggatgcttctaaagttccaataccttgttaccacgaatgttagtcgtcgttctttttgaaatgttcttgtgttagccaggatgtccaaatttgttgtaggttctagttcagtcgtgtgttgtgtggttgtgtctaaccatatttggccgtttccggctgtcctgcatatgctaaattcagaggggtaaagagatctaagaaaaaaaaaaaaaaa

SEQ ID NO: 1864 - protein, 143 aa, Oryza sativa
  G3396,CAAT domain coordinates 21-110
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKGSRASELPVKKDVVLNGDPGSSFEGM

SEQ ID NO: 1865 - DNA, 720 bp, Oryza sativa
  G3397,family:CAAT
gcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgagttcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaaaacaggggcgcttgacatcgctccgagacgagtagcatgcaccat

SEQ ID NO: 1866 - protein, 219 aa, Oryza sativa
  G3397,CAAT domain coordinates 23-112
MPDSDNDSGGPSNYAGGELSSPREQDRFLPIANVSRIMKKALPANAKISKDAKETVQECVSEFISFITGEASDKCQREKRKTINGDDLLWAMTTLGFEDYVDPLKHYLHKFREIEGERAAASTTGAGTSAASTTPPQQQHTANAAGGYAGYAAPGAGPGGMMMMMGQPMYGSPPPPPQQQQQQHHHMAMGGRGGFGHHPGGGGGGSSSSSGHGRQNRGA

SEQ ID NO: 1867 - DNA, 761 bp, Oryza sativa
  G3398,family:CAAT
cctctcctcttcgtcttcctcctcgccttcgcttcgactgcttcgatcgagggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggt

SEQ ID NO: 1868 - protein, 224 aa, Oryza sativa
  G3398,CAAT domain coordinates 21-110
MPDSDNESGGPSNAGEYASAREQDRFLPIANVSRIMKRALPANAKISKDAKETVQECVSEFISFITGEASDKCQREKRKTINGDDLLWAMTTLGFEDYIDPLKLYLHKFRELEGEKAIGAAGSGGGGAASSGGSGSGSGSHHHQDASRNNGGYGMYGGGGGMIMMMGQPMYGSPPASSAGYAQPPPPHHHHHQMVMGGKGAYGHGGGGGGGPSPSSGYGRQDRL

SEQ ID NO: 1869 - DNA, 1160 bp, Oryza sativa
  G3399,family:AT-hook
cggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcaggc

SEQ ID NO: 1870 - protein, 336 aa, Oryza sativa
  G3399,At-hook amino acids 99-107,2nd cons. domain 107-253,DUF296 126-246
MAGMDPGGGGAGAGSSRYFHHLLRPQQPSPLSPLSPTSHVKMEHSKMSPDKSPVGEGDHAGGSGSGGVGGDHQPSSSAMVPVEGGSGSAGGSGSGGPTRRPRGRPPGSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEGEEEEVAAPAAGGEAQDQVAQSAGPPGQQPAASQSSGVTGGDGTGGAGGMSLYNLAGNVGGYQLPGDNFGGWSGAGAGGVRPPF

SEQ ID NO: 1871 - DNA, 1143 bp, Oryza sativa
  G3400,family:AT-hook
ctctgcaggtgaggtgaggtgaggggtgggatcgagggatcgagaagctggcggcgagcaagtggtgggagcgcgccgatgagggcgccatggccgggatggatcccaccggcggcggtggcggcggcggcgtggcggcgcactacctacacatgctccgcgcgcagcagcaccagccactgtccccggcaggtgacgtcaaggcggagcggtccatgctgtcgccggatgagagccccggcgcggacgccgacctaggatcggaccacccgacgtcgtcggccatggtggcggcggaggacagcggcggcggcagcggttcgggtggcccgatgcggcgcccccgcgggaggccgctgggctccaagaacaagcccaagccgcccatcatcgtgacgcgggacagccccaacgcgttccactcccacgtcctcgaggtcgccgcgggaaccgacatcgtcgagtgcgtctgcgagttcgcgcgccgccgcggccgcggcgtctccgtgctcagcggtggcggcgccgtcgccaacgtcgcgctccgccagccaggcgcgtcgcccccgggcagcctggtcgccaccatgcgcggccagttcgagatcctgtccctcacgggcaccgtcctcccgccgcccgcgccgcccagcgccagcggcctcaccgtcttcctctccggcgggcagggccaggtggtcggcgggagcgtggccggccagctcatcgccgcggggccagtcttcctcatggccgcctcgttcgccaatgccgtctacgagcgtctgccactcgatggggaggatccggaggcagaggctgccgccgccacccctcccggcgatgcggcgcagccaaccggcccaccaccaccgcagcagcagcccacagcctcgcagtcctctgaggtgaccgccggtgacggcggcggcggcggcggtctcggcatgtatcttggaggccatgtgggatcctaccagcagcagcagcagcaacttcccggaccaggagacaacttcggtagctggagcggcagcatcaggccgccgccattctgatccaaacacctcaaatcaagctctcccccaacaacgccatgcatgtctaaatcctcacaagattcactccaagaagacgaagctg

SEQ ID NO: 1872 - protein, 322 aa, Oryza sativa
  G3400,At-hook amino acids 83-91,2nd cons. domain 91-237,DUF296 110-230
MAGMDPTGGGGGGGVAAHYLHMLRAQQHQPLSPAGDVKAERSMLSPDESPGADADLGSDHPTSSAMVAAEDSGGGSGSGGPMRRPRGRPLGSKNKPKPPIIVTRDSPNAFHSHVLEVAAGTDIVECVCEFARRRGRGVSVLSGGGAVANVALRQPGASPPGSLVATMRGQFEILSLTGTVLPPPAPPSASGLTVFLSGGQGQVVGGSVAGQLIAAGPVFLMAASFANAVYERLPLDGEDPEAEAAAATPPGDAAQPTGPPPPQQQPTASQSSEVTAGDGGGGGGLGMYLGGHVGSYQQQQQQLPGPGDNFGSWSGSIRPPPF

SEQ ID NO: 1873 - DNA, 1003 bp, Oryza sativa
  G3401,family:AT-hook
ggatatataggccgcaggtagaagctggcgagccggtggtgggacgaggggcggctcagcctgccggtgacagccgccgacccatccctcggccttggcaacaacgacaccaccggcgccggtgacgacgacatggcgtccaaggagccaagcggcgaccacgaccacgagatgaacgggaccagcgccgggggcggcgagcccaaggacggcgcggtggtgaccggccgcaaccggcgcccccgcggacggccgccgggctccaagaacaagcccaagccgcccatcttcgtgacgcgggacagcccgaacgcgctgcgcagccacgtcatggaggtggccggcggcgccgatgtcgccgagtccatcgcgcacttcgcgcggcggcggcagcgcggcgtctgcgtgctcagcggggccggcaccgtgaccgacgtggccctgcgccagccggccgcgccgagcgccgtggtggcgctccgtgggcggttcgagatcctgtccctgacggggacgttcctgccggggccggcgccgccgggctccaccgggctgaccgtgtacctcgccggcgggcaggggcaggtggtgggcggcagcgtggtggggacgctcaccgcggcggggccggtcatggtgatcgcctccaccttcgccaacgccacctacgagaggctgccgctggatcaggaggaggaggaagcagcggcaggcggcatgatggcgccgccgccactcatggccggcgccgccgatccactacttttcggcgggggaatgcacgacgccgggcttgctgcatggcaccatgcccgccctccgccgccgccgccctactagctctctagctagattaattaattaagcttcatgaattaaatccttgcttaattaattggcatatatatatactcacatgatatatatgatcaacaagctatatatagctagccagctcgagctaattaattaacaaaaggtgagccaatataatgcaagatcg

SEQ ID NO: 1874 - protein, 235 aa, Oryza sativa
  G3401,AT-hook amino acids 35-43,2nd cons. domain 43-186, DUF296 62-179
MASKEPSGDHDHEMNGTSAGGGEPKDGAVVTGRNRRPRGRPPGSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQEEEEAAAGGMMAPPPLMAGAADPLLFGGGMHDAGLAAWHHARPPPPPPY

SEQ ID NO: 1875 - DNA, 987 bp, Oryza sativa
  G3407,family:AT-hook
tcatcatcatcatcacttgcatatcgaattattaataatatcgaagatggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgcgccgccggcagcgcggggtgtgcgtgctctcggcggcggggacagtggcgaacgtcacgctccggcagccgcagtcggcgcagcccgggccggcctcgccggcggtggcgacgctgcacggcaggttcgagatactctccctcgcgggctccttcctgcccccgcccgcgccgccgggcgccaccagcctcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgaggacggcgacgaggtggtccccccggcgccggcagggagcgaccagggcggcggcggcagcggcggcatgccaccattaggcgttgatccgtcgggcggcgccgccaccggtgggctcccgttcttcaacatgccgttcgggatgccgccaatgccggtggacggccacgccggctggcctggcgccggcgtcgggaggccaccgttctcatgatggatggatccccatattccggcgagcggccggcggcgaggtggtcggcaagattgaagacatggacatgg

SEQ ID NO: 1876 - protein, 289 aa, Oryza sativa
  G3407,AT-hook amino acids 63-71,2nd cons. domain 71-220,DUF296 90-213
MAGLDLGTSYLHHHQSLHLRHDDGGAGSDDGGHDDLSPGSGGGGGPSSTAGGAGIGGGEVVARRPRGRPPGSKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLEDGDEVVPPAPAGSDQGGGGSGGMPPLGVDPSGGAATGGLPFFNMPFGMPPMPVDGHAGWPGAGVGRPPFS

SEQ ID NO: 1877 - DNA, 1064 bp, Oryza sativa
  G3408,family:AT-hook
gtggttttggttgattgctactctgtgccatgtcgttctgcgagagggacatgaacaaggagagcatgtaccaagaacgggacgacatggcggggatacggttcgcgacgccgccgctgcctcagcagcagcagcagcagcagctggtggagtgcttctccgacgaggtggacagccgcgggagtggcggcgagatgaaggatgccgtggggagcgggagtgggcagctggtcgttgttggtggcggggatggggcgagcatcgaggtggcgaagaagaggagggggaggccgccggggtccaagaacaagccgaagccacccgtggtgatcacgcgggaggcggagccggcggcggcgatgcggccgcacgtgatcgagatccccggcgggcgggacgtcgcggaggcgctcgcgcggttctcgagccgtcggaacctcgggatctgcgtgctcgccggcaccggcgcggtcgccaacgtgtcgctccgccacccgtcacccggggtcccgggctcagctccggctgcgatcgtgttccacggccggtacgagatcctctccctgtcggccacgttcctgcctccggccatgtcctccgtggcgccccaggccgcggtcgccgccgcgggcctctccatctcgctcgccggcccgcacggccagatcgtcggcggggccgtggcaggcccgctctacgccgcgaccaccgtcgtggtcgtcgccgccgccttcaccaaccccaccttccaccgcctccccgccgacgacgacgcgtcggtgtccgtctcggtgtcactctccggcagcggcgacgcggacgaacaccggggccaccagcacaaacctgagccgcaagaaccgcgccaacttcgacggccgccaccgcacctgtcagcagccgccgccgtctcagcagcacagccggtggagccatgcggcgcgcccatgtacgcctgccaccctcagccacaggaggtgatgtggccgccgccggctcgtacgccgcacccgccgccgccgccgccgtactaatccgaccgaattggtacgccattgccacat

SEQ ID NO: 1878 - protein, 334 aa, Oryza sativa
  G3408,At-hook amino acids 82-90,2nd cons. domain 90-247,DUF296 111-240
MSFCERDMNKESMYQERDDMAGIRFATPPLPQQQQQQQLVECFSDEVDSRGSGGEMKDAVGSGSGQLVVVGGGDGASIEVAKKRRGRPPGSKNKPKPPVVITREAEPAAAMRPHVIEIPGGRDVAEALARFSSRRNLGICVLAGTGAVANVSLRHPSPGVPGSAPAAIVFHGRYEILSLSATFLPPAMSSVAPQAAVAAAGLSISLAGPHGQIVGGAVAGPLYAATTVVVVAAAFTNPTFHRLPADDDASVSVSVSLSGSGDADEHRGHQHKPEPQEPRQLRRPPPHLSAAAAVSAAQPVEPCGAPMYACHPQPQEVMWPPPARTPHPPPPPPY

SEQ ID NO: 1879 - DNA, 920 bp, Oryza sativa
  G3429,family:CAAT
ccaggtcattgagacttgagagacatggcagggaacaaaaagcgtggtatagtagtatagtcagtactaggattagtacttgataactagcacaacaaaaagctactatcatttttgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtgtacactgcatgcatgcgtggagggtcaaacagagtcaagactcttgtggtggtttcaataagtctctagtgacaatataagttgtgtatcgttgtttcctttgtaaaaaaaaaaacgtcatgtatcgttgtgtgtcctcatccggtaatcctttacgtgggtgggttatggc

SEQ ID NO: 1880 - protein, 193 aa, Oryza sativa
  G3429,CAAT domain coordinates 40-124
MIILIVPLHLFWMSGGRNMDQVKKAAVRSDGVGGSATNAELPMANLVRLIKKVLPGKAKIGGAAKGLTHDCAVEFVGFVGDEASEKAKAEHRRTVAPEDYLGSFGDLGFDRYVDPMDAYIHGYREFERAGGNRRVAPPPPAAATPLTPGGPTFTDAELQFLRSVIPSRSDDEYSGSSPAIGGYGYGYGYGKNM

SEQ ID NO: 1881 - DNA, 257 bp, Zea mays
  G3431,family:MYB-related
ctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagatt

SEQ ID NO: 1882 - protein, 78 aa, Zea mays
  G3431,MYB-related domain coordinates 31-75
MDSSSGSQDKKFRDNDRPEAKEANSTAQHLVDFTEAEEDLVSRMHRLVGNRWEIIAGRIPGRTAEEVEMFWSKKYQER

SEQ ID NO: 1883 - DNA, 1290 bp, Zea mays
  G3432,family:AP2
ctatagctagcactagcagtggtgcacactgaaatggacagcgccagcagcctcgtggacgacaccagtagcggtggcggcggcggcgcgtccacggacaagctaagggctctggccgtcttcgccgccgcctcggggacgccgctggagcgcatgggcagcggcgccagcgcggtcgtggacgcggccgagccgggcgccgaggcggactccggttccggtgccgccgcggtgagcgtcggcgggaagctgccgtcgtcaaggtacaagggcgtggtgccgcagcccaacgggcggtggggcgcgcagatctacgagcgccaccagcgcgtgtggctcggcaccttcgcgggcgaggccgacgcggcgcgcgcctacgacgtcgcggcgcagcggttccgcggccgcgacgcggtcaccaacttccgcccgctcgcggacgccgacccggacgccgccgccgagctccggttcctggcgtcccgctccaaggccgaggtcgtcgacatgctccgcaagcacacctacttcgacgagctcgcgcagaacaagcgcgccttcgccgccgcgtccgcgtccgcggccaccgcctcgtcgctggccaacaacccttcttcctacgcgtcgctctcccccgcgaccgcgacggccgccgcgcgggagcacctcttcgacaagacggtcacccccagcgacgtgggcaagctgaaccggctggtgatcccgaagcagcacgccgagaagcacttcccgctgcagctcccatccgccggcggcgagagcaagggcgtgctcctcaacctggaggacgccgcgggcaaggtgtggcggttccgctactcgtactggaacagcagccagagctacgtgctcaccaagggctggagccgcttcgtcaaggagaagggcctccaagccggcgacgtcgtcggcttctaccgctccgctgccggcgccgacaccaagctcttcatcgactgcaagctgcggcccaacagcgtcgtcgtcgcctcgacggcaggcccgtcgcctccggcgccggtggcgaaggccgtgcgtctcttcggcgtcgacctgctgacggcaccggccaccgccgcggcgccggcggaggccgtggccgggtgcaagagagccagggacttgggttcgcccccgcaggcggcgttcaagaagcagctcgtggagctggcactagtgtagattaatgctacggagcgatcgatctttccctggctagctagtcttttttttttttgctcgatcgctcaactcagatggtagcatcat

SEQ ID NO: 1884 - protein, 389 aa, Zea mays
  G3432,AP2 domain coordinates 75-140,212-299
MDSASSLVDDTSSGGGGGASTDKLRALAVFAAASGTPLERMGSGASAVVDAAEPGAEADSGSGAAAVSVGGKLPSSRYKGVVPQPNGRWGAQIYERHQRVWLGTFAGEADAARAYDVAAQRFRGRDAVTNFRPLADADPDAAAELRFLASRSKAEVVDMLRKHTYFDELAQNKRAFAAASASAATASSLANNPSSYASLSPATATAAAREHLFDKTVTPSDVGKLNRLVIPKQHAEKHFPLQLPSAGGESKGVLLNLEDAAGKVWRFRYSYWNSSQSYVLTKGWSRFVKEKGLQAGDVVGFYRSAAGADTKLFIDCKLRPNSVVVASTAGPSPPAPVAKAVRLFGVDLLTAPATAAAPAEAVAGCKRARDLGSPPQAAFKKQLVELALV

SEQ ID NO: 1885 - DNA, 819 bp, Zea mays
  G3434,family:CAAT
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctaacaaagggctaatacagcagcaatttatgctagggaagtctctgcattgcttaccatgtgtattggcagaaaacaggaggcacttacaaagggtgttaatctctgcgatggctgcctctcaggtgtaaattggcttcggtttagcgctgcttttgtccgtatatttaggatgatttgactgttgctacttttggcaaccttttacatttacagatatgtattattcagcataaatataatatagtagtcctaggcctaaataatggtgattaaaaaaaaaaaaaaaa

SEQ ID NO: 1886 - protein, 164 aa, Zea mays
  G3434,CAAT domain coordinates 18-107
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNQGMGYMQPQYHNGET

SEQ ID NO: 1887 - DNA, 735 bp, Zea mays
  G3435,family:CAAT
cggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgccgcctcagccgccacagcagcagcagcaacatcaacagcatcacatggcaataggaggcagaggaggattcggccaacaaggcggcggcggcggctcctcgtcgtcgtcagggcttggccggcaagacagggcgtgagttgcgacgatacgtcagaatcagaatcgctgat

SEQ ID NO: 1888 - protein, 222 aa, Zea mays
  G3435,CAAT domain coordinates 22-111
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQQQQGELPRGAANAAGYAGYGAPGSGGMMMMMMGQPMYGGSQPQQQPPPPQPPQQQQQHQQHHMAIGGRGGFGQQGGGGGSSSSSGLGRQDRA

SEQ ID NO: 1889 - DNA, 803 bp, Zea mays
  G3436,family:CAAT
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttcaccat

SEQ ID NO: 1890 - protein, 212 aa, Zea mays
  G3436,CAAT domain coordinates 20-109
MPDSDNESGGPSNAEFSSPREQDRFLPIANVSRIMKKALPANAKISKDAKETVQECVSEFISFITGEASDKCQREKRKTINGDDLLWAMTTLGFEDYVEPLKLYLHKFRELEGEKAATTSASSGPQPPLHRETTPSSSTHNGAGGPVGGYGMYGGAGGGSGMIMMMGQPMYGGSPPAASSGSYPHHQMAMGGKGGAYGYGGGSSSSPSGLGR

SEQ ID NO: 1891 - DNA, 1322 bp, Zea mays
  G3437,family:CAAT
tattgtctatgagggaagcagatcctctacgctgcaattgggccactgacatgtgggaccaggtctagattggacccacacatcaatgaccgaaatgcagaagagggtctcgttgccactgtaagctatctcctagagttcagagcagggcaagaatcttgcaatgctcacatgaacataatataatcgttgtgttagctatgcgtcggcatcactaccgtcctcccactggcatctcccgtctactattttgggacgaacagaacagagacactagctaactagcttattagcttgctcccctccttcctttcaagctttaaaaggagaccatctcttgcaccacctcttcatccatccggccaagcaaggggcatgaagaacaggaagggctacgggcaccagggccacctgctgagccccgtgggcagcccgctgtcggacaacgagtccggcgccgcggcagcggccggcggcggcgggtgcgggagcagcgtggggtactgcggcggcggcggcggtgagtcgccggccaaggagcaagaccggttcctgccgatcgccaacgtgtcgcgcatcatgaagcgctccctgccggcgaacgccaagatctccaaggaggccaaggagacggtgcaggagtgcgtgtccgagttcatcagcttcgtcacgggggaggcctccgacaagtgccagcgcgagaagcgcaagaccatcaacggcgacgacctgctctgggccatgaccacgctcggcttcgaggcctacgtcgccccgctcaagtcctacctcaaccgctaccgcgaggccgagggcgagaaggccgccgtgctcggcggcggcgcgcgccacggcgacggcgcggcgcggcggacgacgccggcccactcgccgcgcaatggcgcgggcgggcccgtcgggggatacggcatgtacggcggcgcgggcgggggaagcggtatgatcatgatgatggggcagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggccaggttgtgaccgtcgccgtccatgcttgcatggccatggcatggctcagtcccgccgccggcttcttgcttggtgtcggtaattagcgctggttaagttaaccttcggtttttccccccttttcttttcgtggtaagtaatgttgtgctgaatggagccagtgatatggttaagatagctccataacctctcggtaaaaaaaa

SEQ ID NO: 1892 - protein, 246 aa, Zea mays
  G3437,CAAT domain coordinates 54-143
MKNRKGYGHQGHLLSPVGSPLSDNESGAAAAAGGGGCGSSVGYCGGGGGESPAKEQDRFLPIANVSRIMKRSLPANAKISKEAKETVQECVSEFISFVTGEASDKCQREKRKTINGDDLLWAMTTLGFEAYVAPLKSYLNRYREAEGEKAAVLGGGARHGDGAARRTTPAHSPRNGAGGPVGGYGMYGGAGGGSGMIMMMGQPMYGGSPPAASSGSYPHHQMAMGGKGGAYGYGGGSSSSPSGLGR

SEQ ID NO: 1893 - DNA, 268 bp, Zea mays
  G3444,family:MYB-related
cctaacccctctaatggatagcagcagtggtagccaggacaagaaattcagagacaatgatcgccctgaagcaaaagaagctaatagcaccgcacagcatcttgttgacttcacggaagcagaggaagatcttgtttccagaatgcacaggcttgtggggaacaggtgggagattatagcaggaagaatcccaggaaggacagcagaagaggtagagatgttctggtccaaaaaataccaggaaagatgaaaccgaggccttagattt

SEQ ID NO: 1894 - protein, 78 aa, Zea mays; identical to SEQ ID NO: 1882
  G3444,MYB-related domain coordinates 31-75

SEQ ID NO: 1895 - DNA, 302 bp, Glycine max
  G3445,family:MYB-related
agaacttgttattgcaatgactgacatagatcgctcctctgataatgtttcttctgattctattgagaaatcaagccaagtttctgatgttgaattttctgaagctgaggaaatccttattgccatggtgtataatctggttggagaaaggtggtctttgattgctggaagaattcctggaagaactgcagaagaaatagagaaatattggacttcaagattttcgactagccaatgaagtggcagaaattaaacgaagcaagacaattttgggtgcctgcaactcattatacagtgactta

SEQ ID NO: 1896 - protein, 73 aa, Glycine max
  G3445,MYB-related domain coordinates 25-69
MTDIDRSSDNVSSDSIEKSSQVSDVEFSEAEEILIAMVYNLVGERWSLIAGRIPGRTAEEIEKYWTSRFSTSQ

SEQ ID NO: 1897 - DNA, 257 bp, Glycine max
  G3446,family:MYB-related
gagaacttgttatgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 1898 - protein, 74 aa, Glycine max
  G3446,MYB-related domain coordinates 26-70
MADIDRSFDNNVSAVSTEKSSQVSDVEFSEAEEILIAMVYNLVGERWSLIAGRIPGRTAEEIEKYWTSRFSTSQ

SEQ ID NO: 1899 - DNA, 250 bp, Glycine max
  G3447,family:MYB-related
gttattgcaatggctgacatagatcgctcctttgataataatgtttctgctgtttctactgagaaatcaagccaagtttcagatgttgaattttctgaagctgaggaaatccttattgccatggtgtataatctggttggggagaggtggtctttgattgctggaagaattcctggaagaactgcagaagagatagagaaatattggacttcaagattttcgactagccaatgatcggtggcagaaaacg

SEQ ID NO: 1900 - protein, 74 aa, Glycine max; identical to SEQ ID NO: 1898
  G3447,MYB-related domain coordinates 26-70

SEQ ID NO: 1901 - DNA, 264 bp, Glycine max
  G3448,family:MYB-related
attctccacgcctccttgcaatggctgactcggatctctcttcaagtcaaatttctacacattctactgattcaggaaatcgagggtcttccaaagttgaattttctgaagatgaggaaaccctcatcatcaggatgtataaactggtaggggagaggtggtctataattgctggaaggattcctggaagaacagcagaggaaatagagaagtattggacttcaagattctcgggctctagtgaatgaagctccggagtactac

SEQ ID NO: 1902 - protein, 75 aa, Glycine max
  G3448,MYB-related domain coordinates 26-70
MADSDLSSSQISTHSTDSGNRGSSKVEFSEDEETLIIRMYKLVGERWSIIAGRIPGRTAEEIEKYWTSRFSGSSE

SEQ ID NO: 1903 - DNA, 268 bp, Glycine max
  G3449,family:MYB-related
actcttctagctccttgcaatggctgactcggatcgctcttctagtgaagtttctacacattctactgattcagggaagcgagggtcttccaaagttgaattttctgaagatgaggaaactcttatcatcaggatgtataaactggtaggggagaggtggtctttaattgctggaaggattcctggaagaacagcagaggaaatagagaagtattggacttcaagattctcaggttctagtgaatgaggtgccaagagttctactacc

SEQ ID NO: 1904 - protein, 75 aa, Glycine max
  G3449,MYB-related domain coordinates 26-70
MADSDRSSSEVSTHSTDSGKRGSSKVEFSEDEETLIIRMYKLVGERWSLIAGRIPGRTAEEIEKYWTSRFSGSSE

SEQ ID NO: 1905 - DNA, 285 bp, Glycine max
  G3450,family:MYB-related
cagctcagaaggcaaagatagatccatgtccaccaccgcaactacaacctctgaagaagttagcagcaatgagtggaaagtcatacacatgagcgagcaagaggaggatctcattcgcaggatgtacaagctagtcggggacaagtggaatttgatagctggtcgcattcccggtcgtaaagcagaagaaatagagagattctggattatgagacacggcgatgctttttctgttaaaagaaacggaagtaaaacccaagactcgtgattttctctggtcatgta

SEQ ID NO: 1906 - protein, 80 aa, Glycine max
  G3450,MYB-related domain coordinates 20-64
MSTTATTTSEEVSSNEWKVIHMSEQEEDLIRRMYKLVGDKWNLIAGRIPGRKAEEIERFWIMRHGDAFSVKRNGSKTQDS

SEQ ID NO: 1907 - DNA, 1253 bp, Glycine max
  G3451,family:AP2
ctagaatccgtacaatctaatcaacataacaaaaatggatgcaattagttgcatggatgagagcaccaccactgagtcactctctataagtctttctccgacgtcatcgtcggagaaagcgaagccttcttcgatgattacatcgtcggagaaggtttctctgtccccgccgccgtcaaacagactatgccgtgttggaagcggcgcgagcgcagtcgtggatcctgatggcggcggcagcggcgctgaggtagagtcgcggaaactcccctcgtcgaagtacaagggcgtggtgccccagcccaacggccgctggggtgcgcagatttacgagaagcaccagcgcgtgtggcttggaacgttcaacgaggaagacgaggcggcgcgtgcgtacgacatcgccgcgcagcggttccgcggcaaggacgccgtcacgaacttcaagccgctcgccggcgccgacgacgacgacggagaatcggagtttctcaactcgcattccaaacccgagatcgtcgacatgctgcgaaagcacacgtacaatgacgagctggagcagagcaagcgcagccgcggcgtcgtccggcggcgaggctccgccgccgccggcaccgcaaactcaatttccggcgcgtgctttactaaggcacgtgagcagctattcgagaaggctgttacgccgagcgacgttgggaaattgaaccgtttggtgataccgaagcagcacgcggagaagcactttccgttacagagctctaacggcgttagcgcgacgacgatagcggcggtgacggcgacgccgacggcggcgaagggcgttttgttgaacttcgaagacgttggagggaaagtgtggcggtttcgttactcgtattggaacagtagccagagttacgtcttaaccaaaggttggagccggttcgttaaggagaagaatctgaaagctggtgacacggtttgttttcaccggtccactggaccggacaagcagctttacatcgattggaagacgaggaatgttgttaacaacgaggtcgcgttgttcggaccggtcggaccggttgtcgaaccgatccagatggttcggctctttggggttaacattttgaaactacccggttcagatactattgttggcaataacaataatgcaagtgggtgctgcaatggcaagagaagagaaatggaactgttctcgttagagtgtagcaagaaacctaagattattggtgctttgtaacgttacgttaggc

SEQ ID NO: 1908 - protein, 401 aa, Glycine max
  G3451,AP2 domain coordinates 80-141,209-308
MDAISCMDESTTTESLSISLSPTSSSEKAKPSSMITSSEKVSLSPPPSNRLCRVGSGASAVVDPDGGGSGAEVESRKLPSSKYKGVVPQPNGRWGAQIYEKHQRVWLGTFNEEDEAARAYDIAAQRFRGKDAVTNFKPLAGADDDDGESEFLNSHSKPEIVDMLRKHTYNDELEQSKRSRGVVRRRGSAAAGTANSISGACFTKAREQLFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTVCFHRSTGPDKQLYIDWKTRNVVNNEVALFGPVGPVVEPIQMVRLFGVNILKLPGSDTIVGNNNNASGCCNGKRREMELFSLECSKKPKIIGAL

SEQ ID NO: 1909 - DNA, 1081 bp, Glycine max
  G3452,family:AP2
caccaacacaaaatggatggaggctgtgtcacagacgaaaccaccacatccagcgactctctttccgttccgccgcccagccgcgtcggcagcgttgcaagcgccgtcgtcgaccccgacggttgttgcgtttccggcgaggccgaatcccggaaactcccttcgtcgaaatacaaaggcgtggtgccgcaaccgaacggtcgctggggagctcagatttacgagaagcaccagcgcgtgtggctcggcactttcaacgaggaagacgaagccgccagagcctacgacatcgccgcgctgcgcttccgcggccccgacgccgtcaccaacttcaagcctcccgccgcctccgacgacgccgagtccgagttcctcaactcgcattccaagttcgagatcgtcgacatgctccgcaagcacacctacgacgacgagctccagcagagcacgcgcggtggtaggcgccgcctcgacgctgacaccgcgtcgagcggtgtgttcgacgcgaaagcgcgtgagcagctgttcgagaaaacggttacgccgagcgacgtcgggaagctgaatcgattagtgataccgaagcagcacgcggagaagcactttccgttaagcggatccggcgacgaaagctcgccgtgcgtggcgggggcttcggcggcgaagggaatgttgttgaactttgaggacgttggagggaaagtgtggcggtttcgttactcttattggaacagtagccagagctacgtgcttaccaaaggatggagccggttcgttaaggagaagaatcttcgagccggtgacgcggttcagttcttcaagtcgaccggaccggaccggcagctatatatagactgcaaggcgaggagtggtgaggttaacaataatgctggcggtttgtttgttccgattggaccggtcgttgagccggttcagatggttcggcttttcggggtcaaccttttgaaactacccgtacccggttcggatggtgtagggaagagaaaagagatggaactgtttgcatttgaatgttgcaagaagttaaaagtaattggagctttgtaacattacatagtgc

SEQ ID NO: 1910 - protein, 351 aa, Glycine max
  G3452,AP2 domain coordinates 51-116,171-266
MDGGCVTDETTTSSDSLSVPPPSRVGSVASAVVDPDGCCVSGEAESRKLPSSKYKGVVPQPNGRWGAQIYEKHQRVWLGTFNEEDEAARAYDIAALRFRGPDAVTNFKPPAASDDAESEFLNSHSKFEIVDMLRKHTYDDELQQSTRGGRRRLDADTASSGVFDAKAREQLFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAVQFFKSTGPDRQLYIDCKARSGEVNNNAGGLFVPIGPVVEPVQMVRLFGVNLLKLPVPGSDGVGKRKEMELFAFECCKKLKVIGAL

SEQ ID NO: 1911 - DNA, 1442 bp, Glycine max
  G3453,family:AP2
acgagtatagctcttaaaatactcaacaataaccaaacctaatcaaaacccttatctacactcacttcacacaaaccaaagttagttcgttaaccgttacaaacacaaaatggatggaggcagtgtcacagacgaaaccaccacaaccagcaactctctttcggttccggcgaatctatctccgccgcctctcagccttgacggaagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgtcagagcctacgacatcgtcgcgcatcgcttccgcggccgcgacgccgtcactaacttcaagcctctcgccggcgccgacgacgccgaagccgagttcctcagcacgcattccaagtccgagatcgtcgacatgctccgcaggcacacctacgacaacgagctccagcagagcacccgcggcggcaggcgccgccgggacgccgaaaccgcgtcgagcggcgcgttcgacgcgaaggcgcgtgagcagctggtcgagaaaaccgttacgccgagcgacgtcgggaagctgaaccgattagtgataccaaagcagcacgcggagaagcactttccgttaagcggatccggcggcggagccttgccgtgcatggcggcggctgcgggggcgaaaggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagtttcttttgttaattttgtaactgttgaattcgtgaggtagagatggtgatggcgttgttgttgcaagttgccactcacaaaacgtgtatattcttaatttgatgggaaaaaaaaggagaaattagggcaagaagaattgtataatgcaaaggtttttttcaaaagaaaggaacatggagtgccactatttatttttgtaaaaaaacagagaaaagggcggcccgc

SEQ ID NO: 1912 - protein, 362 aa, Glycine max
  G3453,AP2 domain coordinates 57-122,177-272
MDGGSVTDETTTTSNSLSVPANLSPPPLSLDGSGATAVVYPDGCCVSGEAESRKLPSSKYKGVVPQPNGRWGAQIYEKHQRVWLGTFNEEDEAVRAYDIVAHRFRGRDAVTNFKPLAGADDAEAEFLSTHSKSEIVDMLRRHTYDNELQQSTRGGRRRRDAETASSGAFDAKAREQLVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAVQFFKSTGLDRQLYIDCKARSGKVNNNAAGLFIPVGPVVEPVQMVRLFGVDLLKLPVPGSDGIGVGCDGKRKEMELFAFECSKKLKVIGAL

SEQ ID NO: 1913 - DNA, 1301 bp, Glycine max
  G3455,family:AP2
tcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggcttcgtacgtcggcgcggctccgccgccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgttagcgcgacggcgacggcggcgaagggcgttttgttgaacttcgaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttttgagttttgtgactgatgaaagaaagaaggtacaagaagaacggcggtgtagtggcatagtggcatcgcaagttg

SEQ ID NO: 1914 - protein, 384 aa, Glycine max
  G3455,AP2 domain coordinates 74-143,201-300
MDAISCLDESTTTESLSISQAKPSSTIMSSEKASPSPPPPNRLCRVGSGASAVVDSDGGGGGGSTEVESRKLPSSKYKGVVPQPNGRWGSQIYEKHQRVWLGTFNEEDEAARAYDVAVQRFRGKDAVTNFKPLSGTDDDDGESEFLNSHSKSEIVDMLRKHTYNDELEQSKRSRGFVRRRGSAAGAGNGNSISGACVMKAREQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQRSTGPDRQLYIDWKTRNVVNEVALFGPVVEPIQMVRLFGVNILKLPGSDSIANNNNASGCCNGKRREMELFSLECSKKPKIIGAL

SEQ ID NO: 1915 - DNA, 869 bp, Glycine max
  G3456,family:AT-hook
tcgacaacttcaacttttgttatggccaaccggtggtggaccgggtcggtgggtctagagaactctggccactcgatgaaaaaaccggatctggggttttccatgaacgagagtacggtgacggggaaccatataggagaagaagatgaggacagagaaaacagcgacgagccaagagagggagctattgacgtcgccaccacgcgccgccctaggggacgtccaccgggctccagaaacaagccgaaaccgccgatattcgtcacccgagacagccctaacgcgctgcggagccacgtcatggagattgccgtcggagccgacatcgccgactgcgtggcgcagttcgctcggaggcgccagcgcggggtttccattctcagcggcagcgggaccgtcgtcaacgtcaatctccggcaacccacggcacccggcgccgtcatggcgctccacggccgcttcgacatcctctccctcaccggctcctttctccctgggccgtcccctcccggcgccaccgggctcacaatctacctcgccggaggccaggggcagatcgtcggcggcggagtggtgggcccgctcgtggcggcgggccccgtattggtaatggcggctactttttccaatgctacgtatgaaagattgcctttagaggatgatgatcaggaacaacacggcggcggaggcggaggaggttcgccgcaggaaaaaaccgggggtcccggcgaggcgtcgtcgtcgatttcggtttataacaataatgttcctccgagtttaggtcttccgaatgggcaacatctgaaccatgaagcttattcttctccttggggtcattctcctcatgccagacctcctttctaattagc

SEQ ID NO: 1916 - protein, 262 aa, Glycine max
  G3456,AT-hook amino acids 44-52,2nd cons. domain 52-195, DUF296 71-188
MKKPDLGFSMNESTVTGNHIGEEDEDRENSDEPREGAIDVATTRRPRGRPPGSRNKPKPPIFVTRDSPNALRSHVMEIAVGADIADCVAQFARRRQRGVSILSGSGTVVNVNLRQPTAPGAVMALHGRFDILSLTGSFLPGPSPPGATGLTIYLAGGQGQIVGGGVVGPLVAAGPVLVMAATFSNATYERLPLEDDDQEQHGGGGGGGSPQEKTGGPGEASSSISVYNNNVPPSLGLPNGQHLNHEAYSSPWGHSPHARPPF

SEQ ID NO: 1917 - DNA, 1596 bp, Glycine max
  G3459,family:AT-hook
ctgtcgcgtgggaaacaaatggctgcattgtgagttctttgtccccttcaacctcatttcaattctctctctcccccattcttacttcacccgcgccccctcccccgcccgctcccgtcccttttctttctctgcactccatctttctttccaaaacccacccttttctattcctcttcctcttcctccttttcccttctttttatttccttacactcacaacatttcccttaaaataaacataaacaaaccagcactgttcttgacccccaaaaaaaaaaaatctctactatttattaactatattaattcctccataatataatcatttgttttccttgttttctgttttctcttataatatataaccttcttttatctattttttctgttttgcaccttgtgattgtgagttatatctatttatatttatatatcattctctctcttttttttggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagagttcatgaagatgttgacggaggatttatatcacaaaaggctttatattattttaaggtcagcaaattaatattcatggactacaacatatatataaactatatgttttttcttcttcttcatgttattttgtttttttcttatgttgttaatggatataatatgacatgataattattatgtagtctgattttcatctccttggaattttatatacttatttcccctgttaaaaaaaaa

SEQ ID NO: 1918 - protein, 295 aa, Glycine max
  G3459,domain coordinates 77-85,85-228
MAGLDLGSASRFVQNLHRPDLHLQQNFQQHQDQQHQRDLEEQKTPPNHRMGAPFDDDSDDRSPGLELTSGPGDIVGRRPRGRPPGSKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEEDEQQQQQQQLQIQPPATTSSQGNNNNNNPFPDPSSGLPFFNLPLNMQNVQLPVEGWAVNPASRPQPF

SEQ ID NO: 1919 - DNA, 862 bp, Glycine max
  G3460,family:AT-hook
tatggctggtttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcctggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggtaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacaacaacaacaacagcttcagattcagtcacccgcaacgacgtcatctcaaggaaacaacaacaataaccctttccctgacccttcttcaggacttcccttcttcaacttaccactcaatatgcagaatgttcagttaccacctttttgagggttcatgaatctgataatatgagactga

SEQ ID NO: 1920 - protein, 276 aa, Glycine max
  G3460,domain coordinates 74-82,82-225
MAGLDLGSASRFVQNLHLPDLHLQQNYQQPRHKRDSEEQETPPNPGTALAPFDNDDDKSQGLELASGPGDIVGRRPRGRPSGSKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEEDEQQQQQLQIQSPATTSSQGNNNNNPFPDPSSGLPFFNLPLNMQNVQLPPF

SEQ ID NO: 1921 - DNA, 555 bp, Glycine max
  G3470,family:CAAT
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttcta

SEQ ID NO: 1922 - protein, 174 aa, Glycine max
  G3470,CAAT domain coordinates 27-116
MSDAPASPSHESGGEQSPRGSLSGAAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSARPDQVGLAGQNAQLVHQGSLNYIGLQVQPQHLVMPSMQGHE

SEQ ID NO: 1923 - DNA, 556 bp, Glycine max
  G3471,family:CAAT
gtagggtttgtgagatgtcggatgcgccaccgagcccgactcatgagagtgggggcgagcagagcccgcgcggttcgtcgtccggcgcgagggagcaggaccggtacctcccgattgccaacatcagccgcattatgaagaaggctctgcctcccaacggcaagattgcaaaggatgccaaagacaccatgcaggaatgcgtttctgagttcatcagcttcattaccagcgaggcgagtgagaaatgccagaaggagaagagaaagacaatcaatggagacgatttgctatgggccatggccactttaggatttgaagactacatagagccgcttaaggtgtacctggctaggtacagagaggcggagggtgacactaaaggatctgctagaagtggtgatggatctgctacaccagatcaagttggccttgcaggtcaaaattctcagcttgttcatcagggttcgctgaactatattggtttgcaggtgcaaccacaacatctggttatgccttcaatgcaaagccatgaatagtttagatgcttctacgcatc

SEQ ID NO: 1924 - protein, 173 aa, Glycine max
  G3471,CAAT domain coordinates 26-115
MSDAPPSPTHESGGEQSPRGSSSGAREQDRYLPIANISRIMKKALPPNGKIAKDAKDTMQECVSEFISFITSEASEKCQKEKRKTINGDDLLWAMATLGFEDYIEPLKVYLARYREAEGDTKGSARSGDGSATPDQVGLAGQNSQLVHQGSLNYIGLQVQPQHLVMPSMQSHE

SEQ ID NO: 1925 - DNA, 547 bp, Glycine max
  G3472,family:CAAT
taaggctagctagctagccatggctgagtcggacaacgagtccggaggtcacacggggaacgcaagcggaagcaacgaattctccggttgcagggagcaagacaggttccttccgatagcgaacgtgagcaggatcatgaagaaggcgttgccggcgaacgcgaagatctcgaaggaggcgaaggagacggtgcaggagtgcgtgtcggagttcatcagcttcataacaggagaagcgtccgataagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcaacagcagcagcatcagggacacgtgtatggatctggaactactactggatcagcatcttctgcaagaactagataacaggtttatgca

SEQ ID NO: 1926 - protein, 171 aa, Glycine max
  G3472,CAAT domain coordinates 25-114
MAESDNESGGHTGNASGSNEFSGCREQDRFLPIANVSRIMKKALPANAKISKEAKETVQECVSEFISFITGEASDKCQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 1927 - DNA, 1818 bp, Glycine max
  G3473,family:CAAT
tttttaaataataaaatgtttctttggaaatttcttaaaaagtatgaacataaatttaaattattattttatattaaatgcacttatgttaatttatttgtcttgcatacacatttaatgttatccttctttatatctatattaaactatatatataaagaaaagattttgaaatttgaataagataagagtgtccaggtcagaggcgagcacgtgccagataccaaagcaacggtccagatcatggagcactcaccaaatccaagggctccaattcgtccgtggacactcacacttatcgactaacaacggtccacaaatcgccacgtgtcctcaagataaagcgttattaacccttctgatccaacggatcctgctcattatctcccaaacaaacccctccgttccgtttcacctttccccttcccgccggagccgccgtcaccggtcgctggccaccgtatccgaccctcccaatacaccctttccgagtcccacacaaaattgcacgattctgtgatttcaattttcaggtctcgaggatttcgtttcagaagcgcttccatttgacgcagaaccaccgactcaaaccgattcgcgccgagttcgtgactcgaattttcaacttctcattcatattccaaatcgaatttgaaactccgaagaaaaattcaccgaacactgaatctcagtttccaaggagcttcttctacgaagagcgcttcaattccacgcagaaccaccaagtcaagccggttcgtgactcggattctcaattcctcgttcattcccgaacgaattttaaattccgaagaaaaccgcaccgaacactgaatttcagattctgaacaagtttcttccgcgaaacagcacagcacttcaatttcacgtggaacagagacaaagggattcgtggttcgaattctcaatcgattttcaaattccgaacagcgaacagtacttcaatttcacgtcgaactagtcaaagcgattcaaatcgatttcgcgaactcgtccgatattttccctgcactgacttagtgattcgtttcatctttctcagcgcgtcttcgatttttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcggagttcatcagcttccattcaccggggggcctcgccggtgagtgccagaaggagaagaggaagacgatcaacggcgatgatctgctgtgggccatgaccacgctgggattcgaggagtacgtggagcctctcaaggtttatctgcataagtatagggagctggaaggggagaaaactgctatgatgggaaggccacatgagagggatgagggttatggtcatgcaactcctatgatgatcatgatggggcatcagcagcagcagcatcagggacacgtgtatggatctggaactactactggatcagcatcttctgcaagaactagataacaggtttatgcatgtgttatctcatctgtttaagcttattaagggtggtctttttggatggtgattttgtttgattttagaaacaccccagctccagcttgtaattgttgcttgaaacttcgttgttgagagaatatagccattattgtggatggtgatgtgacatgcacagaatttttgtattcttctttcttccaatggatttatctcgggccc

SEQ ID NO: 1928 - protein, 170 aa, Glycine max
  G3473,CAAT domain coordinates 23-113
MADSDNDSGGAHNGGKGSEMSPREQDRFLPIANVSRIMKKALPANAKISKDAKETVQECVSEFISFHSPGGLAGECQKEKRKTINGDDLLWAMTTLGFEEYVEPLKVYLHKYRELEGEKTAMMGRPHERDEGYGHATPMMIMMGHQQQQHQGHVYGSGTTTGSASSARTR

SEQ ID NO: 1929 - DNA, 553 bp, Glycine max
  G3474,family:CAAT
gatatccatggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatagcatgtgtcatct

SEQ ID NO: 1930 - protein, 177 aa, Glycine max
  G3474,CAAT domain coordinates 25-114
MAESDNESGGHTGNASGSNELSGCREQDRFLPIANVSRIMKKALPANAKISKEAKETVQECVSEFISFITGEASDKCQKEKRKTINGDDLLWAMTTLGFEDYVDPLKIYLHKYREMEGEKTAMMGRPHERDEGYGHGHGHATPMMTMMMGHQPQHQHQHQHQGHVYGSGSASSARTR

SEQ ID NO: 1931 - DNA, 600 bp, Glycine max
  G3475,family:CAAT
tcgattatccgtttgtcgatggcggactcggacaacgactccggcggcgcgcacaacgccgggaaggggagcgagatgtcgccgcgggagcaggaccggttcctgccgatcgcgaacgtgagccgcatcatgaagaaggcgctgccggcgaacgcgaagatctcgaaggacgcgaaggagacggtgcaggagtgcgtgtcggagttcatcagcttcatcaccggcgaggcctccgacaagtgccagcgggagaagcgcaagacgatcaacggcgacgacctgctctgggcgatgaccactctcggcttcgaggactacgtcgagcctctcaagggctacctccagcgcttccgagaaatggaaggagagaagacagtggcggcgcgtgacaaggacgcgcctcctcctaccaatgctaccaacagtgcctacgagagtcctagttatgctgctgctcctggtggaatcatgatgcatcagggacacgtgtacggttctgccggcttccatcaagtggctggtggtgctataaagggtgggcctgtttatcccgggcctggatccaatgccggtaggcccaggtagatgggcctatgttat

SEQ ID NO: 1932 - protein, 188 aa, Glycine max
  G3475,CAAT domain coordinates 23-112
MADSDNDSGGAHNAGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPPTNATNSAYESPSYAAAPGGIMMHQGHVYGSAGFHQVAGGAIKGGPVYPGPGSNAGRPR

SEQ ID NO: 1933 - DNA, 528 bp, Glycine max
  G3476,family:CAAT
ggattgattgtgaagatggctgagtcggacaacgactcgggaggggcgcagaacgcgggaaacagtggaaacttgagcgagttgtcgcctcgggaacaggaccggtttctccccatagcgaacgtgagcaggatcatgaagaaggccttgccggcgaacgcgaagatctcgaaggacgcgaaggagacggtgcaggaatgcgtgtcggagttcatcagcttcataacgggtgaggcgtcggacaagtgccagagggagaagcgcaagaccatcaacggcgacgatcttctctgggccatgacaaccctgggattcgaagagtacgtggagcctctgaagatttacctccagcgcttccgcgagatggagggagagaagaccgtggccgcccgcgactcttctaaggactcggcctccgcctcctcctatcatcagggacacgtgtacggctcccctgcctaccatcatcaagtgcctgggcccacttatcctgcccctggtagacccagatgacgtgctcctctattc

SEQ ID NO: 1934 - protein, 165 aa, Glycine max
  G3476,CAAT domain coordinates 26-115
MAESDNDSGGAQNAGNSGNLSELSPREQDRFLPIANVSRIMKKALPANAKISKDAKETVQECVSEFISFITGEASDKCQREKRKTINGDDLLWAMTTLGFEEYVEPLKIYLQRFREMEGEKTVAARDSSKDSASASSYHQGHVYGSPAYHHQVPGPTYPAPGRPR

SEQ ID NO: 1935 - DNA, 602 bp, Glycine max
  G3478,family:CAAT
ttccgttagtcgatggcggactccgacaacgactccggcggcgcgcacaacggcggcaaggggagcgagatgtcgccgcgggagcaggaccggtttctcccgatcgcgaacgtgagccgcatcatgaagaaggcgctgccggcgaacgcgaagatctcgaaggacgcgaaggagacggtgcaggagtgcgtgtcagagttcatcagcttcatcaccggcgaggcctccgacaagtgccagcgcgagaagcgcaagacgatcaacggcgacgacctgctctgggcgatgaccactctgggcttcgaggactacgtggagcctctcaaaggctacctccagcgcttccgagaaatggaaggagagaagaccgtggcggcgcgtgacaaggacgcgcctcctcttacgaatgctaccaacagtgcctacgagagtgctaattatgctgctgctgctgctgttcctggtggaatcatgatgcatcagggacacgtgtacggttctgccggcttccatcaagtggctggcggggctataaagggtgggcctgcttatcctgggcctggatccaatgccggtaggcccagataaagagcctattatta

SEQ ID NO: 1936 - protein, 191 aa, Glycine max
  G3478,CAAT domain coordinates 23-112
MADSDNDSGGAHNGGKGSEMSPREQDRFLPIANVSRIMKKALPANAKISKDAKETVQECVSEFISFITGEASDKCQREKRKTINGDDLLWAMTTLGFEDYVEPLKGYLQRFREMEGEKTVAARDKDAPPLTNATNSAYESANYAAAAAVPGGIMMHQGHVYGSAGFHQVAGGAIKGGPAYPGPGSNAGRPR

SEQ ID NO: 1937 - DNA, 736 bp, Oryza sativa
  G3479,family:MADS
aatccagctgagatcgatcgatcgatcgatggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggtaa

SEQ ID NO: 1938 - protein, 235 aa, Oryza sativa
  G3479,MADS domain coordinates 2-57
MGRGKIVIRRIDNSTSRQVTFSKRRNGIFKKAKELAILCDAEVGLVIFSSTGRLYEYASTSMKSVIDRYGRAKEEQQHVANPNSELKFWQREAASLRQQLHSLQENHRQLMGQDLSGLGVKELQTLENQLEMSIRCIRTKKDQLMIDEIHELNRKGSLIHQENMELYRKVNLIRQENAELYKKLYETGAENEANRDSTTPYNFAVIEEANTPARLELNPPSQQNDAEQTTPPKLG

SEQ ID NO: 1939 - DNA, 723 bp, Oryza sativa
  G3480,family:MADS
atggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatga

SEQ ID NO: 1940 - protein, 240 aa, Oryza sativa
  G3480,MADS domain coordinates 2-57
MGRGKIVIRRIDNSTSRQVTFSKRRNGIFKKAKELAILCDAEVGLMIFSSTGRLYEYSSTSMKSVIDRYGKSKDEQQAVANPNSELKFWQREAASLRQQLHNLQENHRQLMGEDLSGLNVKELQSLENQLEISLRSVRTKKDHVLIDEIHELNRKGSLVHQENMELYKKISLIRQENAELYKKIYETEGPSEVNRDSPTPYNFAVIEKTNVPVQLGLSTLPQHSDAEQSTAPKLGLQLNP

SEQ ID NO: 1941 - DNA, 782 bp, Oryza sativa
  G3481,family:MADS
gtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaacatgaaaactgtgatagaccggtataccaacgcaaaggaggagctacttggcgggaatgcaacttcagaaattaagatttggcagagggaggcagcaagcttgaggcagcaactgcacaacttgcaagaaagccacaagcaactgatgggtgaggagctttctggcctaggtgttagagacctacaaggtttagagaataggcttgaaataagtctacgtaatatcagaatgagaaaggacaatcttttgaaaagtgaaatcgaggagttacatgtgaagggaagcctaattcaccaggaaaacatcgaactttctagaagcctaaatgtcatgtcgcaacaaaaattggaactgtataacaagcttcaggcctgtgaacagagaggtgccacagatgcaaatgaaagttccagcactccatacagctttcgtatcatacaaaatgctaatatgcctcctagtcttgaattgagccaatcacagcaaagagaaggggagtgcagcaaaacagctgctccagaactgggacttcatctgccttaagactatgccgtacaagctggacgataagt

SEQ ID NO: 1942 - protein, 241 aa, Oryza sativa
  G3481,MADS domain coordinates 2-57
MGRGKIVIRRIDNSTSRQVTFSKRRNGLLKKAKELSILCDAEVGLVVFSSTGRLYEFSSTNMKTVIDRYTNAKEELLGGNATSEIKIWQREAASLRQQLHNLQESHKQLMGEELSGLGVRDLQGLENRLEISLRNIRMRKDNLLKSEIEELHVKGSLIHQENIELSRSLNVMSQQKLELYNKLQACEQRGATDANESSSTPYSFRIIQNANMPPSLELSQSQQREGECSKTAAPELGLHLP

SEQ ID NO: 1943 - DNA, 636 bp, Oryza sativa
  G3482,family:MADS
atgagggggaagggatgctggagcaaaggagaggagggtcaagaggagaagataaaaattaaggagaggatggaggagagaaaaaggtgcagcgtatctagagaaagtagtttctgcacatctgatacccacgccataggtatatttctagctcatttcaggactacccaattttatgaggtggatggtttcaatctttgtttggagttctggcaagcagaggcggaacgtttaaaacagcaactgcataacttagaaggaagtcaaaggcagttgttggcacatgatctctctggccttgaatggaatgacctgaagagtctagaaaatcaactggagacgagcttgcataacgttcgtctaaagaaggacaaaatcatggtcgaacaaattcaagaattgagaaagaaggagaacatcatgcaccgagaaaacatggaactccaccgtgagttcaacatgatccgtcaagatagtgtgaatttccagcgaaaggtttatggaaaacaagatgtaaatggaggacagggaagttctgttactcagaacaccaatactcaggatgatgcagacgaaattcgtcttgagctaagccaaccacaggttccggatgagaaaccagaagcagcagcataa

SEQ ID NO: 1944 - protein, 211 aa, Oryza sativa
  G3482,MADS domain coordinates 2-57
MRGKGCWSKGEEGQEEKIKIKERMEERKRCSVSRESSFCTSDTHAIGIFLAHFRTTQFYEVDGFNLCLEFWQAEAERLKQQLHNLEGSQRQLLAHDLSGLEWNDLKSLENQLETSLHNVRLKKDKIMVEQIQELRKKENIMHRENMELHREFNMIRQDSVNFQRKVYGKQDVNGGQGSSVTQNTNTQDDADEIRLELSQPQVPDEKPEAAA

SEQ ID NO: 1945 - DNA, 354 bp, Oryza sativa
  G3483,family:MADS
atggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaaggaatatatgtcctcagacttgtttaaagtggttaaagtagggatatctgttgattctaggtatctgtactgtataatattccaccaggcatag

SEQ ID NO: 1946 - protein, 117 aa, Oryza sativa
  G3483,MADS domain coordinates 2-57
MGRGKIEIKRIDNATSRQVTFSKRRSGLFKKARELSILCDAEVGLLVFSSTSRLYDFASSSMKSIIERYNETKEDPHQTMNASSEAKEYMSSDLFKVVKVGISVDSRYLYCIIFHQA

SEQ ID NO: 1947 - DNA, 745 bp, Glycine max
  G3484,family:MADS
tttgaccaaagatggggagaggtaagattgcgattcgaaggatcgacaactccactagccggcaagtgactttctcaaagagaagaaatggattgctgaagaaagctagagaattatcaattctttgtgatgctgaagttggattgatggtgttctccagcactgggaagctttatgactatgcaagcacaagcatgaaagcggttattgaacgctacaacaagctaaaagaggaaacccatcacctcatgaatccggcttcagaagagaagttttggcagacagaagcagcaagcttgaggcagcagcttcagtacttgcaagaatgccacaggcaattaatgggggaagaacttacgggtttgggtattaaagaactacaaaatctggaaaaccaactggagatgagtttaaagggtgtccgcatgaaaaaggatcaaattttaactaatgagattaaagaactacgccaaaagggaaatatcattcatcaagaaaatgttgaactctatcaaaagatggagcagatccaaaaagaaaatgcagagctacaaaagaaggtttatgaagcaaggagtacaaatgaagaaaatgtggcatccaatccttcttacaacgtcagaaatggatatgattcacttgcatctatcagtctccagctaagtcagccacagtctcaatacaaatacagtgaaccatcaaccaaagcaatgaaactcggattgcagctgcattagcaaaaact

SEQ ID NO: 1948 - protein, 241 aa, Glycine max
  G3484,MADS domain coordinates 2-57
MGRGKIAIRRIDNSTSRQVTFSKRRNGLLKKARELSILCDAEVGLMVFSSTGKLYDYASTSMKAVIERYNKLKEETHHLMNPASEEKFWQTEAASLRQQLQYLQECHRQLMGEELTGLGIKELQNLENQLEMSLKGVRMKKDQILTNEIKELRQKGNIIHQENVELYQKMEQIQKENAELQKKVYEARSTNEENVASNPSYNVRNGYDSLASISLQLSQPQSQYKYSEPSTKAMKLGLQLH

SEQ ID NO: 1949 - DNA, 1019 bp, Glycine max
  G3485,family:MADS
attcggctcgaagggcgctttgtctgttataatcaacgcgctcctcacgagtgaatttctggttcggaaggatctgattgttagggtttggtatggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaaattttggcaaagggaggcagcaatgttaaggcaacaattacacaatttgcaagaaagtcaccgcaggaaaatgatgggggaagaactgtcaggcttgacagtcaaagaattaccaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctcacaaatggtctaggcataggagaggatttgcaagtgcctgtgaatctccagctaagccagccaagcaccagcaacaacactacaaggcaccttcaggaactacaaaaatgggcagattgcaattgcattgatccatatacaggatgcgtgtgtttcacaattgctatcaagaaaaatggactcagatttaaacctcgatgtcttcgtataaatgttgtggcatatagaccacagacaaattggcttaaagattttaatttgaaattatcagaaaaagaaaaggcaaccctagcatgtatgtaagaaacaatgaaagcatcttatgagaaaccaagactcaaatcaaggaagaaattcttccacccgccc

SEQ ID NO: 1950 - protein, 286 aa, Glycine max
  G3485,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELPNLENQLEISLHGVRMKKDQLLMGEIQELNRKGNLIHQENVELYKKVYGTQDDNETNRDSVLTNGLGIGEDLQVPVNLQLSQPSTSNNTTRHLQELQKWADCNCIDPYTGCVCFTIAIKKNGLRFKPRCLRINVVAYRPQTNWLKDFNLKLSEKEKATLACM

SEQ ID NO: 1951 - DNA, 691 bp, Zea mays
  G3487,family:MADS
ggagatggggagagggaagatagagatcaagaggatcgacaacgcgacgagccggcaggtaacgttctccaagcgccggggcgggctgttcaagaaggccaaggagctcgccatcctttgcgatgccgaggtcggcctcgtcgtcttctccagcaccggccgcctgtatcacttcgctagcaccagcatggaatctgtgattgaaagatacgaggaaagagaggggcaccatcagactatgagcgcaagtgctgaggccaagctttggcaaagggaggcaggaagcttgaggcagcaactgcataacttgcaagagcaccatcggaagttgttgggtcagcagctctctggcctggacgtgagagatttgcagaatttagagaatcagctggagacaagcctaagaaatattcgtctaaagatggaccaacttattttttatcagattcaagaattaaacaggaagggatacctcatgcaccaggaaaacatagaactacacaacaaagtcaaccttcttcatcaagagaacattaaattacgtagaaaggcgtatggacaaggagtaaatgagcatccaacaagtactacagttagacacagtattctgaatacagagaatgaagatgttcggatcaatcttgagctgagtgtgcaaagggacaaatcagaaacaccaagtgtagggtga

SEQ ID NO: 1952 - protein, 228 aa, Zea mays
  G3487,MADS domain coordinates 2-57
MGRGKIEIKRIDNATSRQVTFSKRRGGLFKKAKELAILCDAEVGLVVFSSTGRLYHFASTSMESVIERYEEREGHHQTMSASAEAKLWQREAGSLRQQLHNLQEHHRKLLGQQLSGLDVRDLQNLENQLETSLRNIRLKMDQLIFYQIQELNRKGYLMHQENIELHNKVNLLHQENIKLRRKAYGQGVNEHPTSTTVRHSILNTENEDVRINLELSVQRDKSETPSVG

SEQ ID NO: 1953 - DNA, 1209 bp, Zea mays
  G3488,family:MADS
gaattcccgggtcgacccacgcgtccgcccacgcgtccggtcgtcctcttctctcgcctccaataattcgtaaccattctccttccaggccgggctcctgctggccggagttcccatctccctctttccttctcggttactatccgtgagtgtgcctgcccccgtgtgtgcgcgtgcaagatcgaccgggcgcagcttcacgatggggcgcggcaagatagtgatccgccggatcgacaactccacgagccggcaggtgacgttctccaagcggcggaacgggatcttcaagaaggcaagggagctcgccatactctgcgacgcagaggtcgggttggtcatcttctccagcaccggtcgtctctatgaatacgccagcacaagcataaagtcagtgattgatcgatatggtcgagcaaaggaggaggagcatgtagcagaccccaacacagagcttaagttctggcaaagggaggcagcaagcttgagacaacaactgcacaacttgcaagaaaatcatcggaggcagttgatgggacaaaatctttctggactaggtgtcaagggacttcaaaatctagaaaatcagctagagatgagcatttgttgcatccggacaaaaaaggaccaactcttggttgacgaaattcacgaactgaatcgaaagggaagtctcatccaacaagacaacatgggattacacagaaaggtcaacctaattcgtcaagaaaatgccgaattatataagaagctctatgagaaagaagcagaaggtgaagtcaaccgagattcaacaactccgtacaactttgtagttgcagagggtgccaacgttcctatccatcttgagcttaatattccactgcaagaaaatggtgttgagcaacctgtggctcctaaattagggttgcaattaaatcaatgaagacatgcaggacattgcctttgttctcattgtccttgaagtctgcaactcaaagcagcctaaaatgataggttgtaacaggcctaaaaacattgcaagacaaataaagtatgcatgccagagacagtggcaatggtagtgcaaatctatctcaaataacttgtgttatattgaataatccagcaaatggtttgttttttacacgttatgcaagtttgtttgaccaaaatggtatgtaacatgtacaaatttccaagtgaacttattgaaaaaattctataaaa

SEQ ID NO: 1954 - protein, 240 aa, Zea mays
  G3488,MADS domain coordinates 2-57
MGRGKIVIRRIDNSTSRQVTFSKRRNGIFKKARELAILCDAEVGLVIFSSTGRLYEYASTSIKSVIDRYGRAKEEEHVADPNTELKFWQREAASLRQQLHNLQENHRRQLMGQNLSGLGVKGLQNLENQLEMSICCIRTKKDQLLVDEIHELNRKGSLIQQDNMGLHRKVNLIRQENAELYKKLYEKEAEGEVNRDSTTPYNFVVAEGANVPIHLELNIPLQENGVEQPVAPKLGLQLNQ

SEQ ID NO: 1955 - DNA, 784 bp, Zea mays
  G3489,family:MADS
aagaagagagctagctataggccggagatcgatggggaggggaaagatcgtgatccgcaggatcgataactccacgagccggcaggtgaccttctccaagcgccggaacgggatcttcaagaaggccaaggagctcgccatcctctgcgatgcggaggtcggcctcgtcatcttctccagcaccggccgcctctacgagtactctagcaccagcatgaaatcagttatagatcggtacggcaaggccaaggaagagcagcaagtcgtcgcaaatcccaactcggagcttaagttttggcaaagggaggcagcaagcttgagacaacaactgcacaacttgcaagaaaattatcggcagttgacgggagatgatctttctgggctgaatgtcaaagaactgcagtccctggagaatcaattggaaacaagcctgcgtggtgtccgcgcaaagaaggaccatctcttgatagatgagattcacgatttgaatcgaaaggcaagtttatttcaccaagaaaatacagacttgtacaataagatcaacctgattcgccaagaaaatgatgagttacataaaaagatatatgagactgaaggaccaagtggagttaatcgggagtcaccgactccattcaactttgcagtagtagaaaccagagatgttcctgtgcaacttgaactcagcacactgccacagcaaaataacattgagccatctactgctcctaagctaggattgcaattaattccatgaagaagagtaaaactgccgtcttatgatgct

SEQ ID NO: 1956 - protein, 240 aa, Zea mays
  G3489,MADS domain coordinates 2-57
MGRGKIVIRRIDNSTSRQVTFSKRRNGIFKKAKELAILCDAEVGLVIFSSTGRLYEYSSTSMKSVIDRYGKAKEEQQVVANPNSELKFWQREAASLRQQLHNLQENYRQLTGDDLSGLNVKELQSLENQLETSLRGVRAKKDHLLIDEIHDLNRKASLFHQENTDLYNKINLIRQENDELHKKIYETEGPSGVNRESPTPFNFAVVETRDVPVQLELSTLPQQNNIEPSTAPKLGLQLIP

SEQ ID NO: 1957 - DNA, 1105 bp, Zea mays
  G3490,family:HB
gccatctgttcaaaataaatatatatataatcgtcgtcatgcatatttcgatttttcgaatcgtgcgaaactagcttgtctgttgtgtttacttatatatattctgaaagtactccgtattttctggagtcaagaacagcatactgtattttctgtgatttttaaaggagctaacttggctatatatgaacaaccgatggttgttgcttggcggccgcagaggggtttggatgcaacaacaacaacgggagcgggaacgggtaacaacatgagggacctggacatgaaccagccggcgagcggcggcgaggaggaggagttcccaatggggagcgtggaggaggaggaggacgagcgcggcggcgccggcgggccgcaccgcgccaagaagctccggctgtccaaggagcagtcccgcctcctggaggagagcttccgcctcaaccacaccctcacaccgaagcaaaaggaggccttggctgtcaagctcaagctgcggcccaggcaggtggaggtctggttccagaaccgcagggctaggacgaagcttaagcagacggagctggagtgcgagtacctgaagcgctgcttcggctcgctgaccgaggagaaccggcggctgcagcgggaggtggaggagctgcgcgcgatgcgggtggccccgcccaccgtgctctccccgcacacccggcagccgctcccggcgtccgcgctcgccatgtgcccgcgctgcgagcgcatctccgccgcaacggccggcgcgcaccccacgcccggcgcccgccgcgagccccttccacccgcgccgcccgtccgcggcgttttagcctagtctcccgctgcatgcgactccggccggtaggggaaggagcggaaagtttggttgttgttagggggggcaaagtgtttgtgctgtgtaaatttgatgatggatggagaaaaccagcgcgggcccgtgtagctttttaggtgtaggtggtagggtttcgaccttggagtcccttcgcgtcaacgtccccgtccccgtgttccgttccatgccgtgcatgctgatggatcaaaagtttgtactagcttcctatcgtcgtcactccattcagaatga

SEQ ID NO: 1958 - protein, 211 aa, Zea mays
  G3490,HB domain coordinates 60-120
MVVAWRPQRGLDATTTTGAGTGNNMRDLDMNQPASGGEEEEFPMGSVEEEEDERGGAGGPHRAKKLRLSKEQSRLLEESFRLNHTLTPKQKEALAVKLKLRPRQVEVWFQNRRARTKLKQTELECEYLKRCFGSLTEENRRLQREVEELRAMRVAPPTVLSPHTRQPLPASALAMCPRCERISAATAGAHPTPGARREPLPPAPPVRGVLA

SEQ ID NO: 1959 - DNA, 823 bp, Oryza sativa
  G3503,family:MYB-(R1)R2R3
cttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggccgcggcggcggcgagggacgacaaggccgccgtgttccggcgagaggaccatcctcatcagccgaaggcggtgacagtggcacaggagcagcaggcagccgccgattggggccatgggaagccactcaagtgccctgacctcaatctggacctctgcatcagcctcccttcccaagaagagcccatgatgatgaagccggtgaagagggagaccggcgtctgcttcagctgcagcctggggctccccaagagcacagactgcaagtgcagcagcttcctgggactcaggacagccatgctcgacttcagaagcttggaaatgaaatga

SEQ ID NO: 1960 - protein, 251 aa, Oryza sativa
  G3503,MYB-(R1)R2R3 domain coordinates 14-116
MGRSPCCEKAHTNKGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPVTHRPINDSASNITISFEAAAAAARDDKAAVFRREDHPHQPKAVTVAQEQQAAADWGHGKPLKCPDLNLDLCISLPSQEEPMMMKPVKRETGVCFSCSLGLPKSTDCKCSSFLGLRTAMLDFRSLEMK

SEQ ID NO: 1961 - DNA, 763 bp, Oryza sativa
  G3504,family:MYB-(R1)R2R3
gacgactcgccgccggcctagaccaacagcgatggggaggtcgccgtgctgcgagaaggagcacactaacaagggcgcgtggaccaaggaggaggacgagcgcctcgtcgcctacatccgcgcccacggcgagggctgctggcgctcgctccccaaggccgccggcctcctccgctgcggcaagagctgccgcctccgctggatcaactacctccgccccgacctcaagcgcggcaacttcaccgccgacgaggacgacctcatcatcaagctccacagcctcctcggcaacaagtggtctctgatcgcggcgaggctgccggggaggacggacaacgagatcaagaactactggaacacgcacatccgccggaagcttctcggcagggggatcgaccccgtcacgcaccgccccgtcaacgccgccgccgccaccatctccttccatccccagccgccgccaacgacgaaggaggagcagctcatactcagcaagccgcccaagtgccccgacctcaacctggacctctgcatcagcccgccgtcgtgccaggaagaagacgatgactatgaggcgaagccggcgatgatcgtgagggcgccggagctgcagcgccgccgcggcggcctctgcttcggctgcagcctcggcctccagaaggagtgcaagtgcagcggcggcggcgccggcgccggcgccggcaacaacttcctcggcctcagggctggcatgctcgacttcagaagcctccccatgaaatga

SEQ ID NO: 1962 - protein, 243 aa, Oryza sativa
  G3504,MYB-(R1)R2R3 domain coordinates 14-116
MGRSPCCEKEHTNKGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKLLGRGIDPVTHRPVNAAAATISFHPQPPPTTKEEQLILSKPPKCPDLNLDLCISPPSCQEEDDDYEAKPAMIVRAPELQRRRGGLCFGCSLGLQKECKCSGGGAGAGAGNNFLGLRAGMLDFRSLPMK

SEQ ID NO: 1963 - DNA, 1042 bp, Oryza sativa
  G3505,family:MYB-(R1)R2R3
ctgtacccccgccgcggctcacctggaaactgggcagattggacaatcgctcgagcgagctagcgagagagagcgcgagagagcgaggcggcgcgcgcggtggttgcggatttgtagcttagagcgcggggccatggggaggtcgccgtgctgcgagaaggcgcacacgaacaagggggcgtggacgaaggaggaggaccagcggctcatcgcgtacatcagggcgcatggcgaaggctgctggcgctcgctgcccaaggcggcgggcctccttcgctgcggcaagagctgccgcctccggtggatgaactacctccgccccgacctcaagcgcggcaacttcaccgacgacgaggacgagctcatcatccgcctccacagcctcctcggcaacaagtggtctctgatcgccgggcagctgccggggaggacggacaacgagatcaagaactactggaacacgcacatcaagcgcaagctcctcgcccgcggcatcgacccgcagacgcaccgcccgctgctcagcggcggtgacggcatcgcggcgagcaacaaggcggcaccaccgccgccgcatcccatatccgtcccggcgaaggcggcggccgcggcgatcttcgccgtggcgaagccgccgccgccgccgcgcccggtcgactcctcggacgacggctgccgcagcagcagcggcacaacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaagggaaagaaaaaggttct

SEQ ID NO: 1964 - protein, 260 aa, Oryza sativa
  G3505,MYB-(R1)R2R3 domain coordinates 14-116
MGRSPCCEKAHTNKGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKLLARGIDPQTHRPLLSGGDGIAASNKAAPPPPHPISVPAKAAAAAIFAVAKPPPPPRPVDSSDDGCRSSSGTTSTGEPRCPDLNLELSVGPTPSSPPAETPTSARPVCLCYHLGFRGGEACSCQADSKGPHEFRYFRPLEQGQYI

SEQ ID NO: 1965 - DNA, 1037 bp, Oryza sativa
  G3506,family:MYB-(R1)R2R3
aaaagctattactactagtacaaaaccaacgcgaagctctcgtcgcgcacaaccaactcgacaccgcggcgaggcgaaccaacgcgcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcggcaacttcaccgacgacgacgacgagctcatcatcaagctccacgcccttctcggcaacaagtggtcgttgattgcggggcagctgccggggaggacggacaacgagatcaagaactactggaacacgcacatcaagcgcaagctcctgagccggggcatcgacccgcagacgcaccggccggtcagcgccgggagcagcgccgccgcggcgagcgggctgaccacgacggccagcaccgccgcctttccgtcccttgcgccggcgccgccgccgcagcagcacaggctacacaacccggtgcacgccgcggcgccgagcaatgcgagcttcgccaggtccgcggcgtccccgccgtcggaggacggccacagcagcagcggcggcagctcggacgcgccgcggtgccccgacctcaacctcgacctcgacctcgacctgtccatgagcctgccgagctcgccgcccaagacgccggccgccgcgtcgtccacgaccgcgtcgcgccaccatcaccaccagcagcagaagaccatctgcctctgctaccacctcggcgtccgcaacggcgacgtctgcagctgcaaggcggccgcgccatcgccggccggcccacgcgcgttccggtttctcaggccactggaggagggccagtacatatagcacagcaggctttagggaaaaaaaacctgtaaaaaacacaaaaaaaaacggtgggcaatagagttttttctaagttc

SEQ ID NO: 1966 - protein, 287 aa, Oryza sativa
  G3506,MYB-(R1)R2R3 domain coordinates 14-116
MGRSPCCEKAHTNKGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKLLSRGIDPQTHRPVSAGSSAAAASGLTTTASTAAFPSLAPAPPPQQHRLHNPVHAAAPSNASFARSAASPPSEDGHSSSGGSSDAPRCPDLNLDLDLDLSMSLPSSPPKTPAAASSTTASRHHHHQQQKTICLCYHLGVRNGDVCSCKAAAPSPAGPRAFRFLRPLEEGQYI

SEQ ID NO: 1967 - DNA, 1027 bp, Oryza sativa
  G3507,family:MYB-(R1)R2R3
ttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgctcacgcaccgcccgctcaatgccgccgccgccgtcgccggccaccaccacctcgccgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgacggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgatcagctagcaaaatcatcataatcatcatcatcatc

SEQ ID NO: 1968 - protein, 266 aa, Oryza sativa
  G3507,MYB-(R1)R2R3 domain coordinates 14-116
MGRSPCCEKAHTNKGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKLLARGLDPLTHRPLNAAAAVAGHHHLAAGGSSCSPDATSGHSSCSDGDEYRGGIDLNLSISPPSSSSQPSSPPPPPHEAEARRAGATASYTYHHHYSETREKICLCLNHLGLHGGDECSCGGSSASSSSSPPPATASSRAFTFANASSSTV

SEQ ID NO: 1969 - DNA, 888 bp, Oryza sativa
  G3508,family:MYB-(R1)R2R3
atggggaggtccccatgctgcgagaaggcgcacacgaacaagggagcctggacgaaggaggaggaccagcggctcatcgcctacatcaaggccaacggcgagggatgctggaggtcgctccccaaggccgcagggttgctgcggtgcgggaaaagctgccggctgcgatggatcaactacctgagaccggacctcaagcgaggtaatttcaccgaggaggaggacgagttcatcatcaagctccatgagcttctaggcaacaagtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcggcggcgccccctccatgcaggccagcacacacatgtttagattcatcacgccgctaggaggaagccaccacaacagtagtagcacaacaatgacataa

SEQ ID NO: 1970 - protein, 295 aa, Oryza sativa
  G3508,MYB-(R1)R2R3 domain coordinates 14-116
MGRSPCCEKAHTNKGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKLLARGVDPQTHRPLNAAADHHQQQQLQAPRRFAAAPAGHHHHHPDHFAVLSNSPEACSHSSDDEPSSATPPPPPRHLGIDLNLSISLAPYQPQDQTSEPMKQEEDDEASATANGAGNAAMTTTATTAAVCLCLNRLGLHGGEVCSCGRGGAPSMQASTHMFRFITPLGGSHHNSSSTTMT

SEQ ID NO: 1971 - DNA, 1152 bp, Solanum lycopersicum
  G3509,family:MYB-(R1)R2R3
cacaacaaagccaaaaaaacttccattatccttctctcaattggtatatcacacttgcaaaaaccaaaaaaaataaaggtatagtttcttaaatactcttatttgtctaaatgggaaggtcaccttgttgtgagaaggcacatacaaacaaaggagcatggactaaagaagaagatgaaagactaatttcttacattagagctcatggtgaaggttgttggaggtctcttcctaaagctgctggacttcttcgatgcggtaaaagttgtcgtctccgatggattaattacttaagacctgaccttaaacgtggtaactttactgaagaagaagatgaactcattatcaaactccatagcctccttggaaacaagtggtcgcttatagcaggaagattaccaggaagaacagataacgagataaaaaactattggaacacacatataagacgaaagctcttgagtcgaggtattgatccaacaacacatagatcaatcaatgatcctactacaataccaaaagttacaacgattacttttgctgctgctcatgaaaatattaaagatattgatcaacaagatgagatgataaatatcaaagctgaattcgttgaaacaagcaaagaatcagataataatgaaataattcaagaaaagtcatcatcatgtcttcctgacttaaatcttgaactcagaattagtcctccacatcatcaacaactcgatcatcatcgtcatcatcaacgatcaagctctttatgttttacatgtagtttgggaattcaaaatagtaaagattgcagttgtggaagtgaaagtaatggaaatggatggagtaataatatggtaagtatgaacattatggctggttatgactttttgggcttgaagactaatggtcttttggactatagaactttggaaactaagtgattcgattcgattcgaatttatgcataaatcatcttaatttgatgtatatgtagaaaagaaaaagagtttgaggatattatttcttctagctaataattttctcatggttgtaaactttgcaatatagtaattacatttaattcaaagcagtaaaaatatagcactaatgattctatgaagataatttttctttttcctctaaaaaaaaaaaaaaaaaaaa

SEQ ID NO: 1972 - protein, 273 aa, Solanum lycopersicum
  G3509,MYB-(R1)R2R3 domain coordinates 14-116
MGRSPCCEKAHTNKGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLSRGIDPTTHRSINDPTTIPKVTTITFAAAHENIKDIDQQDEMINIKAEFVETSKESDNNEIIQEKSSSCLPDLNLELRISPPHHQQLDHHRHHQRSSSLCFTCSLGIQNSKDCSCGSESNGNGWSNNMVSMNIMAGYDFLGLKTNGLLDYRTLETK

SEQ ID NO: 1973 - DNA, 1174 bp, Oryza sativa
  G3510,family:HB
tctccctccgcctttgccccgccttccctgcccttttctcttgctgagccgcttctgcattggcttgtgatgatgggggccacttctccgtcaggcctggagctcaccatggctgtccccggcctcagctcctctggttcagaaggggccggttgcaacaacaacaacgccggtggcggctgcaacatgagggacctggacatcaaccagccggcgagcggcggcgaggaggaggagttcccgatgggcagcgtggaggaggacgaggaggagaggggcgtcggtgggccccaccgccccaagaagctccgcctctccaaggagcagtcccgcctcctcgaggagagcttccgcctcaaccataccctcacgccgaagcaaaaggaggccttggcgatcaaactgaagctgcggccgaggcaggtggaggtctggtttcagaaccgtagggcaaggacgaagctgaagcagacggagatggagtgcgagtacctgaagcgctgcttcgggtcgctgacggaggagaaccgccggctgcagcgggaggtggaggagctgcgggcgatgcgggtggccccgcccacggtgctctcgccgcacaccaggcagccgctcccggcgtccgcgctcaccatgtgcccccgctgcgagcgcatcaccgccgccaccggcccgcctgccgtgcgcccgccgccgtcgtcagccgccgccgccgccccctcgcccttccaccctcgccgcccctctgcggccttctaggcccaaggtctcgcatcctaaaggccacaaaaagatgggcctcgccgtcccgtgtaaattgaaggagacgacgcagcggtagagggccccgtgtcggcgttgttgcgtcgggtccagtcgtctcagaggagtcagaggcgtggacaaaatgtttgttgcggtgtttgtgttccattggtcgttgatcttagcttgatgatctgtgattcgcgccttgctcgtctaggtttctcttgggccgacgcatgatcttttttcccccgtgtcggaccttattgggccttttgagatcgacgggccccctccttgtttcgcatgtggacatgttatttcgtccttttgggccaacaattcagcacggtggccaacggtgcgtagttcgtcgccgttttctttcaaaaaaaaaaaaaaaaaa

SEQ ID NO: 1974 - protein, 229 aa, Oryza sativa
  G3510,HB domain coordinates 74-134
MMGATSPSGLELTMAVPGLSSSGSEGAGCNNNNAGGGCNMRDLDINQPASGGEEEEFPMGSVEEDEEERGVGGPHRPKKLRLSKEQSRLLEESFRLNHTLTPKQKEALAIKLKLRPRQVEVWFQNRRARTKLKQTEMECEYLKRCFGSLTEENRRLQREVEELRAMRVAPPTVLSPHTRQPLPASALTMCPRCERITAATGPPAVRPPPSSAAAAAPSPFHPRRPSAAF

SEQ ID NO: 1975 - DNA, 466 bp, Oryza sativa
  G3515,family:AP2
gtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagctagctagctactatggc

SEQ ID NO: 1976 - protein, 141 aa, Oryza sativa
  G3515,AP2 domain coordinates 11-75
MEDDKSKEGKSSSSYRGVRKRPWGKFAAEIRDPERGGARVWLGTFDTAEEAARAYDRAAFAMKGATAMLNFPGDHHHGAASRMTSTGSSSSSFTTPPPANSSAAAGRGGSDRTTDKVELECLDDKVLEDLLAETNYRDKNY

SEQ ID NO: 1977 - DNA, 393 bp, Zea mays
  G3516,family:AP2
atggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcgccatgaagggcgccacggccgtgctcaacttccccgccagcggaggatcgtcagctggcgcggctcccggcggccggaccagcggcggctcctcctcgtccaccacgtcggctccggccagcagggggagggcccgtgttcccgactcggagaaggtggagctggagtgcctcgacgacagggtcttggaagagctgctcgcggaagacaagtacaacaagaactaa

SEQ ID NO: 1978 - protein, 130 aa, Zea mays
  G3516,AP2 domain coordinates 6-70
MEDDKKEGKYRGVRKRPWGKFAAEIRDPERGGSRVWLGTFDTAEEAARAYDRAAFAMKGATAVLNFPASGGSSAGAAPGGRTSGGSSSSTTSAPASRGRARVPDSEKVELECLDDRVLEELLAEDKYNKN

SEQ ID NO: 1979 - DNA, 477 bp, Zea mays
  G3517,family:AP2
tacgtccgatccacagccatcatcgccacccgcgcgcttatggatggcgagtggtccaaggacggcggaggcggcgagccgaccaagtaccgcggcgtgcggcgtcggccctggggcaagtacgcggcggagatccgcgactcgagccggcacggcgtccgcatctggctcggcacgttcgacaccgccgaggaggccgccagggcgtacgaccgctccgccaactccatgcgcggcgccaacgccgtgctcaacttcccggaggacgcgcccgcctacgccgccgccgcctcccgtggctccgccggcggatcctcgtccagaccggcgggctccggccgggacgtgatcgagtttgagtacctcgacgacgaggtgctgcaggagatgctcaggagccaggagccgtcggcggcggcggcgcagaagaagaagtagcgcgagcgccacaggtggcgaaacggccgcttttccaaa

SEQ ID NO: 1980 - protein, 132 aa, Zea mays
  G3517,AP2 domain coordinates 13-77
MDGEWSKDGGGGEPTKYRGVRRRPWGKYAAEIRDSSRHGVRIWLGTFDTAEEAARAYDRSANSMRGANAVLNFPEDAPAYAAAASRGSAGGSSSRPAGSGRDVIEFEYLDDEVLQEMLRSQEPSAAAAQKKK

SEQ ID NO: 1981 - DNA, 717 bp, Glycine max
  G3518,family:AP2
ctaacacacataacaataacttagcaacattttttccttccttctttctttctttctatactttttgttgttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttgatttttttttttttttttgtagctgatcaaagttcttcgaaatga

SEQ ID NO: 1982 - protein, 158 aa, Glycine max
  G3518,AP2 domain coordinates 13-77
MEGGRSSVSNGNVEVRYRGIRRRPWGKFAAEIRDPTRKGTRIWLGTFDTAEQAARAYDAAAFHFRGHRAILNFPNEYQSHNPNSSLPMPLAVSAPPSYSSSSSTSNYSGDDNNNHLVRPAFSGEIMQGGDHDDDTFELEYFDNKLLEELLQMQDNRHF

SEQ ID NO: 1983 - DNA, 609 bp, Glycine max
  G3519,family:AP2
tttctttctttctatactttttgtggttctgattattaagttctaagagaataacaatggagggtggaagatcatctgtttcaaatgggaattgtgaggttcggtatagagggattagaagaaggccatggggcaagtttgcagcagagattcgtgaccctacgaggaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctgctgatgataataaccaccttgtgagacctggagaaataatgcaaggtggtgatcttgatgacacttttgagttggagtacttggataataagttgctcgaggaactccttcagatgcaagataacagacacttctaaaagtaaaatataacacaagccagctatgttgtgttagtcactggcatgaaataaaatgcaaagaaatattgttgattttatttaatatattttgttt

SEQ ID NO: 1984 - protein, 151 aa, Glycine max
  G3519,AP2 domain coordinates 13-77
MEGGRSSVSNGNCEVRYRGIRRRPWGKFAAEIRDPTRKGTRIWLGTFDTAEQAARAYDAAAFHFRGHRAILNFPNEYQSHNPNSSLPMPLIVPPPSYSSSFTSNYSADDNNHLVRPGEIMQGGDLDDTFELEYLDNKLLEELLQMQDNRHF

SEQ ID NO: 1985 - DNA, 440 bp, Glycine max
  G3520,family:AP2
aaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaa

SEQ ID NO: 1986 - protein, 138 aa, Glycine max
  G3520,AP2 domain coordinates 14-78
MEEESKEKKKDTKEEPRYRGVRRRPWGKFAAEIRDPARHGARVWLGTFLTAEEAARAYDRAAYEMRGALAVLNFPNEYPSCSSMNSSSTLAPSSSSSNSMLKSDHGKQVIEFECLDDKLLEDLLDCDDYAYEKDLPKN

SEQ ID NO: 1987 - DNA, 1096 bp, Glycine max
  G3524,family:HB
tgcttcttctgtcttccttttcatgtgtgtctccttctgtttctccactttaccttttttctctcctttttgttgatccccctcttcctcttcttcatctcacatcatttttttcttcatccctttcattgttttctgtgtgttttctatggcggttttaccaagtagctcctcaagcttggaattgaccatatctgtacctggttttgcttcttcaccaacccttcttccctcatcatctgtgaaagaattggacataaatcaagtacctcttgaagaagattggatggcatcaaacatggaagatgaagaagaaagcagcaatggagaacctcctcgaaagaaactccgtctcacaaaggaacaatctcgtctccttgaagaaagctttagacaaaaccacacgttgaacccaaagcagaaagagtctttggcaatgcaactgaagctgcgaccaaggcaagtggaggtgtggtttcagaaccgtagggccaggagcaagctgaagcagacagagatggagtgcgagtacctcaagaggtggttcggttccctcacagagcagaaccggaggctccagagggaagtggaggagctgcgagccattaaggtgggcccacccaccgtgatctcccctcactcctgcgaaccgctcccggcctccacactttccatgtgtccccgctgcgagcgtgtcacctccaccgccgacaaaccgccctccgccgcggccactttgtccgctaaagtgccgccaactcaatcccgccaaccctccgcggcctgttgaccctataactatagtccatcgcctactctgcacgccacctctactacctcatcatctaattaatcagaaacagggcacaaacttaactaaactttacaaaactaaaaagttagtgtgaatgaagatataatatgtgttagaaaaaataatgtttttttttttttttttactaaaagggcgttttcggatagggaaacttttgtagttagtagtagtactttcaatggtcaatgcgtatctgattattgggctttcatattgactttctcctttttcaaatatggatagaacttttatttaaaaaaa

SEQ ID NO: 1988 - protein, 213 aa, Glycine max
  G3524,HB domain coordinates 60-120
MAVLPSSSSSLELTISVPGFASSPTLLPSSSVKELDINQVPLEEDWMASNMEDEEESSNGEPPRKKLRLTKEQSRLLEESFRQNHTLNPKQKESLAMQLKLRPRQVEVWFQNRRARSKLKQTEMECEYLKRWFGSLTEQNRRLQREVEELRAIKVGPPTVISPHSCEPLPASTLSMCPRCERVTSTADKPPSAAATLSAKVPPTQSRQPSAAC

SEQ ID NO: 1989 - DNA, 1096 bp, Glycine max
  G3527,family:MYB-(R1)R2R3
ggccactctctctctttaacctgcctcaccaactcgcatctagaagcaattatagggtctttctctcttctctctctatgttctgtcccctctactttggagtcaaaagcctataaaaccacacccaaacttcctcttgagccggcttcttaatttgttgctgcaagccaatcctaattcctattctcctatccttttacataactctaaagtaagaaaaaatagagcaatttcacaacacaactcttagaattgtgagttaagtatgggaaggtccccttgctgtgagaaagctcacacaaacaaaggtgcatggactaaagaagaagatgacagactcatatcttatattcgagctcacggagaaggctgctggcgttcactccccaaagccgccggccttctccggtgcggcaagagctgccgtctccggtggatcaactacctccgccccgacctcaaaagaggtaactttaccgaagaagaagatgaactcatcatcaaactccacagtctcctcggtaacaagtggtctttgatagctggaagattgccggggagaacagacaatgaaataaagaattattggaacacgcacataagaaggaagcttttgaacagaggaatcgaccctgctactcataggccactcaacgaagctgcttctgctgcaactgttacaactgccaccactaatatatcttttgggaaacaacaagaacaagagacaagttctagtaacggaagcgttgttaaaggttccatcttggaacgctgccctgacttgaaccttgagttaaccattagtcctcctcgccaacaacaacctcagaagaatctttgttttgtttgcagtttgggtttgaacaacagcaaggattgtagctgcaacgttgccaacactgttactgttactgtcagcaacactactccttcttctgctgctgctgctgctgctgctgcttatgatttcttgggcatgaaaaccaacggtgtttgggattgcacccgcttggaaatgaaatgaaaattcaacgaaattataccaattagttagtgtttttggagagaagtcgagagaatgaaattcattaat

SEQ ID NO: 1990 - protein, 253 aa, Glycine max
  G3527,MYB-(R1)R2R3 domain coordinates 13-117
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAASAATVTTATTNISFGKQQEQETSSSNGSVVKGSILERCPDLNLELTISPPRQQQPQKNLCFVCSLGLNNSKDCSCNVANTVTVTVSNTTPSSAAAAAAAAYDFLGMKTNGVWDCTRLEMK

SEQ ID NO: 1991 - DNA, 1172 bp, Glycine max
  G3528,family:MYB-(R1)R2R3
ctttaacctgtctcaccaactcgcatctagaagcaattagggtctcccttttctctctatgtctcctttggagtcaaaagcctataaaaccacacccaaactccctcttgagccggcttcttaaatatttgttgctgcaagctagccaatcctaattcctattcctatccttattactacataactctaaagtaagtaagaaaaatagagcaatttcacaacacaacacaactcttataattgtgtgagttattaattgagtatgggaaggtccccttgctgtgagaaagctcacacaaacaaaggtgcatggactaaagaagaagatgacagactcatatcttatattcgagctcacggcgaaggctgctggcgttcactccccaaagccgccggtcttctccggtgcggcaaaagctgccgtctccggtggatcaactacctccgccccgaccttaaaagaggtaactttaccgaagaagaagacgagctcatcatcaaactccacagtctcctcggtaacaagtggtctttgatagctggaagattgccggggagaacagacaatgaaataaagaactattggaatacgcacataagaaggaagcttttgaacagaggaatcgaccctgcaactcataggccactcaacgaagctgcaactgctgcaactgttacaactaatatatcttttggcaaacaagaacaacaagagacaagttcgagtaacggaagcgttgttaaaggttccatcttggaacgctgccctgacttgaaccttgagttaaccattagtcctcctcgccaacaacaacagactcagaagaatctttgtttcgtttgcagtttgggtttgcacaacagcaaagattgcagctgcaacgtttccaacgctgtcactgtcaacaacaccactccttcttctgctgctgctgctgcttatgatttcttgggcatgaaaaccagcggtgtttgggattgcacccgcttggaaatgaaatgaaaattcaaccaaattatatcaattagttagtgttgttggagagaagtgagagaatgaaattcgttaatttttgaattttctctcctattttttcttttttttcttctcttatttgtataaataattagtcgctgatatgcataatatatagtaacggtacagttgaaca

SEQ ID NO: 1992 - protein, 246 aa, Glycine max
  G3528,MYB-(R1)R2R3 domain coordinates 13-117
MGRSPCCEKAHTNKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLLNRGIDPATHRPLNEAATAATVTTNISFGKQEQQETSSSNGSVVKGSILERCPDLNLELTISPPRQQQQTQKNLCFVCSLGLHNSKDCSCNVSNAVTVNNTTPSSAAAAAYDFLGMKTSGVWDCTRLEMK

SEQ ID NO: 1993 - DNA, 866 bp, Glycine max
  G3529,family:MYB-(R1)R2R3
gtggagagcataggatgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttctccctcgaagaagaccaactcatcatcaaactccacagcctccttggcaacaagtggtctctaattgctggtagattgcccggtagaactgacaatgagatcaagaattactggaatactcacatacgcaggaagcttctgagcagaggtattgaccctgccactcacaggcctctcaacgattcttctcatcaagaacctgctgctgtctctgcccctcctaaacatcaagagtcctttcaccatgaacgctgccctgacttgaaccttgagctaaccattagtcctccccatcatcctcaacctgatcatccgcacttgaagacccttgtgacaaactcaaacctttgctttccctgcagtctgggtttgcataatagcaaagattgtagctgtgccctccacactagtactgccaacgctactgctactggctatgatttcttggccttgaaaaccaccgtcgttttggattacagaaccttgcacatgaaatgaaatcatattactgaaatctctctctttctttctttctttcttttcttctctaatataatttcttacttacttacttacttacttacttacttgttaatggttgcaaatgataaaaaagttccagccagtacagttgaacaaaaa

SEQ ID NO: 1994 - protein, 235 aa, Glycine max
  G3529,MYB-(R1)R2R3 domain coordinates 14-116
MGRSPCCEKAHTNKGAWTKEEDHRLISYIRAHGEGCWRSLPKAAGLLRCGKSCRLRWINYLRPDLKRGNFSLEEDQLIIKLHSLLGNKWSLIAGRLPGRTDNEIKNYWNTHIRRKLLSRGIDPATHRPLNDSSHQEPAAVSAPPKHQESFHHERCPDLNLELTISPPHHPQPDHPHLKTLVTNSNLCFPCSLGLHNSKDCSCALHTSTANATATGYDFLALKTTVVLDYRTLHMK

SEQ ID NO: 1995 - DNA, 920 bp, Zea mays
  G3531,family:MYB-(R1)R2R3
ccacgcgtccggtgccctataaaatccagccccgcttggcttcacccacccttgggctcgcagtcgcagcaacgatggggaggtcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttgtgcgctgcggcaagagctgccgcctccggtggatcaactacctgcggcccgacctcaagcgcggcaacttcacggaggaggaggacgagctcatcatcaagctccacagcctactcggcaacaaatggtccctgatcgctggaaggctgccgggcaggaccgacaacgagatcaagaactactggaacacgcacatccggcggaagctgctgagcagggggatcgacccggtgacacaccgccccatcaacgagcacacgtccaacataaccatatcgttcgaggactggggccaggggaaggcgctcaagtgccccgacctgaacctggacctctgcatcagcccgccgtgccaggaggaggaggaggccatgctgctgaggccggtgaagcgggaggaggccgggctctgcttcagctgcagcctggggctccccaagagcgcggactgcaagtgcagcaacttcctcgggctcaggaccgccatgctcgacttcagaagactcgagatgaaatgagagcttccatccatctctgtctgtctctctctgtaacttcacccctgataacacgcagtagtagtagtcaccaactgatttgtcgcaacattctgtctctctctctctctctctctctctctctctctctctctcgctatgtaaattagcatcaccaactgattgatcatgggcaattaataataaaaa

SEQ ID NO: 1996 - protein, 218 aa, Zea mays
  G3531,MYB-(R1)R2R3 domain coordinates 14-116
MGRSPCCEKAHTNKGAWTKEEDDRLVAYIKAHGEGCWRSLPKAAGLVRCGKSCRLRWINYLRPDLKRGNFTEEEDELIIKLHSLLGNKWSLIAGRLPGRTDNEIKNYWNTHIRRKLLSRGIDPVTHRPINEHTSNITISFEDWGQGKALKCPDLNLDLCISPPCQEEEEAMLLRPVKREEAGLCFSCSLGLPKSADCKCSNFLGLRTAMLDFRRLEMK

SEQ ID NO: 1997 - DNA, 1372 bp, Zea mays
  G3532,family:MYB-(R1)R2R3
gcacgagctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctcccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctgtatctctgtaattaccatcgccaaatgatcatgggggcaaaatctttttgggtctctggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1998 - protein, 273 aa, Zea mays
  G3532,MYB-(R1)R2R3 domain coordinates 14-116
MGRSPCCEKAHTNKGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKLLSRGIDPVTHRPVTEHHASNITISFETEVAAAARDDKKGAVFRLEEEEERNKATMVVGRDRQSQSQSHSHPAGEWGQGKRPLKCPDLNLDLCISPPCQEEEEMEEAAMRVRPAVKREAGLCFGCSLGLPRTADCKCSSSSFLGLRTAMLDFRSLEMK

SEQ ID NO: 1999 - DNA, 1420 bp, Zea mays
  G3533,family:MYB-(R1)R2R3
ctaccacccaccaactttagctctgtagaagacctaccctcccgggattcctcagtaaagtgcgtatgcctatctataaaatccagccccgcttcacccacacacctttggccttggcctggcgctcgcacctcacagcagcagcagcaacaacaacctccactgccgcaacccaccgagaggcgagaccggcggcggcaaaaggacgatacaaaagcagccagggttgctggcaacagcgtcggtcgcccgcccgctcgccatggggaggtcgccgtgctgcgagaaggcgcacaccaacaagggcgcgtggaccaaggaggaggacgagcgcctggtcgcgcacatcagggcgcacggcgaggggtgctggcgctcgctgcccaaggccgccggcctcctgcgctgcggcaagagctgccgcctccgctggatcaactacctccgccccgacctcaagcgcggcaacttcacggaggaggaggacgagctcatcgtcaagctgcacagcgtcctcggcaacaagtggtccctgatcgccggaaggctgcccggcaggacggacaacgagatcaagaactactggaacacgcacatccggaggaagctgctgagcagggggatcgacccggtgacgcaccgcccggtcacggagcaccacgcgtccaacatcaccatatcgttcgagacggaggtggccgccgctgcccgtgatgataagaagggcgccgtcttccggctggaggaggaggaggaggagcgcaacaaggcgacgatggtcgtcggccgcgaccggcagagccagagccagagccacagccaccccgccggcgagtggggccaggggaagaggccgctcaagtgccccgacctcaacctggacctctgcatcagcccgccgtgccaggaggaggaggaggagatggaggaggctgcgatgagagtgagaccggcggtgaagcgggaggccgggctctgcttcggctgcagcctggggctccccaggaccgcggactgcaagtgcagcagcagcagcttcctcgggctcaggaccgccatgctcgacttcagaagcctcgagatgaaatgagcgcgcttctaccctctctgtgtagcttctccccccccgtcgtcctcgtttttgttttgccacacctcacatggatgatgaattgatgatacgtggttggttagttttttcgtaggtgaaaaatacgcgatggtgagcgagtgaaagagagattttgtgccctgggtcctcctccctgctctctcttgctgctccattttgcctccctctgtcctctctctctctctctctctctctctctctctctctctctctctctctctgtatctctgtaattaccatcgccaaatgatcatgggggcaatatcatgctaggtctctggaaaaaaa

SEQ ID NO: 2000 - protein, 275 aa, Zea mays
  G3533,MYB-(R1)R2R3 domain coordinates 14-116
MGRSPCCEKAHTNKGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKLLSRGIDPVTHRPVTEHHASNITISFETEVAAAARDDKKGAVFRLEEEEEERNKATMVVGRDRQSQSQSHSHPAGEWGQGKRPLKCPDLNLDLCISPPCQEEEEEMEEAAMRVRPAVKREAGLCFGCSLGLPRTADCKCSSSSFLGLRTAMLDFRSLEMK

SEQ ID NO: 2001 - DNA, 963 bp, Zea mays
  G3534,family:MYB-(R1)R2R3
gtagcaacaagcaaaagcccagatcgataatacgatggggcggtcgccgtgctgcgagaaggcgcacaccaacaggggcgcgtggaccaaggaggaggacgagcggctggtggcctacgtccgcgcgcacggcgaagggtgctggcgctcgctgcccagggcggcgggcctgctgcgctgcggcaagagctgccgcctgcgctggatcaactacctccgcccggacctcaagcgcggcaacttcaccgccgacgaggacgacctcatcgtcaagctgcacagcctcctcgggaacaagtggtcgctcatcgccgcgcggctcccggggcggacggacaacgagatcaagaactactggaacacgcacgtccggcggaagctgctgggcaggggcatcgaccccgtcacgcaccgccccatcgccgccgacgccgtgaccgtgaccaccgtctcgttccagcccagccccagcgccgccgccgcagcagcagcagaagccgaggcgacggccgccaaggcgcccagatgccccgacctcaacctcgacctctgcatcagcccgccgtgccagcagcaggaggaggaggaggaggtggacctcaagccctccgccgccgtcgtcaagcgggaggttctgctgggcggccgcggccacggccacggcggggcgctctgcttcggctgcagcctgggcgtccagaagggcgcgcccgggtgcagctgcagcagcagcaacggccaccgctgcttggggctcaggggcggcatgctggactttagaggcctcaagatgaagtgaacgaagcccagcgagatgggcggattcttctggttcgtcggtttggttggttctcgccttgatggatctggatagctagttcctggtaggaggatagtggaagatgagaaggagagccaagatggcgagaggattcgtggctcgtggatagcttagttcctccg

SEQ ID NO: 2002 - protein, 254 aa, Zea mays
  G3534,MYB-(R1)R2R3 domain coordinates 14-116
MGRSPCCEKAHTNRGAWTKEEDERLVAYVRAHGEGCWRSLPRAAGLLRCGKSCRLRWINYLRPDLKRGNFTADEDDLIVKLHSLLGNKWSLIAARLPGRTDNEIKNYWNTHVRRKLLGRGIDPVTHRPIAADAVTVTTVSFQPSPSAAAAAAAEAEATAAKAPRCPDLNLDLCISPPCQQQEEEEEVDLKPSAAVVKREVLLGGRGHGHGGALCFGCSLGVQKGAPGCSCSSSNGHRCLGLRGGMLDFRGLKMK

SEQ ID NO: 2003 - DNA, 780 bp, Oryza sativa
  G3542,family:CAAT
atggaaccatcctcacagcctcagcctgtgatgggtgttgccactggtgggtcacaagcatatcctcctcctgctgctgcatatccacctcaagccatggttcctggagctcctgctgttgttcctcctggctcacagccatcagcaccattccccactaatccagctcaactcagtgctcagcaccagctagtctaccaacaagcccagcaatttcatcagcagctgcagcaacagcaacagcagcaactccgtgagttctgggctaaccaaatggaagagattgagcaaacaaccgacttcaagaaccacagcttgccactcgcaaggataaagaagataatgaaggctgatgaggatgtccggatgatctcggcagaagcccccgttgtcttcgcaaaggcatgcgaggtattcatattagagttaacattgaggtcgtggatgcacacggaggagaacaagcgccggaccttgcagaagaatgacattgcagctgccatcaccaggactgatatctatgacttcttggtggacatagttcccagggatgaaatgaaagaagaagggcttgggcttccgagggttggcctaccgcctaatgtggggggcgcagcagacacatatccatattactacgtgccagcgcagcaggggcctggatcaggaatgatgtacggtggacagcaaggtcacccggtgacgtatgtgtggcagcagcctcaagagcaacaggaagaggcccctgaagagcagcactctctgccagaaagtagctaa

SEQ ID NO: 2004 - protein, 259 aa, Oryza sativa
  G3542,CAAT domain coordinates 93-189
MEPSSQPQPVMGVATGGSQAYPPPAAAYPPQAMVPGAPAVVPPGSQPSAPFPTNPAQLSAQHQLVYQQAQQFHQQLQQQQQQQLREFWANQMEEIEQTTDFKNHSLPLARIKKIMKADEDVRMISAEAPVVFAKACEVFILELTLRSWMHTEENKRRTLQKNDIAAAITRTDIYDFLVDIVPRDEMKEEGLGLPRVGLPPNVGGAADTYPYYYVPAQQGPGSGMMYGGQQGHPVTYVWQQPQEQQEEAPEEQHSLPESS

SEQ ID NO: 2005 - DNA, 762 bp, Oryza sativa
  G3543,family:CAAT
ggtgacaatggacaaccagcagctaccctacgccggtcagccggcggccgcaggcgccggagccccggtgccgggcgtgcctggcgcgggcgggccgccggcggtgccgcaccaccacctgctccagcagcagcaggcgcagctgcaggcgttctgggcgtaccagcggcaggaggcggagcgcgcgtcggcgtcggacttcaagaaccaccagctgccgctggcgcggatcaagaagatcatgaaggcggacgaggacgtgcgcatgatctcggcggaggcgcccgtgctgttcgccaaggcgtgcgagctcttcatcctggagctcaccatccgctcgtggctgcacgccgaggagaacaagcgccgcaccctgcagcgcaacgacgtcgccgccgccatcgcgcgcaccgacgtgttcgacttcctcgtcgacatcgtgccgcgggaggaggccaaggaggagcccggcagcgcgctcgggttcgcggcgggagggcccgccggcgccgttggagcggccggccccgccgcggggctgccgtactactacccgccgatggggcagccggcgccgatgatgccggcgtggcatgttccggcgtgggacccggcgtggcagcaaggagcagcgccggatgtggaccagggcgccgccggcagcttcagcgaggaagggcagcaaggttttgcaggccatggcggtgcggcagctagcttccctcctgcacctccaagctccgaatagtgatgatccatatg

SEQ ID NO: 2006 - protein, 246 aa, Oryza sativa
  G3543,CAAT domain coordinates 55-153
MDNQQLPYAGQPAAAGAGAPVPGVPGAGGPPAVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAGGPAGAVGAAGPAAGLPYYYPPMGQPAPMMPAWHVPAWDPAWQQGAAPDVDQGAAGSFSEEGQQGFAGHGGAAASFPPAPPSSE

SEQ ID NO: 2007 - DNA, 753 bp, Oryza sativa
  G3544,family:CAAT
atggagccatcatcacaacctcagccggcaattggtgttgttgctggtggatcacaagtgtaccctgcataccggcctgcagcaacagtgcctacagctcctgctgtcattcctgccggttcacagccagcaccgtcgttccctgccaaccctgatcaactgagtgctcagcaccagctcgtctatcagcaagcccagcaatttcaccagcagcttcagcagcagcaacagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggtcccaggtgcaggaatagcgtatggtggtcagcaaggtcatccggggtatctgtggcaggatcctcaggaacagcaggaagagcctcctgcagagcagcaaagtgattaa

SEQ ID NO: 2008 - protein, 250 aa, Oryza sativa
  G3544,CAAT domain coordinates 89-185
MEPSSQPQPAIGVVAGGSQVYPAYRPAATVPTAPAVIPAGSQPAPSFPANPDQLSAQHQLVYQQAQQFHQQLQQQQQRQLQQFWAERLVDIEQTTDFKNHSLPLARIKKIMKADEDVRMISAEAPVIFAKACEIFILELTLRSWMHTEENKRRTLQKNDIAAAITRTDMYDFLVDIVPRDDLKEEGVGLPRAGLPPLGVPADSYPYGYYVPQQQVPGAGIAYGGQQGHPGYLWQDPQEQQEEPPAEQQSD

SEQ ID NO: 2009 - DNA, 750 bp, Oryza sativa
  G3545,family:CAAT
atggacccacattcacacaagaaggcacatgaaggtctgattggtgacaaccctgacgcgtatgccgtgacgacataccaacctgtgctgatggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaaggcctgcgagatgttcatcctggacatgacgctgcggtcctggcagcacaccgaggagggcaggaggaggacgctgcagaggagcgacgtcgaggcggtgatcaagaagaccgacatcttcgatttcttggtggatatcatcactgatgataagatgaaggatgatggcatgggctctcaggctgcatccatggtttcgccatatacctcaggaggaatgggattttcctttgatctgtacccgaaccagcatcacctcgcatatatgtggcctccacaagagcagcaggagcagtggcctccacaggagcagcaggagcagaagcagaagcaggattctgatggtggtggacaagatgaatga

SEQ ID NO: 2010 - protein, 249 aa, Oryza sativa
  G3545,CAAT domain coordinates 89-189
MDPHSHKKAHEGLIGDNPDAYAVTTYQPVLMVEPSAAAAFPPAPQVAPAYPVNPMQLPEHQQHAIQQVQQLQQQQKEQLQAFWADQMAEVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQAASMVSPYTSGGMGFSFDLYPNQHHLAYMWPPQEQQEQWPPQEQQEQKQKQDSDGGGQDE

SEQ ID NO: 2011 - DNA, 618 bp, Oryza sativa
  G3546,family:CAAT
atggagcccaaatccaccacccctcctccgcctcctccgccccccgtgctgggcgcccccgtcccttacccgccggcgggagcctaccccccacccgtcgggccctacgcccacgcgccgccgctctacgccccgcctccccccgccgccgccgccgcctccgccgccgccaccgccgcctcgcagcaggccgccgccgcgcagctccagaacttctgggcggagcagtaccgcgagatcgagcacaccaccgacttcaagaaccacaacctccccctcgcccgcatcaagaagatcatgaaggccgacgaggacgtccgcatgatcgccgccgaggcccccgtcgtgttcgccagggcgtgcgagatgttcatcctcgagctcacccaccgcggctgggcgcacgccgaggagaacaagcgccgcacgctccagaagtccgacatcgccgccgccatcgcccgcaccgaggtcttcgacttcctcgtcgacatcgtgccccgcgacgaggccaaggacgccgaggccgccgccgccgttgccgccgggatcccccaccccgccgccggtttgcccgccaccgaccccatggcctactactatgtccagccgcagtaa

SEQ ID NO: 2012 - protein, 205 aa, Oryza sativa
  G3546,CAAT domain coordinates 78-175
MEPKSTTPPPPPPPPVLGAPVPYPPAGAYPPPVGPYAHAPPLYAPPPPAAAAASAAATAASQQAAAAQLQNFWAEQYREIEHTTDFKNHNLPLARIKKIMKADEDVRMIAAEAPVVFARACEMFILELTHRGWAHAEENKRRTLQKSDIAAAIARTEVFDFLVDIVPRDEAKDAEAAAAVAAGIPHPAAGLPATDPMAYYYVQPQ

SEQ ID NO: 2013 - DNA, 806 bp, Glycine max
  G3547,family:CAAT
gggaagaatggatcatcaagggcatagccagaacccatctatgggggttgttggtagtggagctcaattagcatatggttctaacccatatcagccaggccaaataactgggccaccggggtctgttgtgacatcagttgggaccattcaatccaccggtcaacctgctggagctcagcttggacagcatcaacttgcttatcagcatattcatcagcaacaacagcaccagcttcagcaacagctccaacaattttggtcaagccagtaccaagaaattgagaaggttactgattttaagaaccacagtcttcccctggcaaggatcaagaagattatgaaggctgacgaggatgttaggatgatatcagctgaagcaccagtcatttttgcaagggcatgtgaaatgttcatattagagttaaccctgcgctcttggaatcacactgaagagaacaaaaggcgaacacttcagaaaaatgatattgctgctgctatcacaaggactgacatctttgatttcttggttgacattgtgcctcgtgaggacttgaaagatgaagtgcttgcatcaatcccaagaggaacaatgcctgttgcagggcctgctgatgcccttccatactgctacatgccgcctcagcatccgtcccaagttggagctgctggtgtcataatgggtaagcctgtgatggacccaaacatgtatgctcagcagtctcacccttacatggcaccacaaatgtggccacagccaccagaccaacgacagtcatctccagaacattagctgatgtgtcgtggaa

SEQ ID NO: 2014 - protein, 260 aa, Glycine max
  G3547,CAAT domain coordinates 89-185
MDHQGHSQNPSMGVVGSGAQLAYGSNPYQPGQITGPPGSVVTSVGTIQSTGQPAGAQLGQHQLAYQHIHQQQQHQLQQQLQQFWSSQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHPSQVGAAGVIMGKPVMDPNMYAQQSHPYMAPQMWPQPPDQRQSSPEH

SEQ ID NO: 2015 - DNA, 806 bp, Glycine max; identical to SEQ ID NO: 2013
  G3547,family:CAAT

SEQ ID NO: 2016 - protein, 260 aa, Glycine max; identical to SEQ ID NO: 2014
  G3547,CAAT domain coordinates 89-185

SEQ ID NO: 2017 - DNA, 1223 bp, Glycine max
  G3548,family:CAAT
caaaccaaacctctctttctcagtttctctctcttagggttttctcctcccccattgacccaccgtccatcgcaaaggaagtcgcgcccaatttccatggactcagcagcaacatcagcatgggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgaccatgcaattcaattaggtcggaaagtagcatgcaccttatgattattacaaatttacttaatgcctttaagtcagctgtagtttagtgttttgcattgaaaaatgccaaagattgtttgaggtttcttgcactcatttatgattgtatgagctcttatgctgagttacttttggttgtgtttatttgaggtactggtgtggtagttaaattagtttgtagctgtccataagtaaacagcgtagctgcttaattaggaggtctgaaatgatgaaatagtttgtattgttattgcagaaggtaggttttattcagtatttcattctactgca

SEQ ID NO: 2018 - protein, 254 aa, Glycine max
  G3548,CAAT domain coordinates 77-173
MGVATGASQMAYSSHYPTAPMVASGTPAVAVPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVNSPADMPYYYVPPQHPVVGPPGMIMGKPVGAEQATLYSTQQPRPPMAFMPWPHTQPQQQQPPQHQQTDS

SEQ ID NO: 2019 - DNA, 987 bp, Glycine max
  G3549,family:CAAT
gagaggatagttagaagattaaatcttaaagcagtaagtcatcatggataaatcagagcagactcaacagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgacaatgcaattcaattaggtcggaaagtagcatgcaccttatgattattacaaatttacttaatgcctttaagtcagctgtagtttagtgttttgcattgaaaaatgccaaagattgtttgaggtttct

SEQ ID NO: 2020 - protein, 270 aa, Glycine max
  G3549,CAAT domain coordinates 93-189
MDKSEQTQQQQQQQHVMGVAAGASQMAYSSHYPTASMVASGTPAVTAPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVNSPADMPYYYVPPQHPVVGPPGMIMGKPVGAEQATLYSTQQPRPPMAFMPWPHTQPQQQQPPQHQQTDS

SEQ ID NO: 2021 - DNA, 1126 bp, Glycine max
  G3550,family:CAAT
cttgcgcccaatttccatggaactgtaaagagaggatagttagaagattaaatcttaaagcagtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattctacacagcagcctcgacctcctgtggcgttcatgccatggcctcatacacaacccctgcaacagcagccaccccaacatcaacaaacagactcatgatgactatgcaattcaattaggttggaaagtagcctgcaccttttgattattacaaatttacttaatgcctttcagccagctgtagtttagtgttgtgcattgaaaaaaagcaaaagattgttttgaggtttcttgcactcatttatgattgtatgagctcttgtgatgagttacttttggttgtgtttactattggtgtagtggttaaattatttggcagctgtccataaccagagag

SEQ ID NO: 2022 - protein, 271 aa, Glycine max
  G3550,CAAT domain coordinates 94-190
MDKSEQTQQQQQQQQHVMGVAAGASQMAYSSHYPTASMVASGTPAVTAPSPTQAPAAFSSSAHQLAYQQAQHFHHQQQQHQQQQLQMFWSNQMQEIEQTIDFKNHSLPLARIKKIMKADEDVRMISAEAPVIFAKACEMFILELTLRSWIHTEENKRRTLQKNDIAAAISRNDVFDFLVDIIPRDELKEEGLGITKATIPLVGSPADMPYYYVPPQHPVVGPPGMIMGKPIGAEQATLYSTQQPRPPVAFMPWPHTQPLQQQPPQHQQTDS

SEQ ID NO: 2023 - DNA, 1056 bp, Zea mays
  G3551,family:CAAT
aaagatcatagatttttgtgcaagagcgagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaacaagctcaacaattccaccaacagctccagcagcaacaacaacagcagcttcagcagttctgggttgaacgcatgactgaaattgaggcgacgactgatttcaagaaccacaacttgccacttgcgaggataaagaagatcatgaaggccgatgaagatgttcgcatgatctcagctgaagctcctgtagtctttgcaaaagcttgtgagatattcatactggagctgacacttaggtcgtggatgcacactgaggtgaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcagaagctatcacctgattcagagttctcattttaggttgtccaaattgcaggttttcttagtaatatcgttggttatcaaactgaaacaggcgattctaagtagggtgtagcatcatggtagtttcatttctgcttgtgatgttagttgaaaggataatgattagtggctagtggattaaagttaccataccatttccttctattccgaaagtttgcctccatgaggcctctatagtaaaaaaaaaaaaaaaa

SEQ ID NO: 2024 - protein, 248 aa, Zea mays
  G3551,CAAT domain coordinates 87-187
MEPSPQPMGVAAGGSQVYPASAYPPAATVAPASVVSAGLQSGQPFPANPGHMSAQHQIVYQQAQQFHQQLQQQQQQQLQQFWVERMTEIEATTDFKNHNLPLARIKKIMKADEDVRMISAEAPVVFAKACEIFILELTLRSWMHTEVNKRRTLQKNDIAAAITRTDIYDFLVDIVPRDEMKEDGIGLPRAGLPPMGAPADAYPYYYMPQQQVPGSGMVYGAQQGHPVTYLWQEPQQQQEQAPEEQQSA

SEQ ID NO: 2025 - DNA, 778 bp, Zea mays
  G3552,family:CAAT
gagtggatatggaaccatcccctcagcctatgggtgtcgctgccggtgggtcacaagtgtatcctgcctctgcctatccgcctgcagcaacagtagctcctgcttctgttgtatctgctggtttacagtcagggcagccattcccagccaatcctggtcatatgagtgctcagcaccagattgtctaccaacaagctcaacaattccaccaacagctccagcagcaacaacaacagcagcttcagcagttctgggttgaacgcatgactgaaattgaggcgacgactgatttcaagaaccacaacttgccacttgcgaggataaagaagatcatgaaggccgatgaagatgttcgcatgatctcagctgaagctcctgtagtctttgcaaaagcttgtgagatattcatactggagctgacacttaggtcgtggatgcacactgaggagaacaagcgccgcaccttgcaaaagaatgacattgcagcagcgatcactaggactgacatttatgacttcttggtcgacattgttcccagggatgagatgaaggaggacggaattgggcttcctagggctggtctgccacccatgggagccccagctgatgcatatccatactactacatgccacagcagcaggtgcctggttctggaatggtttatggtgcccagcaagggcacccagtgacttatttgtggcaggagcctcagcaacagcaggagcaagctcctgaagagcagcaatctgcatgaaagtggctgagaatattgctcag

SEQ ID NO: 2026 - protein, 248 aa, Zea mays
  G3552,CAAT domain coordinates 87-183
MEPSPQPMGVAAGGSQVYPASAYPPAATVAPASVVSAGLQSGQPFPANPGHMSAQHQIVYQQAQQFHQQLQQQQQQQLQQFWVERMTEIEATTDFKNHNLPLARIKKIMKADEDVRMISAEAPVVFAKACEIFILELTLRSWMHTEENKRRTLQKNDIAAAITRTDIYDFLVDIVPRDEMKEDGIGLPRAGLPPMGAPADAYPYYYMPQQQVPGSGMVYGAQQGHPVTYLWQEPQQQQEQAPEEQQSA

SEQ ID NO: 2027 - DNA, 1141 bp, Solanum lycopersicum
  G3553,family:CAAT
ctttgattgaaccctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggccccactgagggtctgccattctattatggcatgccaccacaatctgctcaaccgattggagctccagggatgtacatgggaaagcctgtcgatcaagctctgtatgcccagcagccccgcccatatatggcacagccaatttggccccagcagcagcaaccaccctcagattcttaagcagctcaaagcttagattacaggaatccagaagctaggagcagtgagtagtctgagtagcgaagtactggagaacacatagcagtctgcatactttgaactttattttaatatatatcgacatgaagcactagttattaaaagtcgagtgttcccttagtgtagctaaaactttacaccatgagcttgatgttcttggtgatgtttatgaacaaatatgtttttaagtgtgtcctttaaaagtaaaacctgttgtaggtaaaaaaaaaaaaaaaacaa

SEQ ID NO: 2028 - protein, 230 aa, Solanum lycopersicum
  G3553,CAAT domain coordinates 62-158
MDQHGNGQPPVSAGAIQSPQAAGLAASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPVDQALYAQQPRPYMAQPIWPQQQQPPSDS

SEQ ID NO: 2029 - DNA, 1095 bp, Solanum lycopersicum
  G3554,family:CAAT
tatcaatcatctacctctttgattgaaccctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccaggtattggagtcgttactagctcagctccaatatatggtgctccataccaagctaaccaaatggcagggccctctcctcctgcagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggccccactgagggtctgccattctattatggcatgccaccacaatctgctcaaccgattggagctccagggatgtacatgggaaaagcctgtcgatcaagctctgtatgcccagcagccccgcccatatatggcacagccaatttggccccagcagcagcaaccaccctcagattcttaagcagctcaaagcttagattacaggaatccagaagctaggagcagtgagtagtctgagtagcgaagtactggagaacacatagcagtctgcatactttgaactttattttaatatatatcgacatgaagcact

SEQ ID NO: 2030 - protein, 271 aa, Solanum lycopersicum
  G3554,CAAT domain coordinates 90-186
MDQHGNGQPPGIGVVTSSAPIYGAPYQANQMAGPSPPAVSAGAIQSPQAAGLAASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKACRSSSVCPAAPPIYGTANLAPAAATTLRFLSSSKLRLQESRS

SEQ ID NO: 2031 - DNA, 981 bp, Solanum lycopersicum
  G3555,family:CAAT
caccattacacctttcccattttctctacacagatagtagcttccattttccgcaaaccgccatggacaacaaccctcaccaatctccgactgaggccgctgcggcggccgcagcagcggcagcggcggctcagtcagccacgtatccgtcgcagactccataccaccatctccttcagcagcaacagcagcagctacagatgttttggacttaccagcgtcaagaaatcgagcaagtcaatgatttcaaaaaccaccaacttccccttgctcgtatcaaaaagatcatgaaagctgatgaagatgttcgtatgatctctgctgaagctccagttctgttcgcgaaagcttgtgagcttttcattctggagctcaccatccgttcgtggcttcacgctgaggaaaacaagcgcaggactttacagaagaatgacatcgctgcggcgattactcgtactgatatttttgattttctggttgacatcgttcctagggatgaaattaaggatgagggtgttgggcttggacccggaattgtgggttctactgctagtggtgtgccgtactattaccctccgatgggccagccggctccgggtggagtgatgcttggtaggcctgctgttcctggggttgatccatcaatgtatgtgcaccctccaccgtcacaggcgtggcaatctgtgtggcagactggagacgataattcctatgctagtggaggtagcagtggacagggtaaccttgatggccaaatttaaaagatctcgctgctgccagtttggaggcttaacagcacatgtgaaactgatggttatgatagggaaatgtaatttcttcaaattgtgaatccaccttttatggcttctgtcatggatattgtttgactttaaccgacttgaaccttctgtctgtataaaacttgacttttgtgtatttctaaatttctcttctccaatccttttggggttgctaaaaaaa

SEQ ID NO: 2032 - protein, 232 aa, Solanum lycopersicum
  G3555,CAAT domain coordinates 54-150
MDNNPHQSPTEAAAAAAAAAAAAQSATYPSQTPYHHLLQQQQQQLQMFWTYQRQEIEQVNDFKNHQLPLARIKKIMKADEDVRMISAEAPVLFAKACELFILELTIRSWLHAEENKRRTLQKNDIAAAITRTDIFDFLVDIVPRDEIKDEGVGLGPGIVGSTASGVPYYYPPMGQPAPGGVMLGRPAVPGVDPSMYVHPPPSQAWQSVWQTGDDNSYASGGSSGQGNLDGQI

SEQ ID NO: 2033 - DNA, 803 bp, Oryza sativa
  G3556,family:AT-hook
tcgacgggatggggagcatcgacggccactcgctgcagcagcatcaggggtactcccacggcggcggcgcgggagggagcaacgaggaggaggaggcgtcgccgccgcccggcggtggctcggctacggggtcggcgggccgccggccgagggggaggccgccgggctccaagaacaagccgaagccgcccgtcgtggtgacgcgggagagccccaacgcgatgcgttcccacgtgctggagatcgccagcggcgccgacatcgtcgaggccatcgcgggcttctcccgccgcaggcagcgcggcgtctccgtgctcagcgggagcggcgccgtcaccaacgtcacgctccggcagcccgcggggactggggccgccgccgtcgcgctgcgggggaggttcgagatattgtccatgtctggcgccttcctcccggcgccggcgccgccaggggccacggggctcgccgtgtacctcgccggcgggcaggggcaggtggtgggtgggagcgtcatgggggagctgatcgcgtcgggccccgtcatggtgatcgcggccacgttcggcaacgccacgtacgagaggctgccgctggaccaggaaggcgaggagggcgccgtgctgtccgggtcggagggcgccgccgcgcagatggagcagcagagcagcggaggcgccgtcgtgcccccgccgatgtacgccgccgtccagcagacgccgccgcacgacatgttcgggcagtgggggcatgcagcggtggctcggccgccgccgacatcgttctagcactggcaccggttaatt

SEQ ID NO: 2034 - protein, 258 aa, Oryza sativa
  G3556,domain coordinates 45-53,53-196
MGSIDGHSLQQHQGYSHGGGAGGSNEEEEASPPPGGGSATGSAGRRPRGRPPGSKNKPKPPVVVTRESPNAMRSHVLEIASGADIVEAIAGFSRRRQRGVSVLSGSGAVTNVTLRQPAGTGAAAVALRGRFEILSMSGAFLPAPAPPGATGLAVYLAGGQGQVVGGSVMGELIASGPVMVIAATFGNATYERLPLDQEGEEGAVLSGSEGAAAQMEQQSSGGAVVPPPMYAAVQQTPPHDMFGQWGHAAVARPPPTSF

SEQ ID NO: 2035 - DNA, 1082 bp, Glycine max
  G3643,family:AP2
ccacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttatctttttttttttttttttgagttatgatcgatgcgcatagttagtagttacagataattactgctagtgttgggtgtttaaacggtcagagatgatgatatataaatttgatgtgcgctagctgcctttttgaagaaactaaaaaaaggtaaaacaagaaagattgtacccccaaaatgaacttggtcaatttcacactttcacgccatttgcattttgtgcacgttgttagttttcaaattgttaattcccttgctaaacccactcaaacttgagtgcgttcaccttttattaccacgtagtaactgagagttaacgaaaatatttctttataaaaattatttaccatttagtgtctttcgtttacttgtaattattcaacttgtcaataagatgaaagttctaattttagatataataaaattcagctagtatttgtgaattactcactt

SEQ ID NO: 2036 - protein, 179 aa, Glycine max
  G3643,AP2 domain coordinates 13-78
MSRSSAMHGITSTNNKLKGVRRRKWGKWVSEIRVPGTQERLWLGTYATPEAAAVAHDVAVYCLSRPSSLDKLNFPETLSSYSVQLRDMSPRSVQKVASDVGMDVDARNIVAGKTSTVGAETNCESDERTSTASVCNVVGEGGADHSDVFWWDDDGGSWHGSGGDSTERDALSISIEDYL

SEQ ID NO: 2037 - DNA, 687 bp, Oryza sativa
  G3644,family:AP2
atgccttttgtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 2038 - protein, 228 aa, Oryza sativa
  G3644,AP2 domain coordinates 52-122
MPFVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATLNFPERAAATYGGGAAVARLSPRSVQRVASDAGMAADAQLVAARDAAPAPAPATAYARPDHCAGATTARHDELARRGMYGAHAHAAGANARTSGERQLVCAEEISVDDMEILM

SEQ ID NO: 2039 - DNA, 656 bp, Brassica rapa subsp. Pekinensis
  G3645,family:AP2
cccacgcgtccgatggattacatcgacaacaccgtcgaaactcaatcaaagtacaaaggcatccgtcgccggaaatgggggaaatgggtatcggagattcgagttccgggaactcgcgaccgtctctggttaggctcattctccacggcggaaggcgcagccgtggcgcacgacgtggctttctactgtttacaccaaccaaactcgctcgaatctctcaacttccctcacttgcttcctccttccattgtttccaagacttcgccgaggtctatccagcaagctgcttctaatgccggaatggccgttgacgccggaatcgttaacagctgtgatcacgcgtcagggaactctgggaatggagatacaacgacggcgtattgtgagaatggaggtgcgttgaatatatcagtgtatgattatttggacggtcacgatcacgtttgaacttcatcttcttgttttttcgtttaaagatacagctactcaaaagaagcagtgatggagcctggtgtgtaagcaagcaaaacgttgtgaatatatataccggtatgtttcgctgttggcccaatgcaagaaacttttgtagtacgaatatatatattttattttgaatgccttcaagaggattataatgcgagtgaagctttgtttca

SEQ ID NO: 2040 - protein, 144 aa, Brassica rapa subsp. Pekinensis
  G3645,AP2 domain coordinates 10-75
MDYIDNTVETQSKYKGIRRRKWGKWVSEIRVPGTRDRLWLGSFSTAEGAAVAHDVAFYCLHQPNSLESLNFPHLLPPSIVSKTSPRSIQQAASNAGMAVDAGIVNSCDHASGNSGNGDTTTAYCENGGALNISVYDYLDGHDHV

SEQ ID NO: 2041 - DNA, 649 bp, Brassica oleracea
  G3646,family:AP2
cagccgcataacatattactattccccctggtcatatctttgacttttatttttatttgctctaacctaaaagtattatataagtattgcacaattcatacaatcggaattgactttcttctcctccaatcgtatttttattcaacagttcctctcaagatcatcaactcaaaaaatggatcctagagacggcggagaaacccatcaggccaagtacaaaggcatccgtcgccggaaatggggaaaatgggtatcggagattagggttccagcaactcgtgaacgactctggttaggctctttctccaccgccgaaggagctgcggtagcccacgacgtcgctttttactgcttgcaccgaccatcttctctcgacaacgaagcttttaacttccctcacttgctgcaaccttcccttgcctccaacacatctcctaagtccatacaaaaagctgcttcggacgcaggcatgggcgtagacgcaggattcgccctaaacaacgacagcgcgagtggtggcgtggaggaaggcaccgaacgggaaacgttgaacatctccgtgtacgattatctagacgacggtcgcatttgatatattggtttatatctacgagcaccttatattagtaattaatataggatgtgaata

SEQ ID NO: 2042 - protein, 138 aa, Brassica oleracea
  G3646,AP2 domain coordinates 10-77
MDPRDGGETHQAKYKGIRRRKWGKWVSEIRVPATRERLWLGSFSTAEGAAVAHDVAFYCLHRPSSLDNEAFNFPHLLQPSLASNTSPKSIQKAASDAGMGVDAGFALNNDSASGGVEEGTERETLNISVYDYLDDGRI

SEQ ID NO: 2043 - DNA, 495 bp, Zinnia elegans
  G3647,family:AP2
attcgcggccgcgaatatgagtaccagctcagatgaaggtaacaactgtttaagccaaaagacttacaaaggcgttaggtgccgacgatggggcaaatgggtgtcagagattcgagttccaggaagtcgagaacggctctggctaggcacgtactctacgcctgagggtgcagctgtggctcatgatgtagcctcgtactgtttaaaagggaatacgtcttttcataaacttaatattccgtctatgttacctccgacagcacggacagacctatctcctaggtccatccaaaaggctgcgtctgatgctggtatggccatagacgcacggtttatcgcgtctagagataccacaccgactaatgaggcgttgaacatttctgtagatgattatctttaaattttgagaactaatattgtgtcaccaatattgtaagtcgatctacattggcaaacacaatgtacgtgtttggtggcacttccagattattgttt

SEQ ID NO: 2044 - protein, 127 aa, Zinnia elegans
  G3647,AP2 domain coordinates 13-78
MSTSSDEGNNCLSQKTYKGVRCRRWGKWVSEIRVPGSRERLWLGTYSTPEGAAVAHDVASYCLKGNTSFHKLNIPSMLPPTARTDLSPRSIQKAASDAGMAIDARFIASRDTTPTNEALNISVDDYL

SEQ ID NO: 2045 - DNA, 594 bp, Oryza sativa
  G3649,family:AP2
atgggccgggtggcggcgagcggcggcggcggcggcggaggggagatgatgaggtacaggggcgtgcggcggcggcggtgggggaagtgggtgtcggagatccgggtgcccgggacgcgggagcgcctgtggctcggctcctacgccaccgccgaggccgccgccgtcgcgcacgacgccgccgtctgcctcctccggctcggcggcggccgccgcgccgccgcaggcggaggcggcgggctcaacttccccgcccgcgcgctcgccgcggcggcggccgcctcctcctacggcggcgccggcggtctcctgtccccgcgctccgtgcagcgcgtggcgtccgacgccggcatggccgccgacgcgcagctcgtggacctgcgccgcgaccacccgcccgccgccgccgccgcctcatcctccggcagcggcgtggcgggagacggtgcaagaaagcaagggacacgtggcgaggttagcgacacgtattggtgtaggaatggagaggatgggagcagaagccggagctccgggagtgaggagctcattgtttacgagggcttaagtgtagatgacatggaaattttgatgtaa

SEQ ID NO: 2046 - protein, 197 aa, Oryza sativa
  G3649,AP2 domain coordinates 15-87
MGRVAASGGGGGGGEMMRYRGVRRRRWGKWVSEIRVPGTRERLWLGSYATAEAAAVAHDAAVCLLRLGGGRRAAAGGGGGLNFPARALAAAAAASSYGGAGGLLSPRSVQRVASDAGMAADAQLVDLRRDHPPAAAAASSSGSGVAGDGARKQGTRGEVSDTYWCRNGEDGSRSRSSGSEELIVYEGLSVDDMEILM

SEQ ID NO: 2047 - DNA, 813 bp, Zea mays
  G3650,family:AP2
ccacccgtgctcgatcgatcatgccatgtcaacgcccccggccgcgctgaccttgatccttctcgtctcaccgcaccttataaatacgcccacgtcgctcgtgtcgtcgtgtgctccatcgcaaacggccaaaaaccaccagcacaagtgcacaagccattgcccatcggacgcccagccggccagcccctgtcccgacggtcggccgacgacgatgagccgcgcagcgaccaacagcggcgcggagcggcggtgccggtacaggggcgtgcggcggcgggcctgggggaagtgggtgtcggagatccgggtgccgggcacgcgggagcggctgtggctgggatcctacgcggcgcccgaggccgccgccgtcgcgcacgacgccgccgcgtgcctcctccgcggctgcgcgggccgccgcctcaacttcccgggccgcgccgcctgctactacgcctgcggcgggcagcagccgctgtcgccgcgctccgtgcagcgcgtcgcgtccgacgccggcatggccgccgacgcgcagatcgtcgacgcgcgggcggccctcgcctcgccgccgcccgttgtccagcccgccgctctcgctggcattattggcggcgccgcgcgagaaggcggcggaggcgtgcgaggccccgcgtgcgcgccggcgccgccaagcaacggcgctggcagcagcagtacgtattggtccacgccgagcagtgagccgccgcttgtttacggggacattagcgtagacgacatagagatcttgatttgactattaggcactagttagtagcatagtcatggcagttc

SEQ ID NO: 2048 - protein, 249 aa, Zea mays
  G3650,AP2 domain coordinates 75-139
MSTPPAALTLILLVSPHLINTPTSLVSSCAPSQTAKNHQHKCTSHCPSDAQPASPCPDGRPTTMSRAATNSGAERRCRYRGVRRRAWGKWVSEIRVPGTRERLWLGSYAAPEAAAVAHDAAACLLRGCAGRRLNFPGRAACYYACGGQQPLSPRSVQRVASDAGMAADAQIVDARAALASPPPVVQPAALAGIIGGAAREGGGGVRGPACAPAPPSNGAGSSSTYWSTPSSEPPLVYGDISVDDIEILI

SEQ ID NO: 2049 - DNA, 702 bp, Oryza sativa
  G3651,family:AP2
atggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgaccgctcaacttcccggagcgcgcggcggccaccgtacggcggccgccgtggcgcgcctgtcgccgcggtccgtgcagcgcgtggcgtccgacgcggcatggccgccgacgcgcagctcggcgtgccgggacccggcccggcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaa

SEQ ID NO: 2050 - protein, 233 aa, Oryza sativa
  G3651,AP2 domain coordinates 60-130
MADLPCIYIRVVRTLAFPTLANQIEGEIKSRTERDHGEVDLSSPEEAMSRAECGGGEEEERCRYRGVRRRRWGKWVSEIRVPGTRERLWLGSYATPEAAAVAHDTAVYFLRGGAGDGGGGGATAQLPGARGGHRTAAAVARLSPRSVQRVASDAAWPPTRSSACRDPARPAPATAYARPDHCAGATTARHDELARRGMYGAHAHAAGANARTSGERQLVCAEEISVDDMEILM

SEQ ID NO: 2051 - DNA, 861 bp, Oryza sativa
  G3657,family:AP2
ccgagcactgcgcactgagcacctcgacacggcgcgcgcgcggccatggtgaagaacacgagcaacaagtgcattgctgctgccggcgcgacggcggcggccggcttaggcggtggcgcggcgtcgtgcagcggcggcggaggtgatgggaaggtgacgacggcggcggcagcggcgttggcggtgaggccgtacaagggggtgaggatgcggagctgggggtcgtgggtgtcggagatcagggcgccgcaccagaagcggcggatctggctgggctcctacgccacgccggaggccgcggcgcgcgcctacgacgccgcgctgctctgcctcaagggctccgacgccgtcctcaacttcccctcctccgcctcgtctcgccgccgcctcgacatccaccgggggggcacggactcggcggcgggcgacatgtcgccgaggtccatccagcgcgtcgcggccgccgcggcggcggcattcgacgccgccgccgccgccgtcgtcgtcgacgaaagctgctcgtgcagcgccgaggcgatgtcgtcgacgccgacgtcgggagcgacctcgctgtccacgctgggaagctccggcggcggtgacgtgctggaccacgcgacgacgccgtcgtcgtcgtcgtctgccgcggccaacgtttgctcgccgccgctggagggggaccatgagctgtggacggagctggacgcgttcgcgtcgccgaagttcatggatctaatggccgccggcggcacggcgttctcgtcgccgtgggaggagcccgaggaggacggcgagctgatgaggctgtggagcttctgctagcttagctaggagcctaggaaacgatcgtgaatccattct

SEQ ID NO: 2052 - protein, 258 aa, Oryza sativa
  G3657,AP2 domain coordinates 47-109
MVKNTSNKCIAAAGATAAAGLGGGAASCSGGGGDGKVTTAAAAALAVRPYKGVRMRSWGSWVSEIRAPHQKRRIWLGSYATPEAAARAYDAALLCLKGSDAVLNFPSSASSRRRLDIHRGGTDSAAGDMSPRSIQRVAAAAAAAFDAAAAAVVVDESCSCSAEAMSSTPTSGATSLSTLGSSGGGDVLDHATTPSSSSSAAANVCSPPLEGDHELWTELDAFASPKFMDLMAAGGTAFSSPWEEPEEDGELMRLWSFC

SEQ ID NO: 2053 - DNA, 783 bp, Brassica oleracea
  G3659,family:AP2
caaaaatataatggcggcagaatccgactacattttgcttgagtcgataagacgacacttactaggagaatcggagtcgtggctcagtgagtcgacggcgagttcggtggttcaatctggtacgacggccaaaccggtgtacggaagaaaccctagcttcagcaagttgtacccttgcttcactgagagctggggacacttgccgttgaaagaaaacgacacggaggacatgttagtctacggtatcctcaacgacgcgtttcacggcggatgggaaccgtcgtcttcatcctccgacgaagaccagagctctaattttccgaaggttaaaaccgagaacttcacggtggtcgatcatgttccggcgaagaaggcgagtccggttaaggctccggagaaggggaagcattacagaggagtgaggcagaggccgtgggggaagttcgcggcggagataagggatccggcgaagaacggagctagggtttggttggggacgtttgagacggcggaagatgcagcgttggcttacgacagagctgctttcaggatgcgtggttcccgcgctcttttgaattttcctttgagggttaactcaggtgaacctgacccggttcgggttaagtcaaagagaggttcttcctctgaaatcggaggttcgaagcggagaagaacggtggcttctgtaaacggcggcggtcaaggaacagatatggggttgatggtcaagtgtgaggtggttgaagtgagacgtgacgatcatttacttgtcttatagttttt

SEQ ID NO: 2054 - protein, 255 aa, Brassica oleracea
  G3659,AP2 domain coordinates 130-194
MAAESDYILLESIRRHLLGESESWLSESTASSVVQSGTTAKPVYGRNPSFSKLYPCFTESWGHLPLKENDTEDMLVYGILNDAFHGGWEPSSSSSDEDQSSNFPKVKTENFTVVDHVPAKKASPVKAPEKGKHYRGVRQRPWGKFAAEIRDPAKNGARVWLGTFETAEDAALAYDRAAFRMRGSRALLNFPLRVNSGEPDPVRVKSKRGSSSEIGGSKRRRTVASVNGGGQGTDMGLMVKCEVVEVRRDDHLLVL

SEQ ID NO: 2055 - DNA, 703 bp, Brassica oleracea
  G3660,family:AP2
tctgtaataataatgtacggacatggcgagataaccacggcagcagaatcagattacgctttgctggagtcaatacgacgtcacttgctaggtggagacaacgagttacgattcagtgagtcaataccgagttcatgtttcactcagagttggggagacttgccattgaaagagaacgactccgaggatatgttagtgtacagtgtcctcaacgacgccttcaacggagcctttgaaacgtcgtcgccgtcgtcggacttgagctgtctcagcgattttaacgattttccggcggttaaaatggaaacttcggagaacttagcagcggaggcggaaaaaatgaaggcggtggcggcgccgccgtcaaagggaaagcattacagaggggtgagacagaggccgtgggggaaattcgcggcggagatacgtgatccggcgaaaaaaggagcgagggaatggttagggacgtttgagacggcggaagatgcagctttggcttacgatagagctgcttttaggatgcgtggttcccgcgctttgttgaattttccgttgagggttaactccggtgaacctgacccggtaaggatcaagtcaaagaggtcttataagtcttcttcgtcgtcctcttctgaaaacgggaagccgaagcagaggagaagaacagagaacgtgccatagttcaggtgaagggcgatgttgt

SEQ ID NO: 2056 - protein, 222 aa, Brassica oleracea
  G3660,AP2 domain coordinates 119-183
MYGHGEITTAAESDYALLESIRRHLLGGDNELRFSESIPSSCFTQSWGDLPLKENDSEDMLVYSVLNDAFNGAFETSSPSSDLSCLSDFNDFPAVKMETSENLAAEAEKMKAVAAPPSKGKHYRGVRQRPWGKFAAEIRDPAKKGAREWLGTFETAEDAALAYDRAAFRMRGSRALLNFPLRVNSGEPDPVRIKSKRSYKSSSSSSSENGKPKQRRRTENVP

SEQ ID NO: 2057 - DNA, 839 bp, Zea mays
  G3661,family:AP2
caggatgctgctgaacccggcgtcagaggcgtcggtgctagacaccatccggcagcacctcctcgaggagccagccgacgagagcttcgggagcctggtggcggaccagtggagcggctcgctcccgttccgcaccgacgacgccgacgacatggtggtgttcggggcgctgcaggacgccttcgcctacggctggctgcccgacggctcattcgtgcacgtgaagcccgagccggtgcggtcccccgactcgtcctcctacccctgctcctacgacggctcaccctgcttcggcctcctggacccggagccgccgctgacgcccggcaccaccacgcccagtagtagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaaccggccggcccagccgtggttccctgccgcgccggtcgagcaggcggcgatggctccgcgcgtggagcagatcgtcgtctagtctagccatgcgccggagaaat

SEQ ID NO: 2058 - protein, 270 aa, Zea mays
  G3661,AP2 domain coordinates 126-190
MLLNPASEASVLDTIRQHLLEEPADESFGSLVADQWSGSLPFRTDDADDMVVFGALQDAFAYGWLPDGSFVHVKPEPVRSPDSSSYPCSYDGSPCFGLLDPEPPLTPGTTTPSSRGQEEAAAAMARGKHYRGVRQRPWGKFAAEIRDPARNGARVWLGTYDTAEDAALAYDRAAYRMRGSRALLNFPLRIGSGDKRPSPAPPEPATSSDSSSSSASGSHKRRKRGEAAAANMAMALVPPPSQLNRPAQPWFPAAPVEQAAMAPRVEQIVV

SEQ ID NO: 2059 - DNA, 1891 bp, Oryza sativa
  G3674,family:ZF-HB
aagcttttcttaagctcgccaagaacacacccgagaaatccaaaagggagggaaaagaaagggggtggccggccggtcggtcggtcggcggccatggatttcgacgaccatgacgagggtgacggcgacgaggagatgcctccgatgcctctgagctcgggctacgacgcgccgatgcagcccgggcttggaggtggcggtggcggggtgcccaagccgggaggtggagtcggcggcggcggtggtggtggtggtggtggtggaggaggaggggcgaggtatcgggagtgcctcaagaaccacgccgtcggcatcggcgggcacgccgtggacggctgcggcgagttcatggcttccggcgaggagggctccatcgacgcgctccgctgcgccgcctgcggctgccaccgtaacttccaccgcaaggagtcggagtcccccacgggcgtcgggccggccgagccttccgccgtgtcccccgccgccatctcggcctacggcgcctcgccgcaccaccagttctccccctactaccgcaccccggcagggtacctccaccaccagcagcaccagatggcggccgcggcggcggccgcggccgccgccgcagcgggcggctacccgcagcggcccctcgcgctgccgtccacctcccactcgggacgcgacgagggcgacgacatgtccgggatggtcggccccatggtgattggccccatggtcggcatgtccctcggctccgccggcccctccggctccggctccggcaagaagcggttccgcacaaagttcacgcaggagcagaaggacaagatgctcgccttcgcggagcggctcgggtggcgcatccagaagcacgacgaggccgccgtgcagcagttctgcgaggaggtctgcgtcaagcgccatgtcctcaaggtttggatgcacaacaacaagcacaccctgggcaagaaggcgccatagctaagctaagccaagcaagctcagctcagctcatctcctcccggtgctaggtacctgcactgcaactgcaactgcatgcatcaccatctccatctacttctactacctccttacccgcggctaattagcctttttctttgccttcttttacctcacctgagtagaagcttagctaggttcgtagcgagcaagctgttcttgttggttttaggggaggtggtggttgctgctgctgctgcttttgcatccttccttgtttctttttcgttattttattccattgtggttgggttctttgggcttgtggttgccgtcgttgttgtttcctagtagatgatgacgacgacgtttggtgttgggaaggaagaggacatggatggcgatttgccgatcgatttagatcttgggaatgtagtacttttgtgttgcaattgaaatttccttcctggggatttgggttgctgcacggtttgtttgtttcatcatttcttttcccctatatttcttgtgcttggcacttcatcatcagtagcacttgtagttcgtctagctaacaactagggcagataaagattcagaaaggtcggctgcaactatatgagctgcaacactgttgcattcacatcgatctccctcgcttccaatttccagacctgggcaccaacttgtccatgatccgtccgcttcacctgtctactctgaaattccaatttctctagctaccatgttcgctgcatttttcttccgagttctcgatctcactgtatccgctgcatttactcgtcttccacatctcgcgagcagtgatgccgcattgctgcccatgtgttaggacgcagagcttgcagaagctatagcaatggccggggactttttagaatttagtctatgtgaattcaatgaagcctcgtcctctcttttactc

SEQ ID NO: 2060 - protein, 290 aa, Oryza sativa
  G3674,ZF-HB domain coordinates 61-114,226-289
MDFDDHDEGDGDEEMPPMPLSSGYDAPMQPGLGGGGGGVPKPGGGVGGGGGGGGGGGGGGARYRECLKNHAVGIGGHAVDGCGEFMASGEEGSIDALRCAACGCHRNFHRKESESPTGVGPAEPSAVSPAAISAYGASPHHQFSPYYRTPAGYLHHQQHQMAAAAAAAAAAAAGGYPQRPLALPSTSHSGRDEGDDMSGMVGPMVIGPMVGMSLGSAGPSGSGSGKKRFRTKFTQEQKDKMLAFAERLGWRIQKHDEAAVQQFCEEVCVKRHVLKVWMHNNKHTLGKKAP

SEQ ID NO: 2061 - DNA, 774 bp, Zea mays
  G3676,family:ZF-HB
cggcagggagctaggggcaggcatgctctgatggaattcaggggccaggaggaggaggagcagcccgtctcggaggagatgggcgccagctccgcgccgtcgtccgcccccacccccgccccggggaaccaggaccacgccgccgaggcgaggtaccacgagtgcctgcggaaccacgcggcggcgctgggcggccacgtcgtcgacggctgcggggagttcatgcccggggacggcgacagtctcaagtgcgccgcatgcggctgccaccgcagcttccaccgcaaggacgacgcgcgccgccgccaccaccaactcatgctcccggcgaccgcgacgtcctctcgcgtcccgctgctcctgcctccgccccacccgcactacgcgccgccgccgttcccgtaccacggcacgcccagcggcggcggcggcggcaccgccaccgagtcgtccagcgaggagcgcggcccgccgtccggggccgccgccgtgcaggcgcagggccacgtccggcggaagcggttccggaccaagttcacgccggagcagaaggagcagatgctggcgttcgcggagcgcctcggctggcggttgcagaagcaggacgacgcgctggtgcagcacttctgcgaccaggtcggcgtgcgccgccaggtattcaaggtctggatgcacaacaacaagcacaccggcaggaggcagcagccgcacctgccgccgccgcaggggcagcaacagccccaacagcagccgaagtagccacggtgggagaca

SEQ ID NO: 2062 - protein, 242 aa, Zea mays
  G3676,ZF-HB domain coordinates 40-89,162-225
MEFRGQEEEEQPVSEEMGASSAPSSAPTPAPGNQDHAAEARYHECLRNHAAALGGHVVDGCGEFMPGDGDSLKCAACGCHRSFHRKDDARRRHHQLMLPATATSSRVPLLLPPPHPHYAPPPFPYHGTPSGGGGGTATESSSEERGPPSGAAAVQAQGHVRRKRFRTKFTPEQKEQMLAFAERLGWRLQKQDDALVQHFCDQVGVRRQVFKVWMHNNKHTGRRQQPHLPPPQGQQQPQQQPK

SEQ ID NO: 2063 - DNA, 1286 bp, Zea mays
  G3680,family:ZF-HB
tgggggcgccgcatggaagccatggacgtcaagtacaagcccgtcatgttccccaacggcgccggcctcaagaagccgaagccggcggcggccgtggcgctggccggggagccgctgtaccgggagtgcctcaagaaccacgccgcgagcctgggcgggcacgccgtcgacggttgcggcgagttcatgccctcgccgggggccaaccccgccgacccgacgtcgctcaagtgcgcggcgtgcgggtgccaccgcaacttccaccgccggacgctggagggttcccctccgccgcccgcgcccgcgccgctggcgctcccgcctccgccgagcgtgatgcacggccagccgcaccgcgcccgggaggagacgcccgaggaccgccacccgggggtcgtcgacgccgacgactccgattccgactcggaaggctcggagtacgacgaggagcggtcggtgtccccgccgccgccgccgcaccacctgctgccggcgccggtggcgcagcagcccccgccaccgtcctacttcccgacggcgccgcacatggtgctctcgctaggttccggcgtgcccgggcccgcggtggcggtatccccggcgcagaggctggccccgacccagctgacgccgtccagcgcgccgccccacgccgggggcgcgatgcccatgcccaggaagcggttccgcaccaagttcaccgccgagcagaagcagcggatgcaggagctgtcggagcggctcgggtggcggctgcagaagcgcgacgaggccatcgtcgacgagtggtgccgcgacatcggcgtcggcaagggcgtcttcaaggtctggatgcacaacaacaagcacaacttcctgggcgggcacagcgcccgccgcagcgcctcctcgcccgcccccgcccccgccgccgcgtcgctccaaaccccagccgccggcgccggcgctgctgcagcaccgtcattccacccgtccaggatcacccctccccctcccgtcctcacctcgtccccgacggccgccaccggcttcaacatcaacggcgccgcctcgtcggcgcccaccgtcgccaccgactacaccacggacaacgccaacggagcttcgtcgccgcactccgcttgaactagagaagggagaagagaggaggggggaagggaagggagagcggagagagagaaacatgtagcttaatttcagtgatcactcgttttttttttctttagacttcttgccatctactaagaaattaaccccaagaaaaagcatgccgctgtgcgccatgc

SEQ ID NO: 2064 - protein, 370 aa, Zea mays
  G3680,ZF-HB domain coordinates 34-89,222-285
MEAMDVKYKPVMFPNGAGLKKPKPAAAVALAGEPLYRECLKNHAASLGGHAVDGCGEFMPSPGANPADPTSLKCAACGCHRNFHRRTLEGSPPPPAPAPLALPPPPSVMHGQPHRAREETPEDRHPGVVDADDSDSDSEGSEYDEERSVSPPPPPHHLLPAPVAQQPPPPSYFPTAPHMVLSLGSGVPGPAVAVSPAQRLAPTQLTPSSAPPHAGGAMPMPRKRFRTKFTAEQKQRMQELSERLGWRLQKRDEAIVDEWCRDIGVGKGVFKVWMHNNKHNFLGGHSARRSASSPAPAPAAASLQTPAAGAGAAAAPSFHPSRITPPPPVLTSSPTAATGFNINGAASSAPTVATDYTTDNANGASSPHSA

SEQ ID NO: 2065 - DNA, 1098 bp, Zea mays
  G3681,family:ZF-HB
cgtcatgttccccaacggcgccgccttcaagaaggcgaagccggcggccgtggcgccggccggggagccgctgtaccgggagtgcctcaagaaccacgccgcgagcctgggcgggcacgccgtggacgggtgcggcgagttcatgccctcgccgggggccaaccccgccgacccgacgtcgctcaagtgcgcggcgtgcgggtgccaccgcaacttccaccgccggacggtggagggttccccgccgcagcctgcgcccgcgccgctggcgctcccgccgccgccgccgccgccgccgagcgtgctgcacggccagacgcaccgcggcggggaggatacgcccgaggaccgccacccgggggtagtcgacgccgacgaccccgattccgactcggagggctcggagtacgacgaggagcggtcagtgtccccgccaccgccgcaccacgtgccggcgccggtggcgcagcaacccccgccgccgtcatacttcccggcggcggcgccgcaccagcacatgctgctctcgcttggtcctggcgccgcggtggcggccgcggcgcagaggctggccccagcccagctgacgccgtcgagcgcgccgcctcccgggggcgcgatgcccaggaagcggttccgcaccaagttcaccgccgagcagaagcagcggatgcaggagctgtcagagcggctcgggtggcggctgcagaagcgcgacgaggccgtcgtggacgagtggtgccgcgacatgggcgtcggcaagggcgtcttcaaggtctggatgcacaacaacaagcacaacttcttgggcggacacagcgcccgccgcagcgtctctgcctcctcaggcgctgctgcgctcctccaaaccccatgcgccaacgccggcgctgctgcaccgtcattcaacccgtccaggctcacccctccccctcccgtcctcacatcgtccccgaccggcttcaacatcaacggcgccgcctcctcctcgccgcccaccgtcaccgccgaccacacggacaacgccaacggagcttcatcgccgcactccgcttaagctagagaggagagggaagcgagaatggagagacaaacatg

SEQ ID NO: 2066 - protein, 350 aa, Zea mays
  G3681,ZF-HB domain coordinates 22-77,208-271
MFPNGAAFKKAKPAAVAPAGEPLYRECLKNHAASLGGHAVDGCGEFMPSPGANPADPTSLKCAACGCHRNFHRRTVEGSPPQPAPAPLALPPPPPPPPSVLHGQTHRGGEDTPEDRHPGVVDADDPDSDSEGSEYDEERSVSPPPPHHVPAPVAQQPPPPSYFPAAAPHQHMLLSLGPGAAVAAAAQRLAPAQLTPSSAPPPGGAMPRKRFRTKFTAEQKQRMQELSERLGWRLQKRDEAVVDEWCRDMGVGKGVFKVWMHNNKHNFLGGHSARRSVSASSGAAALLQTPCANAGAAAPSFNPSRLTPPPPVLTSSPTGFNINGAASSSPPTVTADHTDNANGASSPHSA

SEQ ID NO: 2067 - DNA, 1009 bp, Oryza sativa
  G3683,family:ZF-HB
tgtgtccgccattgcaaatggatctttctggggcgcagggcgagctgccgttgccaatgcacgccgcggcgtcgccgtacctcggcttgcaccatgaccaccaccaccatcatggcggcggcggcggcggtggagggatgaatgggcggcacatgtcgccgccgacgccaccggcggcggcggaggagtcgaaggcggtggtggtggtgtcgtcgtcggcgacggcggcggcgaggtacagggagtgcctcaagaaccacgcggcggccatcggcggcagcgccacggacgggtgcggcgagttcatgcccggcggcgaggaaggctcgctcgacgcgctccgctgctccgcctgcggctgccaccgcaacttccaccgcaaggagctcgacgccgccgccgccccgccgctccaccaccaccaccaccaactgctcggcgtcggcgcgcacccccgcggccacggccaccaccaccaccacctcctggtggcggcgctgccgccgccgacgcggatggtgatgccgctgagcgccatgcacacgtcggagtcggacgacgccgcggcgcgccccggcggcggcgcggcggcgaggaagcggttccggaccaagttcacggcggagcagaaggcgcggatgctggggttcgccgaggaggtcgggtggcggctgcagaagctggaggacgccgtcgtgcagcgcttctgccaggaggtcggcgtcaagcgccgcgtcctcaaggtctggatgcacaacaacaagcacaccctcgcccgccgccacctccacccctcccccgccgccgccgccggagacgacgacgacgacggcgcgccgccgccgcaccccgaccccggcggcgcgagctcgccgccgccgccgcaccacctccggctccagtaacccaacacatcaagaaatccgttgacaacaaaagcctcatttctagcttagctgcattgcattgcattgctctactactgttccatcaaattgatgcttaatcc

SEQ ID NO: 2068 - protein, 295 aa, Oryza sativa
  G3683,ZF-HB domain coordinates 72-125,193-256
MDLSGAQGELPLPMHAAASPYLGLHHDHHHHHGGGGGGGGMNGRHMSPPTPPAAAEESKAVVVVSSSATAAARYRECLKNHAAAIGGSATDGCGEFMPGGEEGSLDALRCSACGCHRNFHRKELDAAAAPPLHHHHHQLLGVGAHPRGHGHHHHHLLVAALPPPTRMVMPLSAMHTSESDDAAARPGGGAAARKRFRTKFTAEQKARMLGFAEEVGWRLQKLEDAVVQRFCQEVGVKRRVLKVWMHNNKHTLARRHLHPSPAAAAGDDDDDGAPPPHPDPGGASSPPPPHHLRLQ

SEQ ID NO: 2069 - DNA, 1096 bp, Oryza sativa
  G3685,family:ZF-HB
taacccaaagccatccagcactttgcgaggtcgctttcgtttcgcctccttcgtcggccccggaccggaccggacagaggcatgtcctgatggaattcaggggccatgacgaacccgtcgacgagatgggagtcgcgtacggcaggacgccaccctcctcctcctcctcccccgccgcctccgcctccgcggggaacggcgccggcgcggcggaggtgaggtaccacgagtgcctgcgcaaccacgccgcggcgatgggcggccacgtcgtggacggatgcagggagttcatgccgatgccgggggacgccgccgacgccctcaagtgcgccgcctgcggctgccaccgcagcttccaccgcaaggacgacgggcagcagcagcagcagctgcgcctgctcatcccgtccccgcccacgccgcgcgtcccgctgctcatgccgccgccgcagccgcagccgcacccgcacccgcaacacccctacctgcacccgccgttcccgtaccaccacaccccaagcggcagcggcggcacgacgaccgagtcgtccagcgaggagcgggggcctccctcctcgtcggcggcggcggcgcaggggcggcggaagcggttccggaccaagttcacgccggagcagaaggagcagatgctggcgttcgcggagcgggtggggtggcggatgcagaagcaggacgaggcactcgtcgaacagttctgcgcgcaggtcggcgtgcggcgccaggtgttcaaggtgtggatgcacaacaacaagagcagcatcggcagcagcagcggcggcggcagtaggaggcagccgcaggagcaacagtcacaacagcagcagcagcagcagtagccatgggaggagacaagcatttggttaatggtttggtaaatccccacctcattatttttatacgcccaagacatgaggagacgggttaaacaacgcaacggaagtgaggactactctctctgcgatctttatcctctctctctctctctctctctcttcatttggccttaaccttcattctttgtagtcacttatcctcctccataatttggttcttgattctagccttgtccaatttg

SEQ ID NO: 2070 - protein, 255 aa, Oryza sativa
  G3685,ZF-HB domain coordinates 43-95,172-235
MEFRGHDEPVDEMGVAYGRTPPSSSSSPAASASAGNGAGAAEVRYHECLRNHAAAMGGHVVDGCREFMPMPGDAADALKCAACGCHRSFHRKDDGQQQQQLRLLIPSPPTPRVPLLMPPPQPQPHPHPQHPYLHPPFPYHHTPSGSGGTTTESSSEERGPPSSSAAAAQGRRKRFRTKFTPEQKEQMLAFAERVGWRMQKQDEALVEQFCAQVGVRRQVFKVWMHNNKSSIGSSSGGGSRRQPQEQQSQQQQQQQ

SEQ ID NO: 2071 - DNA, 743 bp, Oryza sativa
  G3686,family:ZF-HB
gtacgtggctggcatggagctcagcgagcacgaggaggacgccggcgacgtgggcggtggctgctcatccccgcccacgccgcctcaccgcgtgctgacgtcggccgcccccgagacgatcaggtgccggtaccacgagtgcctccggaaccacgcggcggcctcgggcggccacgtcgtggatggctgcggcgagttcatgccggcgtccaccgaggagccgctcgcctgcgcggcctgcggctgccaccgcagcttccaccgccgggacccttccccgggccgcgcgggcgcagcacggctgccgcagctgcacctgccggcgtccatcaactcgcgcgcaccacccgcgctgctgctgccgcctgcagcggccgccagcaagcaaggtttgccgttccctggctacggcacgcccagcggcggcactggcaccacgaccgcgtcctccagcgacgagcggctgcggccctcgccggtgcagccacggaggcggtcacgcacgacgttcacgcgggagcagaaggagcagatgctggcgttcgcggagcgcgtggggtggaggatccagcggcaggaggaggcgacggtggagcacttctgcgcgcaggtcggcgtccggaggcaagcgctcaaggtgtggatgcacaacaacaagcatagcttcaagcagaaacagcagcaggagaacaggcaggaacagcagcagtaggcaggatgccatgtatgggaggagacaaagg

SEQ ID NO: 2072 - protein, 232 aa, Oryza sativa
  G3686,ZF-HB domain coordinates 38-88,159-222
MELSEHEEDAGDVGGGCSSPPTPPHRVLTSAAPETIRCRYHECLRNHAAASGGHVVDGCGEFMPASTEEPLACAACGCHRSFHRRDPSPGRAGAARLPQLHLPASINSRAPPALLLPPAAAASKQGLPFPGYGTPSGGTGTTTASSSDERLRPSPVQPRRRSRTTFTREQKEQMLAFAERVGWRIQRQEEATVEHFCAQVGVRRQALKVWMHNNKHSFKQKQQQENRQEQQQ

SEQ ID NO: 2073 - DNA, 1284 bp, Oryza sativa
  G3690,family:ZF-HB
atggagtacaagagatcatcgcatgtggaggaggaggaagaggaggaagaagaggaggacgacgaggaggaagacgaggaggagcaaggtcaccatcagtacacgacggcggcggcgcagcagcagctgcacccgcaggttcttggctcgtcggcttcctcgccgtcgtcgttgatggactccgccgctttctcgaggcccctcctgcctcccaacctgtcgctcgtgtcgccgtcggcggcggcggcggcggcgcccggtggatcctacctgcatgcggctcaccaccatgggcagggaagaagggtggaggcgcctggtggggagagccagcaccatctccagcgccatcatgagccggcgagaaatggcgttcttggcggcgtcgccggtgctcacgcggcgtctacgcttgccctcgtgggtggtggtggtggtggtccgagaggcggcgagggggcggcgggcgaggcgccgacgtggaggtacagggagtgcctcaagaaccacgcggcgcggatgggcgcgcacgtgctcgacggctgcggcgagttcatgtcgtcccctggcgacggcgccgcggcgctggcctgcgccgcgtgcggctgccaccgtagcttccaccgccgcgagccggcggtcgtcgcgccggcctcgctctcgctctgccccgcctccgcctccgcctccgccgccgccggcctggtgtccctatccccctccgcgacgcccaccggcgccaactcctcccggctcatgccgctcctcctcgccccgccgcacatgcagaagcgcccgcccgtcctccccgtgtccccggcgtctgcgcccgccgcgctggccgagtcgtcaagcgaggagctgcgcccgccgccgctcccctcttcccacccccacgcgcacgcggccgccgtggtggcggcgtcggcctccgcgccgccggggccgagcaagaagcgcttccggaccaagttcacggcggagcagaaggagcggatgcgtgaattcgcgcaccgcgtcgggtggcgcatccacaagcccgacgccgccgccgtcgacgcgttctgcgcccaggtcggcgtctcccgccgcgtcctcaaggtgtggatgcacaacaacaaacacctcgccaagacgcccccgtcgccgacatcgcagccgccgccgccgccgctccaccacgatccttctcctcctccccctcctcaccaccaccaccaccaccatcaccaccaccacccaccacaacaccatcagcagcagcagcagcagcatgatgcatga

SEQ ID NO: 2074 - protein, 427 aa, Oryza sativa
  G3690,ZF-HB domain coordinates 161-213,318-381
MEYKRSSHVEEEEEEEEEEDDEEEDEEEQGHHQYTTAAAQQQLHPQVLGSSASSPSSLMDSAAFSRPLLPPNLSLVSPSAAAAAAPGGSYLHAAHHHGQGRRVEAPGGESQHHLQRHHEPARNGVLGGVAGAHAASTLALVGGGGGGPRGGEGAAGEAPTWRYRECLKNHAARMGAHVLDGCGEFMSSPGDGAAALACAACGCHRSFHRREPAVVAPASLSLCPASASASAAAGLVSLSPSATPTGANSSRLMPLLLAPPHMQKRPPVLPVSPASAPAALAESSSEELRPPPLPSSHPHAHAAAVVAASASAPPGPSKKRFRTKFTAEQKERMREFAHRVGWRIHKPDAAAVDAFCAQVGVSRRVLKVWMHNNKHLAKTPPSPTSQPPPPPLHHDPSPPPPPHHHHHHHHHHHPPQHHQQQQQQHDA

SEQ ID NO: 2075 - DNA, 798 bp, Glycine max
  G3717,family:AP2
ggagaccaccggagatatgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctgagagagattctaaaattggtattgtgt

SEQ ID NO: 2076 - protein, 251 aa, Glycine max
  G3717,AP2 domain coordinates 130-194
MYGRSDSYESDLALLDSIRRHLLGESELIFGAPNFGSGRSSSFSSLDSCLSDDWGELPFKEDDSEDMVLYGVLRDAVNVGWVPSLDAGSPESVSSGFPAVKLEPDVMPALINPCPPPAPAVEEKKVVPPKGKHYRGVRQRPWGKFAAEIRDPAKNGARVWLGTFETAEDAALAYDRAAYRMRGSRALLNFPLRVNSGEPDPVRVTSKRSSSPESMAAAAPKRKKVMVVGTVQEQVGSQVVECTRGEQLLVS

SEQ ID NO: 2077 - DNA, 1013 bp, Glycine max
  G3718,family:AP2
cacgaaatgtacggacaaagtagctatgagtccgatttggcccttttggactccattcgccgccacttactcggcgactccgaggaacacagattcggagccccgaatgttaattcgggtagcactccattgtactctcggagctccagtttcggcaggttgtacccttgcctgagtaacgattggggcgaacttcctcttatggaagacgattcagaagacatgcttctttatggtgttcttcgcgacgccgtgaacgtaggctgggtcccatctctcgacgcttcctcaccggagagtttctcgtcggctttcatgccgccggtgaccgtgaaatccgaaacggatctatttccggcaccggaaccgatttgtaaccctccggtggttcagggcccggcgccggcggtagttccggcgaaagggaagcactaccggggcgtgcggcagcgaccgtggggaaaattcgcagcggagatccgcgacccggctaaaaatggggctcgggtttggcttgggacttttgagacggctgaggacgccgcgctggcttacgatcgagccgcgtatcgaatgcgcggctcgcgggctttgttgaattttccgctccggattaattcgggcgagcccgaaccggttcgagttacggcgaagcgggcttcagcagaaccgtgttcttcgtcggagagtggatcttgggtgaagaagcggaagaaggtggtgggttgagaacggggcacgtggagagcagttgttggtgaagtaatttgtgatgctaaaaaggggtggaataaatgggttggcatgctcactcattgctcaagtgggactgtgggactgatcaaatctaaagctaaaaaagaaaacaaaccacatttggaaaaactgattagggtcgaggttctgtttggctttgtgaatacagttacaagatttcttattttttggttcaattctataataatatctgtaacatagttgggtagggcacccaccctgtgctgaactaagtt

SEQ ID NO: 2078 - protein, 240 aa, Glycine max
  G3718,AP2 domain coordinates 139-203
MYGQSSYESDLALLDSIRRHLLGDSEEHRFGAPNVNSGSTPLYSRSSSFGRLYPCLSNDWGELPLMEDDSEDMLLYGVLRDAVNVGWVPSLDASSPESFSSAFMPPVTVKSETDLFPAPEPICNPPVVQGPAPAVVPAKGKHYRGVRQRPWGKFAAEIRDPAKNGARVWLGTFETAEDAALAYDRAAYRMRGSRALLNFPLRINSGEPEPVRVTAKRASAEPCSSSESGSWVKKRKKVVG

SEQ ID NO: 2079 - DNA, 689 bp, Zea mays
  G3719,family:WRKY
ccaccatggccgatgactacttccagttcggattcgacggccaggagatggtgggcgctcccgctcccgcctgcggcggctacgactgctcggcgccggtgttcgccaacagttcttcagacgccgccgccgccgtcggcaatggcatgagcctgctgagctatggcgtcgacggcgacggcgacgggaggaggccgatgagcggaccaccatatggcaccggtgggaacggcggcggccggccgccgtcgtcgtcacggattgggttccggacgcggtcggaggtggacgtgctggacgatggcttcaagtggcgcaagtacggcaaaaagacggtcaagagcagccccaacccgaggaactactaccggtgctcggcggagggctgcggcgttaagaagcgcgtggagcgggacagcgacgacccgcgctacgtcgtcaccacctacgacggcgtccacaaccacgccgcgctgggcccgggcgccgcctcctacctgtgccaaccaccgcctccgcgcggcgcaaccgcaaccgcaaccgtaacgcccttctcgcctccacgctcggcctcggcgccggcgcccctggctgcagcgcccagctggagcgccgcctgtgacgcgtgggaggcgcagctgcacgccgcggcggcggctgctcattcctcggagtcgtcgtactgatcc

SEQ ID NO: 2080 - protein, 226 aa, Zea mays
  G3719,WRKY domain coordinates 98-154
MADDYFQFGFDGQEMVGAPAPACGGYDCSAPVFANSSSDAAAAVGNGMSLLSYGVDGDGDGRRPMSGPPYGTGGNGGGRPPSSSRIGFRTRSEVDVLDDGFKWRKYGKKTVKSSPNPRNYYRCSAEGCGVKKRVERDSDDPRYVVTTYDGVHNHAALGPGAASYLCQPPPPRGATATATVTPFSPPRSASAPAPLAAAPSWSAACDAWEAQLHAAAAAAHSSESSY

SEQ ID NO: 2081 - DNA, 666 bp, Zea mays
  G3720,family:WRKY
atggcggcagtcggagctcacccagtgctgtaccaccacccggcgccggcgggcgacgcctcctccatgtcctcctacttctcccacggaggcagctccaccacctccagctctgcgtccagcttcaccgccgcgctcgcgccgacgacgacggcgctcgccgagcatttcgacatctccgagttcctcttcgacgacgctgcgggcgctggggtcgccggcgcgccaggtgtgttcgccgatggcgcggcccgccccgtcgtcctgccggtgccggatgccgctggtggtggtgcaattatcggcgcagccgctgggggcgcggctgcggcgtcggaggtgccagagcggccgcggacgacgcggatcgcgttccggacgaggtcggagatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccaccgggctccctcaactga

SEQ ID NO: 2082 - protein, 221 aa, Zea mays
  G3720,WRKY domain coordinates 135-191
MAAVGAHPVLYHHPAPAGDASSMSSYFSHGGSSTTSSSASSFTAALAPTTTALAEHFDISEFLFDDAAGAGVAGAPGVFADGAARPVVLPVPDAAGGGAIIGAAAGGAAAASEVPERPRTTRIAFRTRSEIEILDDGYKWRKYGKKSVKNSPNPRNYYRCSTEGCNVKKRVERDKDDPSYVVTTYEGMHNHVSPSTVYYASQDAASGRFFVAGTQPPGSLN

SEQ ID NO: 2083 - DNA, 825 bp, Oryza sativa
  G3721,family:WRKY
agtggatcccccgggctggaggaaaattcaccggtgaaaaggttcagcactgtgcaatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctatttcggcaggcggcttcgctgctcttctgagggctgatgaagtttgtctaggactagacacgcccgggagctctagctaggatagaaaactagagaaagtttaattatacctgaattttaattaatcacctcacaaaactctgatgtatcatattatatcgtgatagtgactggttgttaatttaattttggcgatcgatgtgatcttcggt

SEQ ID NO: 2084 - protein, 197 aa, Oryza sativa
  G3721,WRKY domain coordinates 96-152
MAASVGLNPEAFFFSNSYSYSSSPFMASYTPEFSAAAIDANLFSGELDFDCSLPAPAQEYPENENTMMRYESEEKMRARVNGRIGFRTRSEVEILDDGFKWRKYGKKAVKNSPNPRNYYRCSTEGCNVKKRVERDREDHRYVITTYDGVHNHASPAAAAAALQYAAAAGDYYSPPLSSAGSPPAAYFGRRLRCSSEG

SEQ ID NO: 2085 - DNA, 680 bp, Zea mays
  G3722,family:WRKY
agttacttgcagctggccatgcacatggcgctatcgtcccgcagctcattcgccgccgacgtcctcctcccagccaccatgtcgtatcgtcagccgtgcagcggtgcttccagctacttgggctctcagcccgcggcccctttcccgtcggcagcgttcggcgcggtggcgcagctggacgtcttcgactgcctgtcgtcggacgaaggcgttggcgtcccggcagctgtacctggtgcgttcgcgccgccgccgccgcttatgccggccgagcgcgtcgtcccggacgctgctgcaggctacagtagtcatactaggagtgcagcggctgtggcgggtgaggggtcgaggactacgcacagaattgcgttccgagtgaggtcggacgaggacgaggtactcgacgacggctacaaatggaggaagtacggaaagaagtccgtcaagaacagccctaatccgaggaactactaccggtgctcgacggagggctgcaacgtcaagaaaagggtggagcgagacagggacgacccgagatacgttgtgaccatgtacgagggagtgcacaaccatgtgagtcctggtaccgtctattacgccacccacgacgccgcctccggccgcttcttcgtcgccgggatgcatcagccaggccattgatcaacgagcagatcagagag

SEQ ID NO: 2086 - protein, 213 aa, Zea mays
  G3722,WRKY domain coordinates 129-185
MHMALSSRSSFAADVLLPATMSYRQPCSGASSYLGSQPAAPFPSAAFGAVAQLDVFDCLSSDEGVGVPAAVPGAFAPPPPLMPAERVVPDAAAGYSSHTRSAAAVAGEGSRTTHRIAFRVRSDEDEVLDDGYKWRKYGKKSVKNSPNPRNYYRCSTEGCNVKKRVERDRDDPRYVVTMYEGVHNHVSPGTVYYATHDAASGRFFVAGMHQPGH

SEQ ID NO: 2087 - DNA, 625 bp, Glycine max
  G3723,family:WRKY
acatacctagctatcacctcaatggattactattttggaaaccttaatcctaacccttattaccatcactctgccgtagtgaacatggcatctccctcctccgagttcatgttatctgattatctcgtgttggaagatgctcttgttgttgatcatcatcaagagtcttggtcacaaagcactgaaactgaatcgtcggagaaagcaacctccagcgatgcaagtcatgggttcggtgatgcaacctccaacaccaacatgcatataaagtgccaaaatagtgggattaagggaaagaatgcagaagtgagtcaaaggataacgtttagaaccagatcgcaacttgaggttatggatgatggatataaatggaggaaatacgggaagaaaacagtgaagagcagtcccaacccacggaactactacaagtgttcaggtgaaggatgcgatgtgaagaaaagggtggaaagggatagggatgactccaactatgtgttaacaacgtacgacggtgtccacaatcatcagaccccgtctactgcctactacagccaaatgcccttgctgcattctaatcatgattgggccctccacccttctgcaaactcataatatcctccttaat

SEQ ID NO: 2088 - protein, 196 aa, Glycine max
  G3723,WRKY domain coordinates 112-168
MDYYFGNLNPNPYYHHSAVVNMASPSSEFMLSDYLVLEDALVVDHHQESWSQSTETESSEKATSSDASHGFGDATSNTNMHIKCQNSGIKGKNAEVSQRITFRTRSQLEVMDDGYKWRKYGKKTVKSSPNPRNYYKCSGEGCDVKKRVERDRDDSNYVLTTYDGVHNHQTPSTAYYSQMPLLHSNHDWALHPSANS

SEQ ID NO: 2089 - DNA, 662 bp, Glycine max
  G3724,family:WRKY
cgcaccatagtctttgttttcatttactaccatatttagttatcagcaatggacttctactttggaaactctcctccttatcccaataattatgctcataattctcttaatatggctctatcttcccctgagattgcactatccgattatctcatgctcgatgactatgttgatcatcaagattctcgatcatcacaaagcaccgagtcatctgaaaaagcaaccttcaatgatgccactcacggattcagtactggtgcaacctctaagaataataacataaactgcaaaaatgggattaatgaaaacaaaggtggagtgggtccaaggatcgcgtttagaaccaaatcagagcttgagatcatggatgatggatacaagtggaggaagtacggcaagaagtccgtgaagagcagtcccaatctaaggaactactacaaatgttcaagtggaggatgcagtgtgaagaaaagggtggaaagggatagagatgactacagctacgtgataacaacatatgaaggtgtgcacaatcatgagagcccatttaccacatactacagccccatctccttcgtacattctgatactactttcaaatgacaccaacttcaaacccttttgggcatttacacctccctagcttaattatgtgccaagaa

SEQ ID NO: 2090 - protein, 184 aa, Glycine max
  G3724,WRKY domain coordinates 107-163
MDFYFGNSPPYPNNYAHNSLNMALSSPEIALSDYLMLDDYVDHQDSRSSQSTESSEKATFNDATHGFSTGATSKNNNINCKNGINENKGGVGPRIAFRTKSELEIMDDGYKWRKYGKKSVKSSPNLRNYYKCSSGGCSVKKRVERDRDDYSYVITTYEGVHNHESPFTTYYSPISFVHSDTTFK

SEQ ID NO: 2091 - DNA, 831 bp, Oryza sativa
  G3725,family:WRKY
gccaacccacatgcacgtgtaccgatgtacatggcggcggcggctgcgggagcaagcacacccttcaatttttgccgccacggctcgcacgccgagtacgacgccgtcttcagcggcagctggatggcgcgccgcccctccgcggcgccgcacggtggcggcgcctccggctccggctccggcagcggctacggcgccgcctcgtacgttgctcccaccttcggcgcggcgtttaggcagcagcatctcgacctcctcgactacctgtccgacgatcagggcgttccggcgccaccaccagcggctgtgcccagcgcgtcgtacgtgacgccggcgccggcgatggcccccgctgaaccggtcgtgccggatgctgttgccgccgccggcggctatccgaggagcgtggctgcggcggcggcggccgtggccggcgagggaagagatcggacgacgacggacaagatcgcattccggacgaggtcggacgatgagatactcgacgacgggtataagtggaggaagtacgggaaaaagtccgttaagaacagccctaatccgaggaactactaccggtgctcgacggaggggtgcaacgtgaagaagagggtggagagagacaagaacgacccgcggtacgtggtgacgatgtacgaggggatccacaaccacgtgtgccccggcactgtctactacgccgcgcaggacgccgcctccggccgctttttcgtcgccgggatcagtcacccagaccttaattaagctaggatatgctttgccggcccagctgtggcttagcttgatgtgcagctctagttattgtatgggctg

SEQ ID NO: 2092 - protein, 243 aa, Oryza sativa
  G3725,WRKY domain coordinates 158-214
MAAAAAGASTPFNFCRHGSHAEYDAVFSGSWMARRPSAAPHGGGASGSGSGSGYGAASYVAPTFGAAFRQQHLDLLDYLSDDQGVPAPPPAAVPSASYVTPAPAMAPAEPVVPDAVAAAGGYPRSVAAAAAAVAGEGRDRTTTDKIAFRTRSDDEILDDGYKWRKYGKKSVKNSPNPRNYYRCSTEGCNVKKRVERDKNDPRYVVTMYEGIHNHVCPGTVYYAAQDAASGRFFVAGISHPDLN

SEQ ID NO: 2093 - DNA, 729 bp, Oryza sativa
  G3726,family:WRKY
taaatacggagctttcgcgccggcctcgtactcggccatggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaaccgcgcgcgtacggttaatttgatcg

SEQ ID NO: 2094 - protein, 221 aa, Oryza sativa
  G3726,WRKY domain coordinates 135-191
MAAVGAHAAVYHHPVSGLSAPAGDAAYSMSSYFSHGGSSTSSSASSFSAALAAATTPPLPDPSGSQFDISEFFFDDAPPAAVFNGAPTAALPDGAAANATRSAAEAVPAPAPAAVERPRTERIAFRTKSEIEILDDGYKWRKYGKKSVKNSPNPRNYYRCSTEGCNVKKRVERDKDDPSYVVTTYEGTHNHVSPSTVYYASQDAASGRFFVAGTQPPGSLN

SEQ ID NO: 2095 - DNA, 663 bp, Zea mays
  G3727,family:WRKY
caagcaaggcggctagcggtgcaagtagtgcgaagctagctaggtgctggtgcatgcaatggcggcttcgctgggtctgaaccctgaagctgtcttcacttcctacacctcctcgccgccgttcatgtcggactacgtggcggcgagcttcctgccgccggccgtcgtcgactccacggacttctctgcagagctcgatgatcttcaccaccacttggattactcatcgccggcgccgaccttggccggggctcggagcgatcgcagcgagaagcagatgatcaggtggtgtgagggtggtggtggcgagaagagactcggtaggatcgggttcagaacgagatcagaggtggagatcttggacgatggattcaaatggaggaagtatggcaagaaggctgtcaagagtagcccaaatccaaggaactactaccgctgctcgtcggagggctgcggcgtgaagaagcgggtggagagggaccgcgacgacccccgctacgtcatcaccacctacgacggcgtccacaaccacgcaagccccgcagccgccgccatcatccagtacggcggcggcggcggattctatagcccgccgcacagcggctcgccgtcggccgcctcctactcgggctccttcgtcctctgacttctccgggccttgac

SEQ ID NO: 2096 - protein, 195 aa, Zea mays
  G3727,WRKY domain coordinates 102-158
MAASLGLNPEAVFTSYTSSPPFMSDYVAASFLPPAVVDSTDFSAELDDLHHHLDYSSPAPTLAGARSDRSEKQMIRWCEGGGGEKRLGRIGFRTRSEVEILDDGFKWRKYGKKAVKSSPNPRNYYRCSSEGCGVKKRVERDRDDPRYVITTYDGVHNHASPAAAAIIQYGGGGGFYSPPHSGSPSAASYSGSFVL

SEQ ID NO: 2097 - DNA, 1663 bp, Zea mays
  G3728,family:WRKY
cattgggaccctcgaggccggccgggtctaattatatgataggtgtcaagtggaagtgcagtgatgtatgcagctgaggcatcctaacagaccccggccgacgggaaacaagaaagaaaaaatcgagaggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgccacctctgtacgattaatcgatgccttgagcttgtaacttgttcgcatccttgtaggtgcgatgcttgttgggtcataaactctgatgatatcgagatttggtgatcagaaataatgcgtggttttcgcgcccaaaattgggaaccccgaggccggccggggttattcaggcaggcgcattgactgatacacatatatacaacaagcaaggcggctagctacagcggctagtgcgcgcgtggtgcaggcgcatctagctactacctggtgcttgttgtgcatacaatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctgacttttccgggccttgacccatagttacctttacactccagtcgtcggataagaagaatgttcagcggctggctaaacagtctcaactgctgcagctattcaaattagtgttggagatgcaatttatagagataaaatactctagaagctatcgctgtagccggattaaattctgacctacttgtatagttttacacttacacagtgcaagtaataatatttaagggaagcagagagcactctaggcggccgctcaaaaaaaaaaaaaaaaaaaaaaaaaaaaaaaaaaaaag

SEQ ID NO: 2098 - protein, 205 aa, Zea mays
  G3728,WRKY domain coordinates 108-164
MATSLGLNPEDLFTSYSSSYYSSPPFMSDYAASFTPAAGDSTAFSSELDDLHHFDYSPAPIVTAAGAGAGGGDRNEKMMWCEGGGDERRLRSNGRIGFRTRSEVEILDDGFKWRKYGKKAVKNSPNPRNYYRCSSEGCGVKKRVERDRDDPRYVITTYDGVHNHASPGAAAIIVPYGSGGGNSGFYSPPHSGSPSATSYSGSLAF

SEQ ID NO: 2099 - DNA, 1091 bp, Oryza sativa
  G3729,family:WRKY
aaagcgctctgcgtgagctgagctgagctaggcgtcgcgcgcgatgtcgtcgctgtacccgtctctcctctcgctgagcgagagccccgccgagtaccggcaggtcggcggtggccgctacgcgggggaggacgtcgtcgacgacgacgacgacatggctgccgtcgccgacgctgtgtccagctacctctccttcgacatggacgacgtcgagtattacacgccggaggtgggcttccactcaaagcagcacaacccgccgccagttgctgcggcgccactggaagccggaggaggcagggagcaaagccggcgggaagccgccgtcaatcttggcaagatggacaggggaccggcgccggtgagcggcggcgcggcgactggcggcgtgccgaggagcaagaacggcagcaagatcgcgttcaagacgaggtcggaggtggacgtgctggacgacggctaccggtggaggaagtacggcaagaagatggtcaagaacagccccaacccaaggaactactaccggtgctcgagcgaggggtgccgcgtgaagaagcgggtggagcgcgcccgggacgacgcgcgcttcgtcgtcaccacctacgacggcgtccacaaccacccggcgccgctgcacctcaggccgcagctgccgccgcccggcggctactcgatcgccggggcaccggccgtggtggcgccgcacggccgcctcgggctggaggaggccgaggtgatcgctctcttcaggggcaccaccgccacctcgctgctgcttccttgaccggccagtccgacgcggcggcgccggcggcgacaactgactagctagtgtgagtcctgggccgtacaggaatggacaattagtttgtctccgatcgaggaccaaggcgacctgaatcaaaattacggcccatcgatatatagtaggtcgtttaattcatcgaaattagacgaatttcatgtacaattattgcattacagtattatttgaaacagtattgtatatatttgctatacaatttgatggatcgtatgtctttagcagttgtaagtatattaatctatagatctagtagttcagccatgat

SEQ ID NO: 2100 - protein, 246 aa, Oryza sativa
  G3729,WRKY domain coordinates 137-193
MSSLYPSLLSLSESPAEYRQVGGGRYAGEDVVDDDDDMAAVADAVSSYLSFDMDDVEYYTPEVGFHSKQHNPPPVAAAPLEAGGGREQSRREAAVNLGKMDRGPAPVSGGAATGGVPRSKNGSKIAFKTRSEVDVLDDGYRWRKYGKKMVKNSPNPRNYYRCSSEGCRVKKRVERARDDARFVVTTYDGVHNHPAPLHLRPQLPPPGGYSIAGAPAVVAPHGRLGLEEAEVIALFRGTTATSLLLP

SEQ ID NO: 2101 - DNA, 731 bp, Oryza sativa
  G3730,family:WRKY
aaacactcaatcagcagcagcagcagctagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttactt

SEQ ID NO: 2102 - protein, 219 aa, Oryza sativa
  G3730,WRKY domain coordinates 107-163
MAASLGLCHETSYAYSYPASNTSSSLCFPPLMADHIVDGGGGGGCSFGEFLELGHSVYSLPLPPPPSQPVVVAGGNNDQYGVSSSSSAAATTSRIGFRTRSEVEVLDDGFKWRKYGKKAVKSSPNPRNYYRCSAAGCGVKKRVERDGDDPRYVVTTYDGVHNHATPGCVGGGGHLPYPTSAAPPWSVPAAAASPPPAHAQAWGAPLHAAAAAHSSESSF

SEQ ID NO: 2103 - DNA, 882 bp, Oryza sativa
  G3737,family:AP2
acacatgcatcgatcattcatggatgccgaattgccgcgatccgggcattatttcgcgccaggagacccaagatcatcgtgtcgcccacgctataaatagctagctagcttgcctttatgttgcatatgccaactgctacatgcaggacgtctgaaactatcattagtgacctgcagcgcctgcagtatatatatacaagtagtagtgagcatggaggacgacaagaaggaggcggcgagcaagtaccgcggcgtacggaggcggccgtggggcaaattcgcggcggagatccgcgacccggagcgcggcggctcacgcgtctggcttggcacgttcgacaccgccgaggaggccgcgcgagcgtacgaccgcgccgcattcgccatgaagggcgctatggccgtgctcaacttcccaggcaggacgagcagcaccggctcttcgtcgtcatcgtcatccacgccgccagctccggtgacgacgagccgccactgcgccgacacgacggagaaggtggagcttgtgtaccttgacgacaaggtgctcgacgagctccttgcggaggactacagctaccgcaacaacaacaactactgatccggccgtcgatgaactgagacggatcgacatggggccggtcgtcggtacgctcgctgaaacgagacccggattgctatcaataagcaagcagaagaaaaccgtctcctatatatagcttcttctgttggcacaagcatatatgggcatgcatgacacatgctactgtgaattgacgggtgtgtgctgtgtgcagactactaaaccacgcttgcaagttgcacgtacgacgtggttgtcaagagcatgcagtccacgaagcagagaaaaacacctggtttatc

SEQ ID NO: 2104 - protein, 128 aa, Oryza sativa
  G3737,AP2 domain coordinates 8-72
MEDDKKEAASKYRGVRRRPWGKFAAEIRDPERGGSRVWLGTFDTAEEAARAYDRAAFAMKGAMAVLNFPGRTSSTGSSSSSSSTPPAPVTTSRHCADTTEKVELVYLDDKVLDELLAEDYSYRNNNNY

SEQ ID NO: 2105 - DNA, 899 bp, Zea mays
  G3739,family:AP2
cgatataattcactcctctcaacgctcgctgcacacacacaccagtgaacctagccagccatttgccgcatcgatcatcagtcgctgtcacgcgcgccaaaccaaaccaaagcccaaacccagctgcaagtgctactgacagcagctagcaaacacacacccgtcgccatcgctatggacggcgactggtccaaggacggcggaggtggagagccgaccaaatatcgcggcgtgcggcggcggccctggggcaagtacgcggccgagatccgcgactcgagccgccacggcgtccgcatctggctgggcaccttcgacaccgccgaggaggccgccagggcgtacgaccggagcgcctactccatgcgcggcgccaacgccgtcctcaacttcccggaggacgcgcacgcctacgccgccgcctgccgcggctccggatcctcctcatcctcgtccaggcataggcagcagcagcagcagggctccggcagggacgtgatcgagctcgagtacctcgacgacgaggtgctgcaggagatgctcaggaaccacgagccgtcgtcgtctgcgaggaagaagatgtaatgcaagacgactggtacacgtggcgaatgcacgttgcacatcagaatgccatgtatgcgtggggggttacgttcaattgtatgcatgcagtgcagtgactaccggccggctctcctggatatgtcggccatctctctctatatattattaaaatgtcagctcccttctctaatttggcgggagttacatcagtggtactatgcagagttgcatacttgcatatatatgcacattattaattaataactcgatctctcgtggacggtggaacagtgataatcatctcattgtcaattaattttgatcaaagaaat

SEQ ID NO: 2106 - protein, 136 aa, Zea mays
  G3739,AP2 domain coordinates 13-77
MDGDWSKDGGGGEPTKYRGVRRRPWGKYAAEIRDSSRHGVRIWLGTFDTAEEAARAYDRSAYSMRGANAVLNFPEDAHAYAAACRGSGSSSSSSRHRQQQQQGSGRDVIELEYLDDEVLQEMLRNHEPSSSARKKM

SEQ ID NO: 2107 - DNA, 837 bp, Oryza sativa
  G3742,family:HLH/MYC
atggcttccgccatggcgggactctaccgcaccgtcagctccggcggcacggagtccaccgccgccgccgccggcaacagcctcctccggcagagcagctcccccgccggcttcctcaaccatcttaccatggacaacggatacgggaatatgctaagagcgggcatgggcggcggcggcggtggcggcgacccgcggctcaaggggcagctcagcttctcgtcgcggcaggggtcggtgatgtcccagatctcggagatgggcagcgaggacgaggagctcgccggcggcggcggcagcccggaggctggcagcaacggcggtggcgccgcacgcggcggctacggcggcgggtacgcgatggggtcctccgcctgggaggagccctcgccgccggcgacgtcgctcctcccggacagcagcctcccgtccaagcgcccccgcgacgacctgccgcggcagctcagcctcccggcggcgtccaagaacagcagcaagcccccctcctccgcctccgccgccgcgtcgccggagatggccgccatcgagaagttcctccagttccaggacgccgtcccctgcaagatccgcgccaagcgcggctgcgccacccacccccgcagcatcgccgagcgggtgaggaggacgcggatcagcgagcggatacggaagctgcaggagctcgtccccaacatggaaaagcaaaccaacactgctgacatgttggatcttgccgtggactacatcaaggagctccagaagcaggtcaaggtgttaaacgacagccgttccagctgcacctgctcggcgagcaagcagaagcacttcgccggctaa

SEQ ID NO: 2108 - protein, 278 aa, Oryza sativa
  G3742,HLH/MYC domain coordinates 199-257
MASAMAGLYRTVSSGGTESTAAAAGNSLLRQSSSPAGFLNHLTMDNGYGNMLRAGMGGGGGGGDPRLKGQLSFSSRQGSVMSQISEMGSEDEELAGGGGSPEAGSNGGGAARGGYGGGYAMGSSAWEEPSPPATSLLPDSSLPSKRPRDDLPRQLSLPAASKNSSKPPSSASAAASPEMAAIEKFLQFQDAVPCKIRAKRGCATHPRSIAERVRRTRISERIRKLQELVPNMEKQTNTADMLDLAVDYIKELQKQVKVLNDSRSSCTCSASKQKHFAG

SEQ ID NO: 2109 - DNA, 450 bp, Oryza sativa
  G3744,family:HLH/MYC
atgagctccgggtgggaggagtcgtcgctcatgtcggacacgaacatctccggcgtgaagcgccagcgcgactcgtcggagccgtcccagaacggcggcggcggcggcggcctggcgcaccagttcagcctgccgaagacctcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaagcaaaccaacactgctgacatgctggatttggctgttgactacatcaaggatcttcagaagcaggtcaagggattaaacgacagccgagctaactgcacctgctcagcgaagcatcagcagtactctggctag

SEQ ID NO: 2110 - protein, 149 aa, Oryza sativa
  G3744,HLH/MYC domain coordinates 71-129
MSSGWEESSLMSDTNISGVKRQRDSSEPSQNGGGGGGLAHQFSLPKTSSEMAAIEKFLQFQDAVPCKIRAKRGCATHPRSIAERVRRTRISERIRKLQELVPNMDKQTNTADMLDLAVDYIKDLQKQVKGLNDSRANCTCSAKHQQYSG

SEQ ID NO: 2111 - DNA, 1164 bp, Oryza sativa
  G3746,family:HLH/MYC
atgaacaggatgacggcgccgcacggggggatgccgccgccgccgatgccggcggcgggggggctggcgaggtacggctcggcgccggggtcgctgctggcgtcgatcgccgactcggtgatccggggccgcggggttggggttgtcgatcagctgcatcatcatcagcatcagcatcagcttccgccgccgccgccgccgcagcagcagcagatggtggggaggtacttctccgcggagtcgtcggggctcacctcctgcgagtccagctgccggacgacgacgacgacgtccacagcggcggcggccgatgtcgggcggcacccgctcgagcgcgcgtacggcggctccggcgagatccacgtcgacgcctcctccgccgccgtcccgctcttccgccacagcagctcccccgccggcctcctctcccgcctcatggctgacccgcacggcaatggcatggccgcgacgagagggatgggcggctactccggcggcggcggcgacgccggcgcgatggcgcacaggaggctgagctcgcagtggagcttctcgcggcaggacctgccgcagatatcggagatgggcggcctcatccccgacatcggggagagcatcgtcaccggcggcggcggcaacagctccagcgatggcgccggccacggcgcgcagtcctcctccttcctctcctccaggaacttctccatgagctcctgggacgacaccaactccatcatgttctcgcccccgagcagcagcaagaaggcccgcgtcgccgccgccgccgccggcgaccacggcgacgacatggtctccagcttcagcaacatcgactcccagtttggcttgtcgaagcagtcgtcgctggagatggccggcatggatgacttcttgcagctccagccagactccgtcgcctgcagggcccgggcaaagcgcggctgcgcgacgcacccgcggagcatcgctgagagggagaggagaacgaggattagcaagaggctgaagaagctgcaggatctcgtgccgaacatggacaagcaaacgaatacatcagacatgttggatattgctgtaacctacatcaaggagcttcagggccaagttgagaagctaaaacatgaccaagcaaactgcacttgctcaggcaagcacgattgctga

SEQ ID NO: 2112 - protein, 387 aa, Oryza sativa
  G3746,HLH/MYC domain coordinates 312-370
MNRMTAPHGGMPPPPMPAAGGLARYGSAPGSLLASIADSVIRGRGVGVVDQLHHHQHQHQLPPPPPPQQQQMVGRYFSAESSGLTSCESSCRTTTTTSTAAAADVGRHPLERAYGGSGEIHVDASSAAVPLFRHSSSPAGLLSRLMADPHGNGMAATRGMGGYSGGGGDAGAMAHRRLSSQWSFSRQDLPQISEMGGLIPDIGESIVTGGGGNSSSDGAGHGAQSSSFLSSRNFSMSSWDDTNSIMFSPPSSSKKARVAAAAAGDHGDDMVSSFSNIDSQFGLSKQSSLEMAGMDDFLQLQPDSVACRARAKRGCATHPRSIAERERRTRISKRLKKLQDLVPNMDKQTNTSDMLDIAVTYIKELQGQVEKLKHDQANCTCSGKHDC

SEQ ID NO: 2113 - DNA, 885 bp, Oryza sativa
  G3750,family:HLH/MYC
atggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggatcgggagaccgtgcagctcaccggactcttcccgccggtgttcggcggcggcggcgtgcagccgccgaacctccgccccaccccgcctacccaggtgttccacccgcagcagtcgaagcagggcggagcagccgtcgggccgcagccgccggcgccgaggccgaaggtgcgagcgcggcgtgggcaggcgaccgacccccacagcatcgcggagaggctaagaagagagagaatagcagaaaggatgagggccctacaggaattggtccccaatacaaacaagacagatagggcagctatgctagatgagatccttgattatgtgaaattcctgaggctgcaagtaaaggttttaagcattagcaggctgggtggcgcgggtgctgttgcacagctggttgctgatattccactttcagttaagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctag

SEQ ID NO: 2114 - protein, 294 aa, Oryza sativa
  G3750,HLH/MYC domain coordinates 136-193
MAGQQPQQQGPPEDDFFDQFFSLTSSFPGAAPGGRAAGDQPFSLALSLDAAAAAEASGSGKRLGVGDDAEGGGSKADRETVQLTGLFPPVFGGGGVQPPNLRPTPPTQVFHPQQSKQGGAAVGPQPPAPRPKVRARRGQATDPHSIAERLRRERIAERMRALQELVPNTNKTDRAAMLDEILDYVKFLRLQVKVLSISRLGGAGAVAQLVADIPLSVKGEASDSGGNQQIWEKWSTDGTERQVAKLMEEDIGAAMQFLQSKALCMMPISLAMAIYDTQQTQDGQPVKHEPNTPS

SEQ ID NO: 2115 - DNA, 531 bp, Zea mays
  G3755,family:HLH/MYC
atgtcccagatctcagagatggacagcgaggaggtcggagggagcagcccagaggctgccggcggcggcagggggtacatccctgggtacccaatgggctctgggtgggaggactcgtcggctctcttgtcagacaatttgtctggcatcaaacgcccccgggactcgtcggagcctggccagagcggccttacgcaccagttcagcgtgcccaagacgtcgtccgagatggcaactattgagaaattcctccagttccaggacgccgtgccttgtaagatccgtgccaagcgggggtgcgccactcatccacgcagcatcgctgagagggtgaggagaacaaagatcagtgagcgaatccgaaagctgcaagaactcgttccaaatatggacaagcaaaccaacacatctgacatgctggatttggctgtcgactacatcaaggatctccagaagcaggttaaggtgctaaaggagagccaagataattgcacctgctcagcaagcaagaaccagcagcactcctgctga

SEQ ID NO: 2116 - protein, 176 aa, Zea mays
  G3755,HLH/MYC domain coordinates 97-155
MSQISEMDSEEVGGSSPEAAGGGRGYIPGYPMGSGWEDSSALLSDNLSGIKRPRDSSEPGQSGLTHQFSVPKTSSEMATIEKFLQFQDAVPCKIRAKRGCATHPRSIAERVRRTKISERIRKLQELVPNMDKQTNTSDMLDLAVDYIKDLQKQVKVLKESQDNCTCSASKNQQHSC

SEQ ID NO: 2117 - DNA, 1011 bp, Zea mays
  G3760,family:HLH/MYC
atgcagcccactacgcgggaaatgcaggccatggccgccgccggccagcagatctccctcgacgacctccgcgcggcagcaggcggcgtgcacgacgacttcctggaccagatgctcggaggcctgccgccgtcggcatggccggagctgtcgtccgcggcgggagggaaggcgccggatggcggcgcgcaggcggagcagatgcagcaccagccgcagcacttgggtgggggtgggggcctgtacgacgactccgccttgctggcgtcgcggctccggcagcaccaaatcagcggcggcggcggcggggaggccgtgaagcagatggtgctgcagcagctggccgatctgaggcaggaacaccatgtgttgctgcagggcatgggccgctcgacctcgacgggcggcagcagagacggcggcctgctcctcccgctctctctcggcagtggcggatcgggcggcgacgtgcaggcgctactcaaagctgtagccgactccgccggaggagaagccgcaggcgtcttcggcggttccttcgccggatcgctccaccaccaccagcagcagcagcagcattttcaatcacatccgcagcagcaaacggcgccgttgccggggcagggcttcggtggaggcgcgggcgcgtccggcggcgtgtcgcagccgcaggccggcgctgcgtgcggaggcgccgccgcgccgcccaggcagcgggtacgggctcggcgcggccaggccaccgacccccacagcatcgcggagcggctccggagagagaggatcgcggagaggatgaaggcgcttcaggagctggtgcccaacgccaacaagacggacaaggcgtcgatgctggacgagatcgtcgactacgtcaagttccttcagctccaagtcaaggtgctgagcatgagccggctaggtggtgccgccttccttttgtggaccgtgcgtgtgtgtgttgtgctcggggggtcgaggcggcgtggcggtcgcggccgggagcgatga

SEQ ID NO: 2118 - protein, 336 aa, Zea mays
  G3760,HLH/MYC domain coordinates 243-300
MQPTTREMQAMAAAGQQISLDDLRAAAGGVHDDFLDQMLGGLPPSAWPELSSAAGGKAPDGGAQAEQMQHQPQHLGGGGGLYDDSALLASRLRQHQISGGGGGEAVKQMVLQQLADLRQEHHVLLQGMGRSTSTGGSRDGGLLLPLSLGSGGSGGDVQALLKAVADSAGGEAAGVFGGSFAGSLHHHQQQQQHFQSHPQQQTAPLPGQGFGGGAGASGGVSQPQAGAACGGAAAPPRQRVRARRGQATDPHSIAERLRRERIAERMKALQELVPNANKTDKASMLDEIVDYVKFLQLQVKVLSMSRLGGAAFLLWTVRVCVVLGGSRRRGGRGRER

SEQ ID NO: 2119 - DNA, 687 bp, Glycine max
  G3765,family:HLH/MYC
atgaaaggtgttggaaactatagtggggtcaatggcaatgatggtgaacttagtctatctatgaacagaatgaagaatcacattagcttctcatcaataagtccttcttcttccttgggaatgctatcaccaacctccaaaatgggcacggagggtattagggtaactagacctgaggatgggagacagggaagttgcaatggtgatgctcgatattatggtcctggattcccttatgcttcttggaatgagccctcacaccccaaaagacagcgaagtagtaatgatgagttactttttgattctcagaatggagagccaggaaatcaagttcaaaggctttcgcatcatttgagtttgccaagaacgtcgtcggagatgtttgctatggataatttgcttcagttctcagattctgttccttgtaaaatcagagcaaagagaggctttgctactcatcctcgaagcattgccgaaagggtgagaagaacaaggatcagtgaacgaataagaaaattgcaagagcttgttccaaccatggacaagcaaactagcacagcagagatgttggacttggctttagactacataaaagatcttcagaaacaattcaagactctgagcgataaacgggctaaatgcaaatgtataaacatgcagaagtcagaagcagatcgagttgcttga

SEQ ID NO: 2120 - protein, 228 aa, Glycine max
  G3765,HLH/MYC domain coordinates 147-205
MKGVGNYSGVNGNDGELSLSMNRMKNHISFSSISPSSSLGMLSPTSKMGTEGIRVTRPEDGRQGSCNGDARYYGPGFPYASWNEPSHPKRQRSSNDELLFDSQNGEPGNQVQRLSHHLSLPRTSSEMFAMDNLLQFSDSVPCKIRAKRGFATHPRSIAERVRRTRISERIRKLQELVPTMDKQTSTAEMLDLALDYIKDLQKQFKTLSDKRAKCKCINMQKSEADRVA

SEQ ID NO: 2121 - DNA, 351 bp, Glycine max
  G3766,family:HLH/MYC
atgttatcacatcacttgagtttaccaaaaacttcagcagagatgattactatggagaagttgcttcagttccctgattctgttccttgtaaaatcagagcaaagcgaggctgtgctactcatcctcgaagcattgctgaaagggtgagaagaactcggatcagtgaaagaatgaggaaattacaagagcttgtcccacacatggataagcaaaccaacacagcagacatgttggacttggctgttgaatacattaaagatcttcagaaacaattcaagactctaagtgaaaaaagggcaaactgcaagtgtataagcatgccaaaggcagatacaaatcaaattgcttga

SEQ ID NO: 2122 - protein, 116 aa, Glycine max
  G3766,HLH/MYC domain coordinates 35-93
MLSHHLSLPKTSAEMITMEKLLQFPDSVPCKIRAKRGCATHPRSIAERVRRTRISERMRKLQELVPHMDKQTNTADMLDLAVEYIKDLQKQFKTLSEKRANCKCISMPKADTNQIA

SEQ ID NO: 2123 - DNA, 666 bp, Glycine max
  misc_feature (234)..(234): n is a, c, g, or t
  G3767,family:HLH/MYC
atggggactttgggggctgttaataacagtatcgaagatgcaaaattttctagttcgagaaggttgaagaatcaaccgaactattcttcgtcggggagaatgtcgtccaatgctgaaattggggacaaagggaatcgagaaagtagtccagacaatgaagcttttgctgatggtaacgattttatcaccggtttccaagttggtcattgggatgatgctgcaatcatgtctganaacgttggtggtctcaaaagatttagagaaaacgattcaaaaccattttctggcttaaatgcggctgagactcagaatgaaacaggacagactcatgctcctttggcccatcagttgagtttgccaaatacttcagctgaaatagctgccattgagaagtttctgcagttttcagattctgttccgtgcaaaatccgtgccaaacggggctgtgccactcacccaagaagcattgcagagagggttagaagaactaaaattagtgagcgtatgaggaaacttcaagatcttgtcccaaacatggacaagcaaactaacacagctgatatgttggacttggctgtggattacatcaaagaccttcaaaagcaagttcagacgctttcagattgtcatgcaaagtgtacgtgttcacacgagaagcaacaataa

SEQ ID NO: 2124 - protein, 221 aa, Glycine max
  misc_feature (78)..(78): Xaa can be any naturally occurring amino acid
  G3767,HLH/MYC domain coordinates 146-204
MGTLGAVNNSIEDAKFSSSRRLKNQPNYSSSGRMSSNAEIGDKGNRESSPDNEAFADGNDFITGFQVGHWDDAAIMSXNVGGLKRFRENDSKPFSGLNAAETQNETGQTHAPLAHQLSLPNTSAEIAAIEKFLQFSDSVPCKIRAKRGCATHPRSIAERVRRTKISERMRKLQDLVPNMDKQTNTADMLDLAVDYIKDLQKQVQTLSDCHAKCTCSHEKQQ

SEQ ID NO: 2125 - DNA, 798 bp, Glycine max
  G3768,family:HLH/MYC
atggagcaaggatcgttttcaatgggactcaggcatagtggaaataattctaaccttaccaggcatagtagctctcccgcaggactattttcccaaattaacattgaaaatgtgtatgctggtgtgagaggcatggggagtttgggagctgttaacaacagtatcgaagatgcgaaattttctagttcgaggaggttgaagaatcaaccgaactattcttcgtcggggagaatgtcgtccattgctgaaattggggacaaagggtatagagaaagtagtccagacagtgaagcttttgctgatggtaacgattttatggccggttaccaagttggtcattgggatgatactgcaatgatgtctgacaacgttggtggtctcaaaagatttagtgaagaagattcaaaaccattttctggcttaaatgcggttgagactcagaatgaaacgggacagactcatgctcctttggcccatcagttgagtttgccaaatacttcagctgaaatggctgccattgagaagtttctgcagttttcagattctgttccgtgcaaaatccgtgccaaacggggctgtgccactcacccaagaagcattgcagagagggtaagaagaactaaaattagtgagcgtatgaggaaacttcaggatcttgtcccaaacatggacaagcaaactaacacagctgatatgttggacttggctgtggattacatcaaagaccttcaaaagcaagttcagacactttcagattgtcatgcaaagtgtacgtgttcacacgagaagcaacaataa

SEQ ID NO: 2126 - protein, 265 aa, Glycine max
  G3768,HLH/MYC domain coordinates 190-248
MEQGSFSMGLRHSGNNSNLTRHSSSPAGLFSQINIENVYAGVRGMGSLGAVNNSIEDAKFSSSRRLKNQPNYSSSGRMSSIAEIGDKGYRESSPDSEAFADGNDFMAGYQVGHWDDTAMMSDNVGGLKRFSEEDSKPFSGLNAVETQNETGQTHAPLAHQLSLPNTSAEMAAIEKFLQFSDSVPCKIRAKRGCATHPRSIAERVRRTKISERMRKLQDLVPNMDKQTNTADMLDLAVDYIKDLQKQVQTLSDCHAKCTCSHEKQQ

SEQ ID NO: 2127 - DNA, 948 bp, Glycine max
  G3769,family:HLH/MYC
atgaataatgaaccacttgttctccaacaacaacagcagcagcagcaacaacaacaacaaagtaataatatgtataattatggctcttctggtactcagaatttttaccaaagcactggacgaccacctttgccaaaccagatgaagactggtcatggaagtagttctaatcttatcagacatggtagctcacctgctggattgttttcaaacattaacattgatattactggctatgctgctgttgtaaggggcatgggaactatgggagctgctgctaataacaccagcgaggaagcaaacttttcaccagcaacaaggatgaagaataatgcaccaaacttctcttcaggactaatgtcatcaagggctgaagttggaaacaagagcaatacacagaacaataatgcagaaaatgaagggtttgctgaaagccagggcaatgagtttatccctgcaggtttccccgttggtccgtggaatgattctgcaatcatgtctgacaacgtgacaggtctgaagagatttagagatgaagatgtgaaaccattttctggtggtttaaatgcacctgaaagtcagaatgaaactggaggccaacaaccttcttcttctgctttggctcatcaattgagtttgccaaatacttctgcagaaatggcagccattgagaagtttctgcagctctcagattctgttccttgcaaaattcgtgccaaacggggctgtgccactcacccaagaagcattgcagagagggttagaagaactaaaattagtgagcgaatgaggaagctacaagatctcgttcccaacatggataagcaaacaaacacagctgacatgttggacttggctgttgagtacattaaagaccttcaaaaccaagttcagactctttcggacaatcgggcaaagtgtacgtgttcacacaagaagcagcaataa

SEQ ID NO: 2128 - protein, 315 aa, Glycine max
  G3769,HLH/MYC domain coordinates 240-298
MNNEPLVLQQQQQQQQQQQQSNNMYNYGSSGTQNFYQSTGRPPLPNQMKTGHGSSSNLIRHGSSPAGLFSNINIDITGYAAVVRGMGTMGAAANNTSEEANFSPATRMKNNAPNFSSGLMSSRAEVGNKSNTQNNNAENEGFAESQGNEFIPAGFPVGPWNDSAIMSDNVTGLKRFRDEDVKPFSGGLNAPESQNETGGQQPSSSALAHQLSLPNTSAEMAAIEKFLQLSDSVPCKIRAKRGCATHPRSIAERVRRTKISERMRKLQDLVPNMDKQTNTADMLDLAVEYIKDLQNQVQTLSDNRAKCTCSHKKQQ

SEQ ID NO: 2129 - DNA, 474 bp, Glycine max
  G3771,family:HLH/MYC
atgcaacccacatccggcggcggcgggctggcaaggttccgttcagctccggcgagctggttagaatcagttctgttgaaggaagaggaagaagaagaagaccccttaagcttcactcaactgctttccactatcgatgatgctccctctcattctcaacaccaactctatggtgccgctctctcaaacaaggataaaacacctgaaatcttcatgttagaagattccgttccttgcagagtgagggctaagcgtggctgtgctactcatcccaggagtattgctgaaagggttcgcaggactcgtatcagtgaccgcatcagaaagctgcaagaacttgtgccaaacatggataagcaaacaaatactgcagatatgttagatgaggctgtagcgtatgtcaagtttctacaaaagcaaattgaggaactgtcagagcaccaacggaggtgtaaatgcgtggttcaagagtaa

SEQ ID NO: 2130 - protein, 157 aa, Glycine max
  G3771,HLH/MYC domain coordinates 84-142
MQPTSGGGGLARFRSAPASWLESVLLKEEEEEEDPLSFTQLLSTIDDAPSHSQHQLYGAALSNKDKTPEIFMLEDSVPCRVRAKRGCATHPRSIAERVRRTRISDRIRKLQELVPNMDKQTNTADMLDEAVAYVKFLQKQIEELSEHQRRCKCVVQE

SEQ ID NO: 2131 - DNA, 918 bp, Zea mays
  G3794,family:AP2
attacttgtgcacttgggtgcagtgcctgcagtataatcaagttagggtttaaaagaacctcgaccgcgatcgtatatagatccagattatcattagttattagaccactgtgatatcgatggacgacggcggcgagccaaccaagtaccgcggcgtgcggcgccggccgtcggggaagttcgccgccgagatccgcgactccagccggcagagcgtgcgcatgtggctgggcaccttcgacacggccgaggaggccgcaagggcgtacgaccgcgcggcctacgccatgcgcggccaaatcgccgtgctcaacttccccgccgaggcgcgcaactacgtgcgcggcgggtcgtcgtcgtcccgccagcagcagcagggaggaggaggaggaggaggaagtggcggcggcgccggtcagcaggtgatcgagctggagtgcctggacgatcaggtgctgcaggagatgctcaagggcggcgacgggaaaaaatagttgttagcgtatctgatcacaggtgcacgtgttgaaactgattatgaccaggcgatcgatcccatcttgtgcatgcggcctgccaaagttgctgggtcttctcatcgacctatatatatatgcttctcgatccatatatatatcataaatgcatgcagggtgcatgcatgtaccaagtttggaattataatgctcttggtgctgaattgaagtatactagtatatatagtgtgatccatgtattgaaaaggttgttttgcttaatcgcgtcatgattgcacacgtgcttgtttctgcttaaacaacccatatatatagccggctctggcctttgtcaagtctgcaatccttatacatcgttggtaattcatgcatgagttctatgtaactgcaatttagataaattgtagctaatataatagtc

SEQ ID NO: 2132 - protein, 124 aa, Zea mays
  G3794,AP2 domain coordinates 6-70
MDDGGEPTKYRGVRRRPSGKFAAEIRDSSRQSVRMWLGTFDTAEEAARAYDRAAYAMRGQIAVLNFPAEARNYVRGGSSSSRQQQQGGGGGGGSGGGAGQQVIELECLDDQVLQEMLKGGDGKK

SEQ ID NO: 2133 - DNA, 628 bp, Glycine max
  G3803,family:WRKY
acatatctagctattacctcaatggattactattttggaaaccctaatcctaaaccttatgataaccgtcactctgccgtagtgaacacggaatctccttcctccgagttcatgctatctgattatctcgtgttggaagatgctgtcgataatcaagagtcttggtcacaaagcactgaaactgaatcatcggagaaaggaaactccagcgatgtcagtcatgggtttggtgatgcaaccttcagcaacaccaacatgcatataaagtgcgaaaataatgggataaagcgaaagaaggaagaagtgagtcaaatgatcacgtttagaaccagatcgcagcttgaggttatggatgatggatataaatggaggaaatacggaaagaagacagtgaagaacaatcccaacccaaggaactactacaagtgttcaggtgaaggatgcaatgtgaagaaaagggtggaaagagacagggatgactcgaactatgttttaacaacgtacgacggtgtccacaatcatgagagcccgtcgactgcctactacagccaaattcccttggtgcattctaaccatgattggccccagctgcacccttctgcaaactcatgatcctcttcaatacagt

SEQ ID NO: 2134 - protein, 196 aa, Glycine max
  G3803,WRKY domain coordinates 111-167
MDYYFGNPNPKPYDNRHSAVVNTESPSSEFMLSDYLVLEDAVDNQESWSQSTETESSEKGNSSDVSHGFGDATFSNTNMHIKCENNGIKRKKEEVSQMITFRTRSQLEVMDDGYKWRKYGKKTVKNNPNPRNYYKCSGEGCNVKKRVERDRDDSNYVLTTYDGVHNHESPSTAYYSQIPLVHSNHDWPQLHPSANS

SEQ ID NO: 2135 - DNA, 823 bp, Zea mays
  misc_feature (9)..(9): n is a, c, g, or t
  misc_feature (802)..(802): n is a, c, g, or t
  G3804,family:WRKY
ccggccggngatattcaggcaggcgcattgactggtacgcatacaactacaagcaaggcggctagctacagcggctagtgcgcgcgtggtgcaggcgcagctagctagtgcgtgcaatggcgacttcgctgggactgaaccctgaagatctcttcacttcgtactcgtcttcctactactcctcgccgccgttcatgtccgactacgcggcgagcttcacgccggcgggcggggactccacggccttctcctcggagctcgacaaccttcaccacttcgactactcaccggcgccgatcgtcactgctgccggagccggggctgggggcggcgatcgcaacgagaagatgatgtggtgtcagggtggtggtgacgagagaagactcagaagcaacggaaggatcgggttcagaacgaggtcacaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccgcagccgctgctatcatcgtcccgtacggcaacggcggcggcaatagcggcttctacagcccgccgcacagcggctccccgtcggccacctcctactcgggctccctagtcttctgacttttccgggccttgacccatagttacctttacaccccagtcgtcggatgagaagaatcttcagcggncggctaaacagtctcaactgc

SEQ ID NO: 2136 - protein, 205 aa, Zea mays
  G3804,WRKY domain coordinates 108-164
MATSLGLNPEDLFTSYSSSYYSSPPFMSDYAASFTPAGGDSTAFSSELDNLHHFDYSPAPIVTAAGAGAGGGDRNEKMMWCQGGGDERRLRSNGRIGFRTRSQVEILDDGFKWRKYGKKAVKNSPNPRNYYRCSSEGCGVKKRVERDRDDPRYVITTYDGVHNHASPAAAAIIVPYGNGGGNSGFYSPPHSGSPSATSYSGSLVF

SEQ ID NO: 2137 - DNA, 1368 bp, Glycine max
  G3810,family:SCR
atgatgtcactttcacctagcttaggttctcccaacaatctcttgtttagagaaatgaaatccgaggaaaggggtttgtacttgattcatttgttgctcagttgtgcaaatcatgtagctgctggtaaccttgaaaatgcaaacaccacacttgagcaaatttccatgcttgcttcccctgatggggacactatgcagcgaatcgcaacatattttatggagtcgcttgctgatcggattcttaaaacatggcctgggatccacagagccctcaactcaaccaaaatgactttgatatccgacgaaattctggttcagaagcttttctttgagcttttccctttcttgaaggtagcatttgttctcacaaatcaggccatcattgaagcaatggaaggggagaaagtgattcacataattgatctcaatgctgctgaagctgctcagtggattgctctccttcgagtattaagtgcgcatcccgaaggccctcctcatttgagaatcaccggggttcatcagaaaaaggagattctggatgaggtggctcatagactaactgaagaagcagaaaagttggatataccgttccaattcaaccctgtggcaagcaaattagaaaatcttgattttgacaaacttagggtgaaaactggggaggcactagcaataagttccattctccaattgcatacccttttggcctgggatgatgaagccatgcagagaaagtctcctcttctgttaaaaagctcaaatggaattcacctgcaaagagttctgccaatgggccaaagcacattgggtgatttgcttgagaaagatatggttaatgggtacactccaagtcctgactcaacctcatcatctccatcatctttaactacttccaattcaatgaatatggagagctttcttaatgccttgtggggattatcaccaaaggtcatggttgtgacagaacaagactgtaatcacaatggtccaactctgatggataggcttcttgaagctctatactcttatgcagcattgtttgattgtttggaatccactgtctcaagaacatcattggagagattaagggtggagaagatgctttttggggaggaaataaagaacatcattgcatgtgagggatctgaacgaaaggaaagacatgaaaagctggaaaagtggttccagagatttgatctagctgggtttggcaacgtgcctttgagctactttggtatggtgcaagcaaggaggttcctgcagagctatggttgtgaaggatacagaatgagggatgaaaatggttgtgtgttaatttgctgggaggatcggccaatgtattcaatatcagcttggagatctaggaagtaa

SEQ ID NO: 2138 - protein, 455 aa, Glycine max
  G3810,SCR domain coordinates 106-171,305-374,378-451
MMSLSPSLGSPNNLLFREMKSEERGLYLIHLLLSCANHVAAGNLENANTTLEQISMLASPDGDTMQRIATYFMESLADRILKTWPGIHRALNSTKMTLISDEILVQKLFFELFPFLKVAFVLTNQAIIEAMEGEKVIHIIDLNAAEAAQWIALLRVLSAHPEGPPHLRITGVHQKKEILDEVAHRLTEEAEKLDIPFQFNPVASKLENLDFDKLRVKTGEALAISSILQLHTLLAWDDEAMQRKSPLLLKSSNGIHLQRVLPMGQSTLGDLLEKDMVNGYTPSPDSTSSSPSSLTTSNSMNMESFLNALWGLSPKVMVVTEQDCNHNGPTLMDRLLEALYSYAALFDCLESTVSRTSLERLRVEKMLFGEEIKNIIACEGSERKERHEKLEKWFQRFDLAGFGNVPLSYFGMVQARRFLQSYGCEGYRMRDENGCVLICWEDRPMYSISAWRSRK

SEQ ID NO: 2139 - DNA, 1563 bp, Glycine max
  G3811,family:SCR
gaattcggctcgaggttatcttctgtaacttcttcacctcttcagttcttttccatgatgtctctgtcagtttcacctagcttaggatctccctaccatatgaaatgcgagcttaggggtttggtattaatccatttgttgctcgctggtgctaattttgtagccaccggtgatttacaatatgcatacctcacacttgagcagatttcccagcatgcctctcttgatggggatactatgcagcgaattgcttcttatgtttctgaagcactcgctgatcggatacttaaaacatggcctggcatccacagggccctcaattccagcagaataactatggtttctgatgaaattcttgttcaaaagctcttctttgagcttttacccttcctcaagttctcatatatcctcactaatcaggctattgttgaagccatggaaggggagaaaatggtgcatatagttgatctctatggggccggaccggcacagtggatttctctcctccaagttttgagtgcacgtcctgaaggtcctccccatttgagaatcaccggggtccatcacaagaaagaggttctggatcagatggctcataaactcactgaagaggcggaaaagttggatatcccattccaattcaaccctgtgctaagcaagttggaaaatcttgatttcaacaaacttcgcgttaaaactggggaggcactggcaataagttctattatgcagttgcactcccttttggccttggatgaagatgcctcgcggagaaaatcgcctcttttgtcaaaaaactcaaatgcaattcacctgcagaaaggcctcctcatgaaccataacacactgggagatttgcttgacggctatagcccgagtcctgattcggcctcatcctcaccagcagcgtcttcatctgctttgatgaattcggagagctttcttaatgccttgtgggggttatccccaaaagtcatggttgtaactgaacaagactttaaccacaactgtttgaccatgatggagagactggcagaagctctattttcttatgctgcatattttgattgcttggagtccacggtctcaagagcatccatggacagattaaaacttgagaagatgctttttggcgaggagataaagaacatcatagcttgtgaaggatgtgaaagaaaagaaaggcacgaaaagatggataggtggatccagagacttgacttatctggatttgcaaacgtgcctataagctattatgggatgctgcagggaaggaggttcttgcagacctatggttgtgaggggtacaagatgagggaggaatgtggtcgggtgatgatatgctggcaggagcgatccttgttttccataacagcttggagaccaaggaagtaagataaagaagaaaattagtcatgtagtaatggatagagtctctttttttaagtttttcttttcttttctttgtttctaattgtatgacagagttttaccaatgtggtaatgactagtaatgaagagatacttctatttccttaaaaaaaaaaaaaaaagggcggccgc

SEQ ID NO: 2140 - protein, 446 aa, Glycine max
  G3811,SCR domain coordinates 103-168,296-365,369-442
MMSLSVSPSLGSPYHMKCELRGLVLIHLLLAGANFVATGDLQYAYLTLEQISQHASLDGDTMQRIASYVSEALADRILKTWPGIHRALNSSRITMVSDEILVQKLFFELLPFLKFSYILTNQAIVEAMEGEKMVHIVDLYGAGPAQWISLLQVLSARPEGPPHLRITGVHHKKEVLDQMAHKLTEEAEKLDIPFQFNPVLSKLENLDFNKLRVKTGEALAISSIMQLHSLLALDEDASRRKSPLLSKNSNAIHLQKGLLMNHNTLGDLLDGYSPSPDSASSSPAASSSALMNSESFLNALWGLSPKVMVVTEQDFNHNCLTMMERLAEALFSYAAYFDCLESTVSRASMDRLKLEKMLFGEEIKNIIACEGCERKERHEKMDRWIQRLDLSGFANVPISYYGMLQGRRFLQTYGCEGYKMREECGRVMICWQERSLFSITAWRPRK

SEQ ID NO: 2141 - DNA, 1329 bp, Oryza sativa
  G3813,family:SCR
atggtccaggacgaaggctcgtcgtcgtcggtgacatcctccccgctccacaacttctccaacatgccgctccacccggccgcggcggcgtcgcccacgccgccatggatggtgcgggagctgcgttccgacgagcgcgggctgtgcctcatccatctcctgctcaactgcgccgcggcggcggcggccgggcggcttgatgctgcgaacgccgcgctcgagcacatcgcgtcgctggcggcgcccgacggggacgccatgcagcgcgtggcggccgccttcgcggaggcgctggcgcggcgcgcgctgagggcgtggcctgggctgtgccgcgcgctgctcctgccccgcgcgtcgcccacgccggccgaggtcgctgccgcgcgccgccacttcctcgacctctgcccgttcctccgcctcgccggcgccgccgccaaccagtcgatactggaggccatggagtccgagaagatcgtgcacgtcatcgacctcggcggcgccgacgccacgcaatggctggagctcctccacctcctcgccgcgcgccccgagggcccgccgcacctgcgcctcacgtcggtgcacgagcacaaggaactcctcacccagacagccatggcgctcacgaaagaagcagagcgcctcgacgtgccgttccagttcaacccggtggtgtcccgcctcgacgccctcgacgtggagtccctccgcgtgaagaccggcgaggccctcgccatctgctccagcctccagctgcactgcctcctggcgtccgacgacgacgccgccgccgtggcgggcggcgacaaggagaggcggagcccggagtccgggctgtcgccgtcgacgtcgcgcgcggacgcgttcctgggcgcgctgtgggggctgtcgccgaaggtgatggtggtggcggagcaggaggcgagccacaacgcggcggggctgacggagaggttcgtggaggcgctcaactactacgcggcgctgttcgactgcctggaggtgggggcggcgcgcgggtcggtggagcgcgcgcgcgtggagcggtggctgctcggggaggagatcaagaacatcgtggcgtgcgacggcggcgagcggcgggagcggcacgagcggctggagcggtgggcgcggcggctggagggcgccggcttcggccgcgtcccgctcagctactacgcgctgctccaggcgcggcgggtggcgcagggcctcggctgcgacggcttcaaggtccgggaggagaagggcaacttcttcctctgctggcaagatcgcgccctcttctccgtctccgcatggcgcggccgccgcttcgactga

SEQ ID NO: 2142 - protein, 442 aa, Oryza sativa
  G3813,SCR domain coordinates 129-194,290-359,363-436
MVQDEGSSSSVTSSPLHNFSNMPLHPAAAASPTPPWMVRELRSDERGLCLIHLLLNCAAAAAAGRLDAANAALEHIASLAAPDGDAMQRVAAAFAEALARRALRAWPGLCRALLLPRASPTPAEVAAARRHFLDLCPFLRLAGAAANQSILEAMESEKIVHVIDLGGADATQWLELLHLLAARPEGPPHLRLTSVHEHKELLTQTAMALTKEAERLDVPFQFNPVVSRLDALDVESLRVKTGEALAICSSLQLHCLLASDDDAAAVAGGDKERRSPESGLSPSTSRADAFLGALWGLSPKVMVVAEQEASHNAAGLTERFVEALNYYAALFDCLEVGAARGSVERARVERWLLGEEIKNIVACDGGERRERHERLERWARRLEGAGFGRVPLSYYALLQARRVAQGLGCDGFKVREEKGNFFLCWQDRALFSVSAWRGRRFD

SEQ ID NO: 2143 - DNA, 1554 bp, Oryza sativa
  G3814,family:SCR
atgttccaggacgacatgctgtcgtcggcgacgtcatcgccggcgtcgtcggtgtactcgccgtcgccgtcgccgtcgaacgggtcgtgggtgcaggagctgagccatgaccagcagagcgttcggctgatcggcctgctttaccagtgcgccgccgaggtgtccgccggctccttcgaccgcgccaacctctgcctcgagcacatcacgcagctcgcgtccctggacgcgccgcacgcgctccagcgcctcgccgccgtcttcgccgacgcgctcgcgcgcaagctgctcaacctcatcctgggcctctcgcgcgcgctgctgtcgtcggccaactccgccgacgcccacctcgtccccgtcgcgcgccgccacatgttcgacgtgctcccgttcctgaagctcgcgtacctgaccaccaaccatgccatccttgaggcaatggagggggagaggttcgtccacgtcgtcgacttctccggcccggcggcgaacccggtgcagtggatcgcgctgttccacgcgttccgaggccgccgggaaggcccgccgcacctccgcatcaccgccgtccacgacagcaaggagttcctcgcgaacatggccgcggtgctgtccaaggaggcggaggcgttcgacatcgcgttccagttcaacgccgtggaggcgaagctcgacgagatggacttcgacgcgctccgccacgacctcggcgtcaggtccggcgaggcgctcgccgtcagcgtcgtgctgcagcttcaccgcctcctcgccgtcgacgacgggaggaggcacgccgccgccggctgcctcaccccggtccagatcatcgcgcgctccagcccgagaagcttcggcgagctgctggagcgggagctgaacacgcggctgcagctgagccccgacgcgtccgtggtgtcgtcgctgtcaccccactcccccgcagcagcaacggcggcgcacccgacgacgtcgacgccaaagctggggagcttcctgtcggcggtgaggtcgctgtccccgaagatcatggtgatgacggagcaggaggcgaaccacaacggcggcgcgttccaggagcggttcgacgaggcgctcaactactacgcgtcgctgttcgactgcctgcagcggagcgcggcggcggcggcggagcgcgcgcgcgtggagcgggtgctgctcggggaggagatccgcggcgtggtggcgtgcgagggggcggagcgggtggagcggcacgagcgggcgcggcagtgggcggcgcggatggaggcggccggcatggagcgggtggggctgagctacagcggcgccatggaggcgaggaagctgctgcagagctgcgggtgggcggggccgtacgaggtgaggcacgacgccggcggccatggcttcttcttctgctggcacaagaggccgctctacgccgtcacggcgtggcgcccggcggcgtcgcgacgcggccacactcttcatggccgaagatccgagggaacacgggagtctgtcccttggcctcccagaagtagacgtcggtgtggcagagcgaggtga

SEQ ID NO: 2144 - protein, 517 aa, Oryza sativa
  G3814,SCR domain coordinates 123-190,332-400,404-480
MFQDDMLSSATSSPASSVYSPSPSPSNGSWVQELSHDQQSVRLIGLLYQCAAEVSAGSFDRANLCLEHITQLASLDAPHALQRLAAVFADALARKLLNLILGLSRALLSSANSADAHLVPVARRHMFDVLPFLKLAYLTTNHAILEAMEGERFVHVVDFSGPAANPVQWIALFHAFRGRREGPPHLRITAVHDSKEFLANMAAVLSKEAEAFDIAFQFNAVEAKLDEMDFDALRHDLGVRSGEALAVSVVLQLHRLLAVDDGRRHAAAGCLTPVQIIARSSPRSFGELLERELNTRLQLSPDASVVSSLSPHSPAAATAAHPTTSTPKLGSFLSAVRSLSPKIMVMTEQEANHNGGAFQERFDEALNYYASLFDCLQRSAAAAAERARVERVLLGEEIRGVVACEGAERVERHERARQWAARMEAAGMERVGLSYSGAMEARKLLQSCGWAGPYEVRHDAGGHGFFFCWHKRPLYAVTAWRPAASRRGHTLHGRRSEGTRESVPWPPRSRRRCGRAR

SEQ ID NO: 2145 - DNA, 1401 bp, Solanum lycopersicum
  G3824,family:SCR
tggagataccatgcaaaggattgcttcatattttactgaggctttagctgataggattctaaggagttggcctggtctttataaggcgttgcgttcgactaagttatcggttgtctcagaagaaattcttgttaggaagatgtttttcgagatctttcctttcttgaaggtggcgtttgtggtcacaaatcaagctataattgaagctatggaaggtgaaaagatggttcatattgtggatcttaatgctgctgaacccctgcaatggcgtgcgttgcttcaggacttgagcgcgcgtcctgaaggaccgccccatctgcgcattactggggttcatcagcaaaaagaggtgttagatcaaatggcacatgtgcttactcaagaagcagaaaaactggatatcccttttcagttcaatcaagtagttagcagattggaaaatcttgatgttgagaaacttcgcgtgaaaacgggggaggctcttgcgattagttcaattatgcaattgcacacccttctagcccatgataatgacaagaagtcccctttgccttttaagcattcaaatggtgttaacttaaacagggcactagtcaaccaaaatactttaggggaatttcttgaaaaagatatggctaatggttgcagtccaagcaatgacaccgcttcttcatccccgctatgttcaactggttcaacaaagatggatagtttcctcaatgctttgtggggtttatcaccaaaagttatggtggtaacagaacaagatgctaaccataatgggacaactcttatggagaggctatcagagtcgttacatttttatgctgcattatttgattgtcttgaatcgacgctgccaagaacatcattagagagattaaaggtggaaaagatgttattaggtgaagagattagaaacattatagcatgtgaagggatcgaacgaaaggagaggcatgaaaagctcgaaaagtggttccaaagattcgacacatctggttttgggaatgtgcctttgagttattatgctatgttgcaggcaagaaggttgttgcagagttacagttgtgaaggatacaagatcaaagaagataatggttgcgtggtgatatgctggcaggatcgcccacttttctcagtgtcgtcttggcgatgtaggaagtgagactaaacttagttttcattgtaatgttttagatttgtatcttccttttgttgttgtaacataatgtgtagaactccagttggtgaaactgctattgacatgtttgagacattttgtcaacttttttgatctcatgtgataagcttctctctagtgtttagatttccattttgatatggatcaataaagctgatgttctcttaaaaaaaaaaaaaaaaaactcgagactagga

SEQ ID NO: 2146 - protein, 385 aa, Solanum lycopersicum
  G3824,SCR domain coordinates 42-107,235-304,308-381
MQRIASYFTEALADRILRSWPGLYKALRSTKLSVVSEEILVRKMFFEIFPFLKVAFVVTNQAIIEAMEGEKMVHIVDLNAAEPLQWRALLQDLSARPEGPPHLRITGVHQQKEVLDQMAHVLTQEAEKLDIPFQFNQVVSRLENLDVEKLRVKTGEALAISSIMQLHTLLAHDNDKKSPLPFKHSNGVNLNRALVNQNTLGEFLEKDMANGCSPSNDTASSSPLCSTGSTKMDSFLNALWGLSPKVMVVTEQDANHNGTTLMERLSESLHFYAALFDCLESTLPRTSLERLKVEKMLLGEEIRNIIACEGIERKERHEKLEKWFQRFDTSGFGNVPLSYYAMLQARRLLQSYSCEGYKIKEDNGCVVICWQDRPLFSVSSWRCRK

SEQ ID NO: 2147 - DNA, 1269 bp, Oryza sativa
  G3827,family:SCR
atgatcacgtttgggttgaactcccgcccccatccggagttccggaacgacctccgcccatcgtcatcgtcacttgccgccggcgaaagtgagtccccaaaggcggtggagaggctggagagagagggatgtaccagatctggaagctcccgccgtcagccgcgccgaggtgcggcagccgctctggccgtagccagcgccccttcactcgcgagttgttgtcgtcgcccctccatccgcaagctgctgtcgttgccgctccacgctcgcccggtgccgccgccaggctccgggatgcggcagccgctccgcccgtcgccggcggccctccacccacgaggtgctgccgtcgcccctacgcgctcgcctggtgccgccgtcgccggcgctgagatgcggcagcaggtgagctactgctggcgccctgtccgcccgccaccggcgggtggggaggaggctggcggggagctcctcctgcgcggccgcgagctcctgctgctgcagctgctgctaatttatctcgtgtgggacggagggacgctgctcctccttgagctgagcattttcttccttctcttttgttcacttgtgacggccatggcgctcacgaaagaagcagagcgcctcgacgtgcccttccagttcaacccggtggtgtcccgcctcgatgccctcgatgtggagtccctccgcgggctgtcactgaaggtgatggtggtgacggagcaggaggtgagccacaacgcggcggggctgacggagcggttcgtggaggctctcaactactacgcggcgttgttcgactgcctggaggtgggcggggcgcgcgggtcggtggagcgcacgcgcgtggagcggtggctactcggggaggagatcaagaacatcgtggcgtgtgacggcggcgagcggcgggagcggcacgagcggctggagggcgccggctttggccgcgtcccgctcagctactacgcgctgcttcaggccaggcgggtggcgcagggtctcggctgcgacggcttcaaggtccgggaggagaagggcaacttcttcctctgctggcaagatcgcgccctcttctccgtctccgcatggcgcggccgccgcttcgccgccttgctccccttgccgccatcgacgcctctcccctgctcccgcgtcattgctaccttgctctcctccccgccgccgccttgctctcctctccatccgtactgcccagagcggagagagaggatgaagggagagaagaagggaaagagagagtag

SEQ ID NO: 2148 - protein, 422 aa, Oryza sativa
  G3827,SCR domain coordinates 226-295,299-365
MITFGLNSRPHPEFRNDLRPSSSSLAAGESESPKAVERLEREGCTRSGSSRRQPRRGAAAALAVASAPSLASCCRRPSIRKLLSLPLHARPVPPPGSGMRQPLRPSPAALHPRGAAVAPTRSPGAAVAGAEMRQQVSYCWRPVRPPPAGGEEAGGELLLRGRELLLLQLLLIYLVWDGGTLLLLELSIFFLLFCSLVTAMALTKEAERLDVPFQFNPVVSRLDALDVESLRGLSLKVMVVTEQEVSHNAAGLTERFVEALNYYAALFDCLEVGGARGSVERTRVERWLLGEEIKNIVACDGGERRERHERLEGAGFGRVPLSYYALLQARRVAQGLGCDGFKVREEKGNFFLCWQDRALFSVSAWRGRRFAALLPLPPSTPLPCSRVIATLLSSPPPPCSPLHPYCPERRERMKGEKKGKRE

SEQ ID NO: 2149 - DNA, 435 bp, Oryza sativa
  G3835,family:CAAT
atgacgaacgggcaggacaacctgctgccgatcgccaacgtgggccggatcatgaaggacgggctgccgccgcaggcgaagatatcgaagcgggccaaggagacgatccaggagtgcgcgacggagttcatcagcttcgtcaccggcgaggcgtcggagcggtgccggcgggagcggcggaagacggtgaacggcgacgacgtctgccacgccatgaggagcctcggcctcgaccactacgccgacgccatgcacaggtacctgcagaggtaccgcgagggcgaggagctcgccgcgtcgctcaacagcagcagcagcgccgccgccgccgccgccgccgccggcagcaggggcggtggcgccatacagatcgacgtgagagctgagctctccatcttcagatcaggcaacaaccaaggtcgtccaaacaattaa

SEQ ID NO: 2150 - protein, 144 aa, Oryza sativa
  G3835,CAAT domain coordinates 3-92
MTNGQDNLLPIANVGRIMKDGLPPQAKISKRAKETIQECATEFISFVTGEASERCRRERRKTVNGDDVCHAMRSLGLDHYADAMHRYLQRYREGEELAASLNSSSSAAAAAAAAGSRGGGAIQIDVRAELSIFRSGNNQGRPNN

SEQ ID NO: 2151 - DNA, 795 bp, Glycine max
  G3837,family:CAAT
ctgtgtttgagaggactaaagtaaacagatgggtgacaacaacataggcaaagtcttagagagagaaggctttaagtacaacttcacggcagctgcaagtgacacctctgcacaagatgaggtgattaaagagcaagatcggttgcttccaatagcaaatgtggggcgcatcatgaagcaaatccttcctcctaacgccaagatctcaaaggaagctaaagaaaccatgcaagaatgtgtgtccgagttcattagctttgtcactggggaagcttctgacaagtgtcacaaggagaagcgcaagaccgtgaatggcgacgatatttgctgggcccttgctaccctagggtttgatgactactctgagccacttaaaaggtacttgcataagtatagggagttcgaaggggagagagcaaatcaaaataagggtaacaacaacacttatgaaaacaacattgcaaacatataaattaattatgtggaaggtgaactctttctccaattcccatgatcaatgtgattgatagttgttaatctgatcttctagttttctcctgaatttgagatactcaaggggcttgtatccttatgtgatatatatatgacgtgagtcatgtatgcaaactcacgtgttttagacctgatattttcatcaagggttgaaattaccctagatgaacacatggtagcttgagaatcatgtgagttacaactaatctttgtatttgtctatccaataataagcttggatcctttccagaaaaaaaaaaaaaaaaaaaaaaaaaaaaaaaa

SEQ ID NO: 2152 - protein, 147 aa, Glycine max
  G3837,CAAT domain coordinates 34-123
MGDNNIGKVLEREGFKYNFTAAASDTSAQDEVIKEQDRLLPIANVGRIMKQILPPNAKISKEAKETMQECVSEFISFVTGEASDKCHKEKRKTVNGDDICWALATLGFDDYSEPLKRYLHKYREFEGERANQNKGNNNTYENNIANI

SEQ ID NO: 2153 - DNA, 1582 bp, Zea mays
  G3839,family:CAAT
ctcgaggccggccggggacacccttggtcccaacttacaaagcacagagaagacctaccccgccccggcacacaaggtagcaacatgaataatccccaaaaccctaaagccagtgctccttgcaccttgccatcggagcttcccaaagaagcagtggcgaccgacgaagcaccgccgccaatgggcaacaacaacaacacggaatcggcgacggcgacgatggtccgggagcaggaccggctgatgcccgtggccaacgtgtcccgcatcatgcgccaagtgctgcctccgtacgccaagatctccgacgacgccaaggaggtgatccaggagtgcgtgtcggagttcatcagcttcgtcaccggcgaggcgaacgagcggtgccacaccgagcgccgcaagaccgtcacctccgaggacatcgtgtgggccatgagccgcctcggcttcgacgactacgtcgcgcccctcggcgccttcctccagcgcatgcgcgacgacagcgaccacggcggtgaagagcgcggcggccctgcagggcgtggtggctcgcgccgcggctcgtcgtccttgccgctccactgcccgcagcagatgcaccacctgcacccagccgtctgccggcgtccgcaccagagcgtgtcgcctgctgcaggatacgccgtccggcccgttccccgcccgatgccagccagtgggtaccgcatgcagggcggagaccaccgcagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactagcttagctagcttctcagttccccgtgtacaataagaggggcggtcgcggcgccgcgccgcgcccttgggttgggccgggcgctatgctgcagtttggtttgtaaactaacgagcctagggtagctggtgcacgcgcgccacctcgccggacgtcgccgtcgtcgtcggcatggacttaaccggcgggccctgttgttatttctcaagtttgtagccaacgcactgttcggtgcgttccataatttaatttaccatgttgctctcgaaaaaaaaaagaaaaaaagaaaaaaaaaaaaaaaaaagcgtgggcggcgtggctccctgcagctacggaggggcgctcgtccaggccggtggaacccaacacgttgttggattccacgacgacgaggcaagctcttcgagtgaaaatccgccgccggaggggcgtgccgctggctcgaactagcctagcttctcagttccccgtgtacaataaagggggcggtcgcggcgccgcgccgcgcccttgggttgggccgggcgctatgctgcagtttggtttgtaaactaacgagcctagggtagctggtgcacgcgcgccacctcgccggacgtcgccgtcgtcgtcggcatggacttaaccggcgggccctgttgttatttctcaagtttgtagccaacgcactgttcggtgcgttccataatttaatttaccatgttgctctgg

SEQ ID NO: 2154 - protein, 262 aa, Zea mays
  G3839,CAAT domain coordinates 48-137
MNNPQNPKASAPCTLPSELPKEAVATDEAPPPMGNNNNTESATATMVREQDRLMPVANVSRIMRQVLPPYAKISDDAKEVIQECVSEFISFVTGEANERCHTERRKTVTSEDIVWAMSRLGFDDYVAPLGAFLQRMRDDSDHGGEERGGPAGRGGSRRGSSSLPLHCPQQMHHLHPAVCRRPHQSVSPAAGYAVRPVPRPMPASGYRMQGGDHRSVGGVAPCSYGGALVQAGGTQHVVGFHDDEASSSSENPPPEGRAAGSN

SEQ ID NO: 2155 - DNA, 1582 bp, Zea mays; identical to SEQ ID NO: 2153
  G3839,family:CAAT

SEQ ID NO: 2156 - protein, 262 aa, Zea mays; identical to SEQ ID NO: 2154
  G3839,CAAT domain coordinates 48-137

SEQ ID NO: 2157 - DNA, 705 bp, Solanum lycopersicum
  G3841,family:AP2
atggatcaacagttaccaccgacgaacttcccggtagattttccggtgtatcgccggaattcaagcttcagtcgtctaattccctgtttaactgaaaaatggggagatttaccactaaaagtcgacgattccgaagatatggtaatttacggtctattaaaagacgctctaagcgtcggatggtcgccgtttaatttcaccgccggcgaagtaaaatcggagccgagagaagaaattgaatcgtcgcctgaattttcaccttctccggcggagaccacggcagctccggcggctgaaacaccgaaaggaagacattatagaggcgttagacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttggatgtcaaattgaacaattgacaggtgtccatcaactattggtcatttaa

SEQ ID NO: 2158 - protein, 234 aa, Solanum lycopersicum
  G3841,AP2 domain coordinates 102-166
MDQQLPPTNFPVDFPVYRRNSSFSRLIPCLTEKWGDLPLKVDDSEDMVIYGLLKDALSVGWSPFNFTAGEVKSEPREEIESSPEFSPSPAETTAAPAAETPKGRHYRGVRQRPWGKFAAEIRDPAKNGARVWLGTYETAEEAAIAYDKAAYRMRGSKAHLNFPHRIGLNEPEPVRVTAKRRASPEPASSSGNGSMKRRRKAVQKCDGEMASRSSVMQVGCQIEQLTGVHQLLVI

SEQ ID NO: 2159 - DNA, 705 bp, Solanum lycopersicum
  G3843,family:AP2
atgtattcaaattgtgaactagaaaatgatttttcagtactcgaatcaattagaagatacttacttgaagattgggaagctccattaacgagctctgaaaactcaacatcctcagagttcagccggagcaacagcattgaatccaatatgtttagtaattcatttgattatacacctgaaatttttcaaaatgatattcttaatgaaggatttggatttggatttgaattcgagacttctgattttataatccctaaattagagtcacaaatgtcaatcgaatcacctgaaatgtggaatttaccggaatttgtggctccattagagacggcggcggaggtgaaagttgaaacaccggttgagatgacaactacgacgacgaagccaaaggcaaagcattatagaggtgtgagagtgaggccatgggggaaattcgcggcggaaattagagatccggcgaaaaatggagcacgagtttggctcggtacatatgagacggcggaggatgcggcgttggcttacgacaaggcggcttttcgcatgcggggatcacgtgcattgctgaattttccgttgaggattaattccggtgaaccggatcctgttagagttggatcgaagagatcgtcaatgtcgccggagcattgttcatcggcgtcgtcgacgaagaggaggaagaaggttgctcgtggaacaaagcaataa

SEQ ID NO: 2160 - protein, 234 aa, Solanum lycopersicum
  G3843,AP2 domain coordinates 130-194
MYSNCELENDFSVLESIRRYLLEDWEAPLTSSENSTSSEFSRSNSIESNMFSNSFDYTPEIFQNDILNEGFGFGFEFETSDFIIPKLESQMSIESPEMWNLPEFVAPLETAAEVKVETPVEMTTTTTKPKAKHYRGVRVRPWGKFAAEIRDPAKNGARVWLGTYETAEDAALAYDKAAFRMRGSRALLNFPLRINSGEPDPVRVGSKRSSMSPEHCSSASSTKRRKKVARGTKQ

SEQ ID NO: 2161 - DNA, 1231 bp, Medicago truncatula
  G3844,family:AP2
ctctctaaaaaacatcacaaaacgaaaatttcattccttccacactctccaatctccatagcaaattacaacacaaaaactttaccaaaggccacaacatgtacggaaatagtaattttgattccgatcttgcccttttagactctattcgccgccacttgttaggagaatccgaatttatattcggtgctccaacaaatgtttcgggtaatacccgagttttctctcggagctccagtttcagcagcttatacccatgtttaagtgacaattggggtgaactaccactcaaagaagatgattctgaagatatggtactttacggcgtcctccgcgatgccgtaaatgttgggtgggtcccgtctctcgaagtcgggtcacccgaaagtgtctcatcggtttttccgttagaaatgacggtgaaaccggagccggatgttatgccggtggagaatgtcctcccggtagcttcaacagcggagcaagtggttcctgaggggccaaaagctgctccggtgaaaggaaaacactaccgcggtgtgagacaacggccgtgggggaaatttgcggcggagattcgtgatccggcgaagaacggagctagagtttggcttggaacatttgaaaccgctgaggatgcggctttggcttatgatagagctgcgtataggatgagagggtcaagagctttgttgaattttccacttcgggttaactccggtgaacccgacccggttagaatagcttcaaaacgttcttcgccggaacgctcttcgtcatcggaaagtaattctccggcgaagaggaagaaagtaatgacagctcagagtggattaaaaacaggacaagtgggaagtcaagtggcacaacaatgtacacgtggaggacagttattggtttcttaatatacggttctaccgtactaggaacaaaaaatgtttaggttaatgttgtgttgtgtttcttcaatgcaatttgtaattatccgaagacatgtgtgtactgtgtatagcactatgcaactattccttcttttgtgcctacacaattttggaaccaaggaaaaggatgaaaatgtagcaaaatggtgattcatgagggagacaaaaatgcgggagaaaaacaaaaattgaaaaaatgagaaatgaaataatgatgtttaaaggatagtgaatgaagtggggttatgcgatgtaactttgtgaatatagaaattcttatttgtttgatc

SEQ ID NO: 2162 - protein, 268 aa, Medicago truncatula
  G3844,AP2 domain coordinates 141-205
MYGNSNFDSDLALLDSIRRHLLGESEFIFGAPTNVSGNTRVFSRSSSFSSLYPCLSDNWGELPLKEDDSEDMVLYGVLRDAVNVGWVPSLEVGSPESVSSVFPLEMTVKPEPDVMPVENVLPVASTAEQVVPEGPKAAPVKGKHYRGVRQRPWGKFAAEIRDPAKNGARVWLGTFETAEDAALAYDRAAYRMRGSRALLNFPLRVNSGEPDPVRIASKRSSPERSSSSESNSPAKRKKVMTAQSGLKTGQVGSQVAQQCTRGGQLLVS

SEQ ID NO: 2163 - DNA, 841 bp, Nicotiana tabacum
  G3845,family:AP2
acacaagagaactaaaacttaaaagcaaaatgaatcaaccaatttatacagagttgccgccggcgaattttccgggagaatttccggtgtaccgccggaattcaagcttcagtcgtctaatcccatgtttaactgaaacatggggcgacttaccactaaaagtcgacgattctgaagatatggtaatttatactctcttaaaagacgctcttaacgtcggatggtcgccgtttaatttcagcgccggcgaagtaaaatcggagcagagggaggaagaaattgtggtttctccggcggagacgacggccgcgccggcggctgagttacctaggggaaggcattacagaggtgttagacgacggccgtgggggaaatttgcggcggagattagggatccggcgaagaatggagctagggtttggcttggaacatacgaaacagatgaagaagctgcaattgcttatgataaagcggcttatagaatgcgcggttcaaaggctcatttaaattttccacatagaatcggtttaaatgaaccggaaccggttcgagttacggcgaaaagacgagcatcgcctgaaccggctagttcgtcggaaaatagttcacctaaacggagaagaaaggctgttgcaactgagaaatctgaagcagtagaagtggagagtaaatcaaatgttttgcaaactggatgtcaagttgaactattgacacgtcgacatcaattattagtcagttaagtatgaacttaggatattcaattgtggtactcttgagctccaaagttgtacagtttgattctctcatgttaattatatgacaggagggttaattgcaacgt

SEQ ID NO: 2164 - protein, 236 aa, Nicotiana tabacum
  G3845,AP2 domain coordinates 101-165
MNQPIYTELPPANFPGEFPVYRRNSSFSRLIPCLTETWGDLPLKVDDSEDMVIYTLLKDALNVGWSPFNFSAGEVKSEQREEEIVVSPAETTAAPAAELPRGRHYRGVRRRPWGKFAAEIRDPAKNGARVWLGTYETDEEAAIAYDKAAYRMRGSKAHLNFPHRIGLNEPEPVRVTAKRRASPEPASSSENSSPKRRRKAVATEKSEAVEVESKSNVLQTGCQVELLTRRHQLLVS

SEQ ID NO: 2165 - DNA, 947 bp, Nicotiana tabacum
  G3846,family:AP2
acacaacacataaaaaatccaattgcttaaaactcataacaaacaaaatgtatcaaccaatttcgaccgagctacctccgacgagtttcagtagtctcatgccatgtttgacggatacatggggtgacttgccgttaaaagttgatgattccgaagatatggtaatttatgggctcttaagtgacgctttaactgccggatggacgccgtttaatttaacgtccaccgaaataaaagccgagccgagggaggagattgagccagctacgattcctgttccttcagtggctccacctgcggagactacgacggctcaagccgttgttcccaaggggaggcattataggggcgttaggcaaaggccgtgggggaaatttgcggcggaaataagggacccagctaaaaacggcgcacgggtttggctagggacttatgagacggctgaagaagccgcgctcgcttatgataaagcagcttacaggatgcgcggctccaaggctctattgaattttccgcataggatcggcttaaatgagcctgaaccggttagactaaccgctaagagacgatcacctgaaccggctagctcgtcaatatcatcggctttggaaaatggctcgccgaaacggaggagaaaagctgtagcggctaagaaggctgaattagaagtgcaaagccgatcaaatgctatgcaagttgggtgccagatggaacaatttccagttggcgagcagctattagtcagttaagatatgagctaagaactcaattgttaagtttggagtgaatagaaacagcaaactactccactttgctcatagttggaccaaggaggccatttgtattatgtctatggcgtgtaaagtgtcacctttcagtttaaaaacagtatttcttgtcctcactttggattgattaaatggataatactcgctttcgactgggtt

SEQ ID NO: 2166 - protein, 233 aa, Nicotiana tabacum
  G3846,AP2 domain coordinates 95-159
MYQPISTELPPTSFSSLMPCLTDTWGDLPLKVDDSEDMVIYGLLSDALTAGWTPFNLTSTEIKAEPREEIEPATIPVPSVAPPAETTTAQAVVPKGRHYRGVRQRPWGKFAAEIRDPAKNGARVWLGTYETAEEAALAYDKAAYRMRGSKALLNFPHRIGLNEPEPVRLTAKRRSPEPASSSISSALENGSPKRRRKAVAAKKAELEVQSRSNAMQVGCQMEQFPVGEQLLVS

SEQ ID NO: 2167 - DNA, 957 bp, Oryza sativa
  G3848,family:AP2
atgacggcgcgaagcatgttgcggaaccacccggaggcgtcggtgctcgacaccatccggcagcacctgctggaggagccgcgcggcggcggcggtggcgaggcggcggaggcgagcttcgggagcctggtggccgacatgtggagcgactcgctgccgttccgcgacgacgacgccgacgacatggtggtgttcggcgcgatgcgggacgcgttctcgtgcgggtggctgcccgacggcgtgttcgcggaggtgaagccggagcccctgctctcgccggactcgtcgtcgtacgacgggtcctcttgctgcttcggcttcgcggacgtgtcggagccggtgacgccgagcgacgcggcgtcgggggcggcagaagcggcggccgcggcggcggcggcgacggcggagcacgggaaggaggaggaggccgcggctgcggtggcgagggggaagcactacaggggggtgaggcagcggccgtggggcaagttcgcggcggagatccgggaccccgccaagaacggcgcgcgcgtgtggctcggcacgttcgacaccgccgaggacgccgccctggcgtacgaccgcgccgcctaccgcatgcgtggctcccgcgcgctcctcaacttcccgctccgcatcggctcggagatcgcagccgccgccgccgccgcagcggcagcggcagccggcgacaagcggccgtcgccggagccggcgacctcggagtcgtccttctcctcctcatcctcctgcaccaccaccaccacctcctcctcaacctcctcctccggctccccgaaacggagaaagagaggcgaggccgcggccgcgtccatgtccatgcccctggtgcccccgccttcccagctgaactggccggtgcaggcatggtaccccgccgccgcaccggtcgagcaggtggcgatcaccccgcgcgtggagcagctcgtcatctaa

SEQ ID NO: 2168 - protein, 318 aa, Oryza sativa
  G3848,AP2 domain coordinates 149-213
MTARSMLRNHPEASVLDTIRQHLLEEPRGGGGGEAAEASFGSLVADMWSDSLPFRDDDADDMVVFGAMRDAFSCGWLPDGVFAEVKPEPLLSPDSSSYDGSSCCFGFADVSEPVTPSDAASGAAEAAAAAAAATAEHGKEEEAAAAVARGKHYRGVRQRPWGKFAAEIRDPAKNGARVWLGTFDTAEDAALAYDRAAYRMRGSRALLNFPLRIGSEIAAAAAAAAAAAAGDKRPSPEPATSESSFSSSSSCTTTTTSSSTSSSGSPKRRKRGEAAAASMSMPLVPPPSQLNWPVQAWYPAAAPVEQVAITPRVEQLVI

SEQ ID NO: 2169 - DNA, 931 bp, Solanum lycopersicum
  G3852,family:AP2
aaaaccttcaaatactcataatgtatcaacttcccacttctactgagttaactttttttccggcagaattcccggtgtattgccggagttcaagtttcagtagtctcatgccatgtttaaccgaatcatggggtgacttgccgttaaaagttaacgattccgaagatatggtaatttatgggtttctacaagacgcttttagtatcggatggacgccgtcaaatttaacgtccgaggaagtgaaactcgagccgagggaggagattgagccagctatgagtacttctgtttctccgccgacagtggctccagcggctttgcagcctaaaggaaggcattacaggggcgttagacaaaggccatggggaaaatttgcagcggaaataagagatccggctaaaaacggcgcacgggtttggcttggaacttacgagtcggctgaggaagccgcactcgcttatggtaaagccgcttttaggatgcgcggtactaaggctctattgaatttcccgcatagaattggtttaaatgagccggagccggttagagtgacggttaagagacgattatctgaatcggctagttcatcggtatcatcagcttcggaaagtggctcgcctaagaggaggagaaagggtgtagcggctaagcaagccgaattagaagttgagagccggggaccaaatgttatgaaagttggttgccaaatgttccagttggcgagcagctattggttagttaaaatatggagctaagaactcaatggctagggcttgtttggctttgaagtggacagaaaatagcaaatcattccactaggtgagaagtggaccaaagaggccatttggactatgtgtatctaacgtgtaaagtgcactttttagtttgtgcttttatgaaaaaaaacacacattttcatatagtggctttt

SEQ ID NO: 2170 - protein, 244 aa, Solanum lycopersicum
  G3852,AP2 domain coordinates 102-167
MYQLPTSTELTFFPAEFPVYCRSSSFSSLMPCLTESWGDLPLKVNDSEDMVIYGFLQDAFSIGWTPSNLTSEEVKLEPREEIEPAMSTSVSPPTVAPAALQPKGRHYRGVRQRPWGKFAAEIRDPAKNGARVWLGTYESAEEAALAYGKAAFRMRGTKALLNFPHRIGLNEPEPVRVTVKRRLSESASSSVSSASESGSPKRRRKGVAAKQAELEVESRGPNVMKVGCQMFQLASSYWLVKIWS

SEQ ID NO: 2171 - DNA, 885 bp, Zea mays
  G3856,family:AP2
atgctgcttaacccggcgtgcgaggcggcagcgccgatggacagcatccggcatcacctcctggacgagccggcggcggcggcgaccgcgagcgcggctccgcggccggtgtactgccgcagcacgagcttcggcagcctagtggcggaccaatggagcgagtcgctcccgttccgccccgacgacgccgacgacatggtcgtcttcggcgcgctccgcgacgccttttcccagggctggctccccgacggctccttcgccgccgtgaagcccgagcccctggcgttcccggactccccctacgagcgcggatcctatccctgccttggtggcttccttctcgcggaggggcctgagacgccgaccgaggcggcgacgacgcccgggagcgaggaggaggccgcggcggcggtgtccagggggaagcactaccgcggggtgaggcagcggccgtggggcaagttcgcggcggagatccgggacccggccaagaacggcgcgcgcgtgtggctgggcacgtacgacagcgccgaggacgccgccgtggcctacgaccgcgccgcgtaccgcatgcgcggctcccgcgcgctcctcaacttcccgctccgcatcggctccgagatcgccgcggcggccgccgccgtcgcggccactgcccctgccgcgggagacaagcgggcgtccccagagccgaccgcgagctccgactcctccccttcggcctcctctgcgacaccgaagcggaggaagagaggcgaggccgctgccgcgaccatggccatggcccttgtgccgcccccgccggcggcgcaggcgcccgtccagctgaccctcccggcccgtccgtggttcgccgccggccccgtccagcagctagtgagctaa

SEQ ID NO: 2172 - protein, 294 aa, Zea mays
  G3856,AP2 domain coordinates 140-204
MLLNPACEAAAPMDSIRHHLLDEPAAAATASAAPRPVYCRSTSFGSLVADQWSESLPFRPDDADDMVVFGALRDAFSQGWLPDGSFAAVKPEPLAFPDSPYERGSYPCLGGFLLAEGPETPTEAATTPGSEEEAAAAVSRGKHYRGVRQRPWGKFAAEIRDPAKNGARVWLGTYDSAEDAAVAYDRAAYRMRGSRALLNFPLRIGSEIAAAAAAVAATAPAAGDKRASPEPTASSDSSPSASSATPKRRKRGEAAAATMAMALVPPPPAAQAPVQLTLPARPWFAAGPVQQLVS

SEQ ID NO: 2173 - DNA, 946 bp, Solanum tuberosum
  G3857,family:AP2
ccaaaaacctcataaatcactagaaaaaactaaaattcaaagcaaaatggatcaacagttgctaccgacgaacttcccggtgtatcgccggaattcaagcttcagtcgtctaatcccctgtttaactgaaacatggggagatttaccactaaaagtcgacgattccgaagatatggtaatttacggtctattaaaggacgctcttagcgtcggatggtcgccgtttagtttcaccaccggcgaagtaaaatcggaaccgagagaggaaattgagtcggcgcctgaatttgtaccttctccggcggagaagacggcagctccggtggctgaaacacccaagggaagacattatagaggcgttagacagcggccgtgggggaaatttgcggcggagattagagatccggcgaagaacggagctagggtttggcttggaacgtatgaaacagctgaagaagctgctattgcttatgataaagctgcttatagaatgagaggatcaaaagcacatttgaatttcccgcaccggatcggtttgaatgaaccggaaccggttcgagttacggcgaaaagacgagcatcgcctgaaccggtaagctcgtcggaaaacggttcaatgaaacggagaagaaaagccgttcggaaatgtgacggagaagtggagagtagatcaagtgttatgcaagttggatgtcaaatcgaacaattgacaggtgtccatcaactattggtcagttaaatagccggcaattttccgaacgcgaaatactttgtgcatattttccccgaacccttaaataaattcgaaatactctatgcatcggactatgatggtggagaagaatcgaaagtccaatgaaaaaaattatcgtgatagggtaatcccgaagttgtaaaaaagtttgattttcattaatattatctttgatctttgataattatttga

SEQ ID NO: 2174 - protein, 230 aa, Solanum tuberosum
  G3857,AP2 domain coordinates 98-162
MDQQLLPTNFPVYRRNSSFSRLIPCLTETWGDLPLKVDDSEDMVIYGLLKDALSVGWSPFSFTTGEVKSEPREEIESAPEFVPSPAEKTAAPVAETPKGRHYRGVRQRPWGKFAAEIRDPAKNGARVWLGTYETAEEAAIAYDKAAYRMRGSKAHLNFPHRIGLNEPEPVRVTAKRRASPEPVSSSENGSMKRRRKAVRKCDGEVESRSSVMQVGCQIEQLTGVHQLLVS

SEQ ID NO: 2175 - DNA, 884 bp, Solanum tuberosum
  G3858,family:AP2
gatcaaaaactcataatgtatcaattacccatttctacagagttacctccgacttttttcccggcagaattcccggtgtattgccggagttcaagtttcagtagtctcatgccatgtttaaccgaatcatggggtgacttgccgttaaaagttaacgattccgaagatatggtaatttatgggcttctacaagacgccttcagtatcggatggacgccgtcaaatttaacgtcagtggaagtgaaacccgagccgagggaggagattgagccagctatgagtacttctgtttctccgccgacagagactgcggcggctccatcggctctgcaacctaaaggaaggcattacaggggcgttagacaaaggccatggggaaaatttgcagcggaaataagagatccagctaaaaacggcgcacgggtttggcttggaacttacgagtcggccgaggaagctgcgctcgcttatgatatagcagcttttaggatgcgcggtactaaggctctattgaatttcccgcatagaatcggtttaaatgagccggagccggttagagtgacggttaagagacgattacctgaaccggctagttcattggtatcatcagcctcggaaagtggctcgctgaagaggaggagaaaaggtgtagcggctaagcaagccgaattagaagttcagagccggggaccaaatgttattcaagttggttgccaaatggaacaatttccagttggcgagcagctattggttagttaaaatatggagctaagaactcaacggcaagggcttgtttcgctttgaagtggacagaaaattgcaattcattccacttggtgagaagtggaccaaagaggccatttggattatgtgtatctaacgtg

SEQ ID NO: 2176 - protein, 247 aa, Solanum tuberosum
  G3858,AP2 domain coordinates 108-172
MYQLPISTELPPTFFPAEFPVYCRSSSFSSLMPCLTESWGDLPLKVNDSEDMVIYGLLQDAFSIGWTPSNLTSVEVKPEPREEIEPAMSTSVSPPTETAAAPSALQPKGRHYRGVRQRPWGKFAAEIRDPAKNGARVWLGTYESAEEAALAYDIAAFRMRGTKALLNFPHRIGLNEPEPVRVTVKRRLPEPASSLVSSASESGSLKRRRKGVAAKQAELEVQSRGPNVIQVGCQMEQFPVGEQLLVS

SEQ ID NO: 2177 - DNA, 1225 bp, Triticum aestivum
  G3864,family:AP2
cccacgcgtccgccaagagcgaactgagatcatcctaggaccaggcgcgaccacacaggacaagatgctgctgcttaatccggcgtccgaggcggcggcggcggcgctggacagcatccggcagcagctcctggaggagccaatggcgccggcgcggccggcgtactgccggagcgcgagcttcggcagcctggtggcggaccagtggagcgagtctctcccgttccggcccaacgacgccgacgacatggtcgtctacggtgccctccgcgacgccttctcctgcggctggctccccgacggctccttcgcggccgtcaagcccgagcccctgccctcccccgactcctacgacggctgctgcctcggcagcttcctcgcgtcgccgcccgggctggacgcgccgtgggcggaggaggccgaggtcgcagcgacggcgtcaagggggaagcacttcagaggcgtgaggcagcggccgtggggcaagttcgcggcggagatccgggacccagccaagaacggcgcgcgcgtgtggctcggcaccttcgacagcgccgaggacgccgctgtggcgtacgaccgcgccgcctaccgcatgcgcggctcccgcgcgctcctcaacttcccgctccgcatcggctcggagatcgccgcagccgcgggtcagaagcgtccgtctccccagccagcgagccccgactctcctcctccctcctccagcgcacccgggtcgtcgaagcggagaaagagaggcgaggccgcagcagagtccatgtccatggctctggtgccgcccccgccggtgcaggctccggtccagctgaccctcccagtccagccgtggctcgccaccggcgccgtccagcagctagtgagctgaagcggcgaaagcaacaagtgatcgttctcatgaccgatggccattagttcttccttcatggcttcatgtgttgagcccatggaggaacagagcatcaagatggcgtcaatggcgtaatgcgtcgctcgaagaaaccttgatcagttggaggcaattacgcgccacgccattgtgaaatttgtgtggctccgtgtgaaacttgtcgctagggttagtggcgttggcacagtagcaagtgggtgcagtggaatcccgaagctggtttgtaagaggtggtgagggtgcaggtgcaaaagttgcacagaccttctcctctccaatggagaatcttctttgttaaaaaaa

SEQ ID NO: 2178 - protein, 271 aa, Triticum aestivum
  G3864,AP2 domain coordinates 127-191
MLLLNPASEAAAAALDSIRQQLLEEPMAPARPAYCRSASFGSLVADQWSESLPFRPNDADDMVVYGALRDAFSCGWLPDGSFAAVKPEPLPSPDSYDGCCLGSFLASPPGLDAPWAEEAEVAATASRGKHFRGVRQRPWGKFAAEIRDPAKNGARVWLGTFDSAEDAAVAYDRAAYRMRGSRALLNFPLRIGSEIAAAAGQKRPSPQPASPDSPPPSSSAPGSSKRRKRGEAAAESMSMALVPPPPVQAPVQLTLPVQPWLATGAVQQLVS

SEQ ID NO: 2179 - DNA, 1098 bp, Triticum aestivum
  G3865,family:AP2
cgctcggcgaatcccaagagcgaactcagatcatcctacgaccagacgcgaccacacaggataagatgctgctgcttaatccggcgtccgaggcggcggcgctggacagcatccggcagcagctcctggaggagccggcgcggccggcgtactgccggagcgcgagcttcggcagcctggtggcggaccagtggagcgagtcgctcccgttccgtcccaacgacgccgacgacatggtcgtctacggcgccctccgcgacgccttctcctgcggctggctccccgacggctccttcgcggccgtcaagcccgagcccctgccctcccccgacggctcctacgacggctcctgcctcggcagcttcctcgcgccgccggcgcccgggccggacgcgccgtgggcggaggaggaggccgaggtcgcggcggcggcgtcgagggggaagcacttcagaggcgtgaggcagcggccgtggggcaagttcgcggcggagatccgggacccggccaagaacggcgcgcgcgtgtggctcggcaccttcgacagcgccgaggacgccgccgtggcctacgaccgcgccgcctaccgcatgcgcggctcccgcgcgctcctcaacttcccgctccgcatcggctccgagatcgccgccgccgccgcagccgcgggccagaagcgtccgtctccccagccggcgagccccgactcttcatctccctcctgcagcgcgcccgggtcgtcgaagaggagaaagagaggcgaggccgcggcagcgtccatggccatggctctggtgccgcccccgccggcgcaggctccggtccagctgaccctcccagcccagccgtggctggccgccggcgccgtccagcagctggtgagctgaagcggcgaagcgaccagtgatcgttctcacttctcacgagcgattagttgcttgatgtgttgagcgacgtgaggaacagagcatcaagatgagatgaatggcgcgtaatgcgtcgctcgaagaaaccttcgatcagttggaagcgattacgcgccaaaaaaaaaaaaaaaaaaaaaaaaaaaaaaaaaaaaaaaaaaaaaaaaaaaaaaaaaaa

SEQ ID NO: 2180 - protein, 272 aa, Triticum aestivum
  G3865,AP2 domain coordinates 125-189
MLLLNPASEAAALDSIRQQLLEEPARPAYCRSASFGSLVADQWSESLPFRPNDADDMVVYGALRDAFSCGWLPDGSFAAVKPEPLPSPDGSYDGSCLGSFLAPPAPGPDAPWAEEEAEVAAAASRGKHFRGVRQRPWGKFAAEIRDPAKNGARVWLGTFDSAEDAAVAYDRAAYRMRGSRALLNFPLRIGSEIAAAAAAAGQKRPSPQPASPDSSSPSCSAPGSSKRRKRGEAAAASMAMALVPPPPAQAPVQLTLPAQPWLAAGAVQQLVS

SEQ ID NO: 2181 - DNA, 1205 bp, Zea mays
  G3866,family:CAAT
cggtccggaattcccgggtcgacccacgcgtccgcgcaccctcccgggccgccttctcttctccagcgtccgatctcccactcccctccctcaccgcagctctcccacctccgccctccccccgcacgcgctcgccacctcgccctcccctccacgttgctcgcacccgcgcttatataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaatggaggtatggaccttttctgcgacagctgctcttacctgaggcgattttttttgtcttagttatttactaagacaccttgcggtgaccattaaagagtaaccaatcgccctcaataggtccgtttttatctgccagaactgatgaggtcgctcactaggagtaagtcgcttccctgggaacggttgtcggctagcaccgctcttgtatgtatattaagagtaacttaatgattggtcttttggctgcgatttgattacatgtatttgtatcgggaggcataaatattgtgtaatttgtgttaaagactggtgtaattgaactatgggaagagctgctttggttgtaaccatattttgatgcccgtatattaggcaaaaatagaaggctgtgggcgtgcacaacaaaaaaaaaaaaaaaaaaaaaaaaagggcggccgctctagaggatcca

SEQ ID NO: 2182 - protein, 185 aa, Zea mays
  G3866,CAAT domain coordinates 30-126
MAEAPASPGGGGGSHESGSPRGGGGGGSVREQDRFLPIANISRIMKKAIPANGKTIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 2183 - DNA, 489 bp, Glycine max
  G3873,family:CAAT
atgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttag

SEQ ID NO: 2184 - protein, 162 aa, Glycine max
  G3873,CAAT domain coordinates 29-118
MSDAPASPCGGGGGGSHESGEHSPRSNFREQDRFLPIANISRIMKKALPPNGKIAKDAKETVQECVSEFISFVTSEASDKCQREKRKTINGDDLLWAMTTLGFEEYIDPLKVYLAAYREIEGDSKGSAKGGDASAKRDVYQSPNGQVAHQGSFSQGVNYTNS

SEQ ID NO: 2185 - DNA, 1109 bp, Glycine max
  G3874,family:CAAT
attcggctcgagataatccagagagaggagagagaagtaaaaaggtggaggaagaagcgaaaagcgagtgagggcagtgttgcttaataaaagaaaacgaacggtggtgataggcttcagtctagatctcaatcgtctccaccttgctttcttctccagcgtccgattctctcaccgatctcgcgccaaatacaaattcgtgtcaacccaacccagggttccggcgagcatggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtaggtatcaagtttattattgaccctcttgttgtaacgtatgttttctacgccagttaccaagtgctcacggcatattgaatgtctttttatgttatgtgaatactgacaggagatgttggttcttgtgtccgtttttttttttaaattaaggtttgtatattatctttggattcgaattattatttgaaagttattattatattgtaaatcctagagccctgttgtctgaatccatcaggcggcttggtaaagaccgagattttaggactgattgtaagcataaatccgaatattcttttcctaatttctttgcacaataatgtatgaagaaggctcgagcttcttttataaaaaaaaaaaaaaag

SEQ ID NO: 2186 - protein, 171 aa, Glycine max
  G3874,CAAT domain coordinates 25-114
MADGPASPGGGSHESGDHSPRSNVREQDRYLPIANISRIMKKALPANGKIAKDAKETVQECVSEFISFITSEASDKCQREKRKTINGDDLLWAMATLGFEDYMDPLKIYLTRYREMEGDTKGSAKGGDSSAKRDVQPSPNAQLAHQGSFSQNVTYPNSQGRHMMVPMQGPE

SEQ ID NO: 2187 - DNA, 818 bp, Glycine max
  G3875,family:CAAT
cttaacatttccctaaacataactcacacacccctcttctctagggtttcaatttcaccatgtttccctttctcaaattagggttccggcgagcatggccgacggtccggcgagtccaggcggcggtagccacgagagcggcgagcacagccctcgctctaacgtgcgcgagcaggacaggtacctccccatcgctaacataagccgcatcatgaagaaggcactacctgcgaacggtaaaatcgccaaggacgccaaagagaccgttcaggaatgcgtatccgagttcatcagtttcatcaccagcgaggcctctgataagtgtcagagggaaaagagaaagactattaacggtgatgatttgctctgggccatggccactcttggttttgaggattatatcgatcctcttaaaatttacctcactagatacagagagatggagggtgatacgaagggttcagccaagggcggagactcatcttctaagaaagatgttcagccaagtcctaatgctcagcttgctcatcaaggttctttctcacaaggtgttagttacacaatttctcagggtcaacatatgatggttccaatgcaaggcccggagtaggtatcaagtttattaaccctcctgttgtaacgtatgttttccacgccagttaccaagtgctcacggcatattgaatgtctttttatgttatgtgaatactgacataggagatggttcttgtgtcctttttttttaaaaaaaaaagtaaggtttgtatattatctttggagtcgaattattatttgaaagttattatattgtaaatcct

SEQ ID NO: 2188 - protein, 171 aa, Glycine max
  G3875,CAAT domain coordinates 25-114
MADGPASPGGGSHESGEHSPRSNVREQDRYLPIANISRIMKKALPANGKIAKDAKETVQECVSEFISFITSEASDKCQREKRKTINGDDLLWAMATLGFEDYIDPLKIYLTRYREMEGDTKGSAKGGDSSSKKDVQPSPNAQLAHQGSFSQGVSYTISQGQHMMVPMQGPE

SEQ ID NO: 2189 - DNA, 557 bp, Zea mays
  G3876,family:CAAT
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 2190 - protein, 178 aa, Zea mays
  G3876,CAAT domain coordinates 30-119
MAEAPASPGGGGGSHESGSPRGGGGGGSVREQDRFLPIANISRIMKKAIPANGKIAKDAKETVQECVSEFISFITSEASDKCQREKRKTINGDDLLWAMATLGFEDYIEPLKVYLQKYREMEGDSKLTAKSSDGSIKKDALGHVGASSSAAQGMGQQGAYNQGMGYMQPQYHNGDISN

SEQ ID NO: 2191 - DNA, 719 bp, Gossypium raimondii
  G3883,family:CAAT
gttcaccagccaatggacagtaaccagcaaactcaatccaccccatacccacctcagcctcccacatccgccattacccctccttcatccgccacagcaacagcgcctcctttccaccacctccttcaacaacaacagcaacagctccaaatgttttggtcataccaacgccaagaaatcgagcaagttaacgattttaagaaccaccaactcccattagctcgcattaagaagataatgaaagccgacgaagacgtccgtatgatctccgccgaggctcccattctcttcgccaaagcttgtgagcttttcattttggaactcactatccgttcttggcttcacgccgaggaaaacaagcgacggacacttcagaaaaacgacatcgctgcggctattacgaggaccgacattttcgatttcttggtagatattgtgcctagggatgagatcaaggatgaaactgctttggctccgatggtcggtgctaccgccagtggggtaccttacttttatccccctatgggtcaacctgctggtggtggtcctggtgggatgatgattggccggcctgccgtcgatcccaccggagttatttacggtcagccaccttctcaggcttggcagagtgtttggcagacggcggggactgatgatggctcgtatggcagtggagttaccggtggtcaagggaatcttgacggtcaaggctaacctaa

SEQ ID NO: 2192 - protein, 233 aa, Gossypium raimondii
  G3883,CAAT domain coordinates 54-150
MDSNQQTQSTPYPPQPPTSAITPPSSATATAPPFHHLLQQQQQQLQMFWSYQRQEIEQVNDFKNHQLPLARIKKIMKADEDVRMISAEAPILFAKACELFILELTIRSWLHAEENKRRTLQKNDIAAAITRTDIFDFLVDIVPRDEIKDETALAPMVGATASGVPYFYPPMGQPAGGGPGGMMIGRPAVDPTGVIYGQPPSQAWQSVWQTAGTDDGSYGSGVTGGQGNLDGQG

SEQ ID NO: 2193 - DNA, 929 bp, Nicotiana benthamiana
  G3884,family:CAAT
taaaatagaaaaaatcgccggtgaaccacctcgtctaaaacgccaatggaaaacaatcagcaatcggcggcgaatgcagcggcggcggcagcagcagcagctgcatatccagcgcagccaccgtaccaccatctccttcagcaacagcaacagcagctccagatgttctggacctaccagcgccaagaaatcgaacaggttaacgatttcaagaaccaccaacttcctcttgcccgaatcaagaagatcatgaaagctgacgaggatgtccgcatgatctccgctgaagctcccattttattcgccaaagcgtgtgagcttttcattctggaactcactattcgttcctggcttcacgctgaggaaaacaagcgtcgaactttacaaaagaacgacatagctgcagcgattacgcggactgacatttttgatttccttgttgacattgttccgagggatgagatcaaggaagagggtggtgttggtcttgggcctgctgggattgtgggctccacagctagtggtgtgccttactattacccaccaatgggccagcctgctccaccgggtgtgatgatgggcaggcctgctatgcctggggttgatccttcaatgtacgttcagccaccgccgtcgcaggcgtggcagtccgtttggcagactgctgaggataattcctatgcaagtggaggcagcagtggacagggtaaccttgatggtcaaagttaatgatcatgtttgctgctgatccagtcgctttgtggcacaaaggaagctattagttactaatggtacatgtccacaaatgtgaatgatccttattgctagtgtccatgaatactagcttaactgtaatgacttgaatcctttagtcgtcttgtttgtataaaactgtttagtttatcagaatgctggtggatttctggttt

SEQ ID NO: 2194 - protein, 227 aa, Nicotiana benthamiana
  G3884,CAAT domain coordinates 47-143
MENNQQSAANAAAAAAAAAAYPAQPPYHHLLQQQQQQLQMFWTYQRQEIEQVNDFKNHQLPLARIKKIMKADEDVRMISAEAPILFAKACELFILELTIRSWLHAEENKRRTLQKNDIAAAITRTDIFDFLVDIVPRDEIKEEGGVGLGPAGIVGSTASGVPYYYPPMGQPAPPGVMMGRPAMPGVDPSMYVQPPPSQAWQSVWQTAEDNSYASGGSSGQGNLDGQS

SEQ ID NO: 2195 - DNA, 910 bp, Solanum tuberosum
  G3885,family:CAAT
cacagatagtagcttccattttccgcaaaccgccatggacaacaaccctcaccaatctccgactgaggccgccgccgcggcagcagcagcggcagcggcggctcagtcagccacatatccaccgcagactccataccaccatctccttcaacaacaacagcaacagcttcagatgttttggacttaccagcgtcaagaaatcgagcaagtcaatgatttcaaaaaccaccaacttccccttgctcgtatcaaaaagatcatgaaagctgatgaagatgttcgtatgatctctgctgaagctccggttctgtttgcgaaagcctgtgaacttttcattctggagctcaccatccgttcttggcttcacgctgaggaaaacaagcgcaggactctacagaagaatgacatcgctgcggcgattactcgtactgatatttttgattttctggttgacatcgttcctagggatgagattaaggatgagggtgttgtgcttggacccggaattgtgggttctactgctagtggtgtgccgtactattaccctccgatgggccagccggctccgggtggggtgatgcttggtaggcctgctgttcctggggttgatccgtcaatgtatgtgcaccctccgccatcacaggcgtggcaatctgtgtggcagactggagacgataattcctatgctagtggaggtagcagtggacagggtaaccttgatggccaaatttaaaagatctcgctgctgccggtttggaggcttaacagcacatgtgaaactaatggttatgatagtgaaatgtaatttcttctctcaaatgtgaatccaccttttatggcttctgtccatggatactgtttaactgtaaccgacttgaatctttgtctgtataaaacttgacttttgtgt

SEQ ID NO: 2196 - protein, 232 aa, Solanum tuberosum
  G3885,CAAT domain coordinates 54-150
MDNNPHQSPTEAAAAAAAAAAAAQSATYPPQTPYHHLLQQQQQQLQMFWTYQRQEIEQVNDFKNHQLPLARIKKIMKADEDVRMISAEAPVLFAKACELFILELTIRSWLHAEENKRRTLQKNDIAAAITRTDIFDFLVDIVPRDEIKDEGVVLGPGIVGSTASGVPYYYPPMGQPAPGGVMLGRPAVPGVDPSMYVHPPPSQAWQSVWQTGDDNSYASGGSSGQGNLDGQI

SEQ ID NO: 2197 - DNA, 750 bp, Glycine max
  G3886,family:CAAT
attgggggaatggagaccaacaaccagcaacaacaacaacaaggagctcaagcccaatcgggaccctaccccgtcgccggcgccggcggcagtgcaggtgcaggtgcaggcgctcctccccctttccagcaccttctccagcagcagcagcagcagctccagatgttctggtcttaccagcgtcaagaaatcgagcacgtgaacgactttaagaatcaccagctccctcttgcccgcatcaagaagatcatgaaggccgacgaggatgtccgcatgatctccgccgaggcccccatcctcttcgccaaggcctgcgagctcttcatcctcgagctcaccatccgctcctggctccacgccgaggagaacaagcgccgcaccctccagaagaacgacatcgccgccgccatcacccgcaccgacattttcgacttcctcgttgatattgtcccccgcgacgagatcaaggacgacgctgctcttgtgggggccaccgccagtggggtgccttactactacccgcccattggacagcctgccgggatgatgattggccgccccgccgtcgatcccgccaccggggtttatgtccagccgccctcccaggcatggcagtccgtctggcagtccgctgccgaggacgcttcctatggcaccggcggggccggtgcccagcggagccttgatggccagagttgagtgacatcgatgccgatgatggacagtcaggagttatgaagattctgaact

SEQ ID NO: 2198 - protein, 229 aa, Glycine max
  G3886,CAAT domain coordinates 59-155
METNNQQQQQQGAQAQSGPYPVAGAGGSAGAGAGAPPPFQHLLQQQQQQLQMFWSYQRQEIEHVNDFKNHQLPLARIKKIMKADEDVRMISAEAPILFAKACELFILELTIRSWLHAEENKRRTLQKNDIAAAITRTDIFDFLVDIVPRDEIKDDAALVGATASGVPYYYPPIGQPAGMMIGRPAVDPATGVYVQPPSQAWQSVWQSAAEDASYGTGGAGAQRSLDGQS

SEQ ID NO: 2199 - DNA, 760 bp, Zea mays
  G3889,family:CAAT
cccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtga

SEQ ID NO: 2200 - protein, 244 aa, Zea mays
  G3889,CAAT domain coordinates 54-152
MDNQPLPYSTGQPPAPGGAPVAGMPGAAGLPPVPHHHLLQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAPGTGVVGAGAPGGAPAAGMPYYYPPMGQPAPMMPAWHVPAWDPAWQQGAADVDQSGSFSEEGQGFGAGHGGAASFPPAPPTSE

SEQ ID NO: 2201 - DNA, 881 bp, Solanum tuberosum
  G3892,family:CAAT
ctctttgattgaaccctagctctcactctctctttctctctctaaaaaaagcataaaagtttcaatctttcaggtaatttgattggagaggcgaatccagattttggagcttcaatcagtgggagcccacagcctaaggtagccttgaattctccaaaagggaatcttgctcaaaatggatcatcatggaaatggacagcctccagtttcagctggtgcaattcaatctcctcaagcagctggtctttctgcttcgtcagcccagatggcacaacatcagctcgcttatcagcacattcatcagcagcagcagcaacaattgcagcaacaactccaaactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgactctgcgtgcatggaaccacactgaggagaacaaaaggaggacgctgcagaaaaatgatatcgctgcagccataactaggactgacatatttgatttcttagttgacattgtcccaagggaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgttgatcaagcactttatgcccagcagccccgtccatttatggctcagccaatttggccccagcagcaacaaccaccctcagattcttaagcagctcaaagct

SEQ ID NO: 2202 - protein, 230 aa, Solanum tuberosum
  G3892,CAAT domain coordinates 62-158
MDHHGNGQPPVSAGAIQSPQAAGLSASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPVDQALYAQQPRPFMAQPIWPQQQQPPSDS

SEQ ID NO: 2203 - DNA, 971 bp, Solanum tuberosum
  G3893,family:CAAT
gatcaatatatcaatcatctacctcttcgattgaaccctagctctcactctctttctctctctaaaaaaagcataaaagtttcaatctttcaggtaatttgattggagaggcgaatccagaatttggagcttcaatcagtgggagcccacagcctaaggtagccttgaattctccaaaagggaatcttgctcaaaatggatcatcatggaaatggacagcctccaggtattggagtcgttactagctcagctccaatatatggtgctccataccaagctaaccaaatggcagggcctcctgcagtttcagctggtgcaattcaatctcctcaagcagctggtctttctgcttcgtcagcccagatggcacaacatcagctcgcttatcagcacattcatcagcagcagcagcaacaattgcagcaacaactccaaactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgactctgcgtgcatggaaccacactgaggagaacaaaaggaggacgctgcagaaaaatgatatcgctgcagccataacaaggactgacatatttgatttcttagttgatattgtcccaagggaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgtttgatcagctctttatgcccagcagccccgtccatatatggctcagccaatttggccccagcagccacaaccaccctcagaatcttaagcagc

SEQ ID NO: 2204 - protein, 228 aa, Solanum tuberosum
  G3893,CAAT domain coordinates 88-184
MDHHGNGQPPGIGVVTSSAPIYGAPYQANQMAGPPAVSAGAIQSPQAAGLSASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPV

SEQ ID NO: 2205 - DNA, 1221 bp, Solanum lycopersicum
  G3894,family:CAAT
tatcaatcatctacctctttgattgaaccctagctctcactctctctttctctctctaaaaaaaaagcataaaagtttcaatctttcaggtaatttgattggagaggcgtatccagaatttggagcttcaatcagtggggagcctaagttagctttggattctccaaaagggaatcttgctcaaaatggatcaacatggaaatggacagcctccaggtattggagtcgttactagctcagctccaatatatggtgctccataccaagctaaccaaatggcagggccctctcctcctgcagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgtcgatcaagctctgtatgcccagcagccccgcccatatatggcacagccaatttggccccagcagcagcaaccaccctcagattcttaagcagctcaaagcttagattacaggaatccagaagctaggagcagtgagtagtctgagtagcgaagtactggagaacacatagcagtctgcatactttgaactttattttaatatatatcgacatgaagcactagttattaaaagtcgagtgttcccttagtgtagctaaaactttacaccatgagcttgatgttcttggtgatgtttatgaacaaatatgtttttaagtgtgtgatttaaaagtaaaaaaaaaaaaaaa

SEQ ID NO: 2206 - protein, 258 aa, Solanum lycopersicum
  G3894,CAAT domain coordinates 90-186
MDQHGNGQPPGIGVVTSSAPIYGAPYQANQMAGPSPPAVSAGAIQSPQAAGLAASSAQMAQHQLAYQHIHQQQQQQLQQQLQTFWANQYQEIEHVTDFKNHSLPLARIKKIMKADEDVRMISAEAPVVFARACEMFILELTLRAWNHTEENKRRTLQKNDIAAAITRTDIFDFLVDIVPREDLKDEVLATIPRGTLPVGGPTEGLPFYYGMPPQSAQPIGAPGMYMGKPVDQALYAQQPRPYMAQPIWPQQQQPPSDS

SEQ ID NO: 2207 - DNA, 921 bp, Medicago truncatula
  G3896,family:CAAT
ttcgcacttttgtctctcagaggctctcagttttcgtggaaccaagcttcgttttttgagggaagaatggaccatcaagggcataaccagaatccgcaaatgggggttgtcggtagtggcagtcaaatgccatacggatctaacccatatcaatcaaaccaaatgactggggccccaggatcagttgttacatcagttgggggcatgcagtccactggtcaacctgctggagctcagctgggtcagcatcaacttgcttaccagcatatccatcagcagcaacagcagcaacttcagcaacagctgcaatccttctggtcaaaccagtaccaggaaatcgaaaaggttactgatttcaagaaccacagccttcctctggcaaggatcaagaagatcatgaaggctgatgaggatgttagaatgatatcagctgaagcacctgtcatatttgcaagggcctgtgagatgttcatattggagttaaccctgcgctcatggaaccacactgaggagaacaaaaggaggacacttcagaagaatgatattgctgctgcaatcactaggactgatatctttgatttcctggttgacattgtgcctcgtgaggacctgaaagatgaagtgctggcttcaattccaagaggaacaatgcctgttgctgggcctgctgatgctcttccttactgctacatgccacctcagcatgcctcccaagttggaactgctggtgtcataatgggcaagcctgtgatggacccaaacatgtatgctcagcagccccatccctacatggcaccacaaatgtggccacagcctccggaacagcgaccaccatctccagatcactagatgctgagatgtggatgttaaggtaaacttttgactctctctctttagttagttgtagagagtttgagttaa

SEQ ID NO: 2208 - protein, 260 aa, Medicago truncatula
  G3896,CAAT domain coordinates 89-185
MDHQGHNQNPQMGVVGSGSQMPYGSNPYQSNQMTGAPGSVVTSVGGMQSTGQPAGAQLGQHQLAYQHIHQQQQQQLQQQLQSFWSNQYQEIEKVTDFKNHSLPLARIKKIMKADEDVRMISAEAPVIFARACEMFILELTLRSWNHTEENKRRTLQKNDIAAAITRTDIFDFLVDIVPREDLKDEVLASIPRGTMPVAGPADALPYCYMPPQHASQVGTAGVIMGKPVMDPNMYAQQPHPYMAPQMWPQPPEQRPPSPDH

SEQ ID NO: 2209 - DNA, 1167 bp, Daucus carota
  G3899,family:CAAT
ctctcctagtcctttgtctctatctctcagtctttactgctgctcagtctttcctatatataacaagaaaattgtatgtatattagtttcacagcttcagacttcagagcttctcctctgcaaattccattcaggaatatttaagtgaaggccagtaggaactcaatggacgaatcagaagaacctcagcaacaacaggaagccgtaatagacagtgctagtcagatgacttatggtgtgcctcattaccatgctgttggactaggagttgcaactggtacgcctgtggtaccagtgtctgcaccaactcagcatccaactggcactacttctcagcagcagcctgaatactacgaggcgcaacatgtctaccagcaacagcagctgcaactacggactcagctacaggcattctgggctaaccagatacaggaaattggacagacacccgacttcaagaatcatagccttccccttgctcgcataaaaaagattatgaaagctgatgaagatgtgaggatgatttcatccgaggcgcctgtcatatttgcgaaggcctgtgagatgttcatcttggagctgactatgcgttcttggttacttaccgaggagaacaaaaggagaacgctgcagaagaatgacattgctgctgcaatatcaagaactgatatttttgattttctggttgatatcatcccaagagatgagttgaaggaagaaggacttggtatcaccaaggctacaattccgctgctgggttcacctgctgattctgcaccatactactatgttccgcagcagcatgccgtggaacaagcagggttctatcctgatcagcaggcccacccgcagctaccatatatgtcgtggcagcagccccatgaacataaagatcaggaggaaaatggagattgatatcattgctgagtaattttatggatctatcgtggtacctttgtattttgttgatgttcatgatggatctctgtagctttaatcagtggtctagtagtatggtatcgtactctaaactatgcaactttaagttttgagcaggacaaggtgaaactgcctaatgggttgcacctagcctcttttgtggttgctcccttcccatgcatattttaaggtcatttgacagagtaatttggtttcaatgtttgtgtc

SEQ ID NO: 2210 - protein, 249 aa, Daucus carota
  G3899,CAAT domain coordinates 89-185
MDESEEPQQQQEAVIDSASQMTYGVPHYHAVGLGVATGTPVVPVSAPTQHPTGTTSQQQPEYYEAQHVYQQQQLQLRTQLQAFWANQIQEIGQTPDFKNHSLPLARIKKIMKADEDVRMISSEAPVIFAKACEMFILELTMRSWLLTEENKRRTLQKNDIAAAISRTDIFDFLVDIIPRDELKEEGLGITKATIPLLGSPADSAPYYYVPQQHAVEQAGFYPDQQAHPQLPYMSWQQPHEHKDQEENGD

SEQ ID NO: 2211 - DNA, 917 bp, Daucus carota
  G3900,family:CAAT
ctctgctcctcgtaacctcggctaattgttcttcatggatcactctgaggaatctcagcagcaacaggaggaggtgattgatattgcatacggtatgcctcaataccatgctggaccaggagttgccactgggacacctgttgtgcccgtttccgcagcaactcaggcgcaacatttctttcagcaaaagctgcagctgcagcaacaggatcagcttcaggcgttttgggctaaccaaatgcaggaaattgaacagaccacagacttcaaaaaccatagccttccgcttgctcgcattaagaagataatgaaagctgatgaagatgtgaggatgatttcgtccgaggcccctgttgtatttgccaaggcgtgcgagatgttcatcatggatctgactatgcgttcttggtctcacaccgaggagaacaaaaggaggacgctgcagaagaatgacattgcagcagcagtttcaaggactgatgtctttgattttcttgttgatatcatcccgaaggacgagatgaaggaggacacaagggcttcaatcccgctgatgggtcaacctcccgctgattctgttccatattactatgttcctcagcagcatgcagcaggacaagcagggttttatcctgatcagcatcagcagcaaccactgccatatatgcagtggcagcagccccaacaagaccaaaatcagcaacagcaggagaatggcaactgagaatctgtcttgaatctgtattgttctgctgtgattactagcgtttagtatatagttggtgttttagaagagtctgtgtaggttccagtcagtggtcaagtagtgtgatgatgggagcttgaactatgcaatatatttgcaggacataatgtaattgtataataagaccattctagggtaatgttttctgttt

SEQ ID NO: 2212 - protein, 229 aa, Daucus carota
  G3900,CAAT domain coordinates 70-166
MDHSEESQQQQEEVIDIAYGMPQYHAGPGVATGTPVVPVSAATQAQHFFQQKLQLQQQDQLQAFWANQMQEIEQTTDFKNHSLPLARIKKIMKADEDVRMISSEAPVVFAKACEMFIMDLTMRSWSHTEENKRRTLQKNDIAAAVSRTDVFDFLVDIIPKDEMKEDTRASIPLMGQPPADSVPYYYVPQQHAAGQAGFYPDQHQQQPLPYMQWQQPQQDQNQQQQENGN

SEQ ID NO: 2213 - DNA, 841 bp, Gossypium arboreum
  G3907,family:CAAT
ttctttttcttttttattggttcttgagaagattcaactgctgaagggaagatagatcaaaggttggaataaattagtggcattcaagtgtttggttatctgctttattttcttttcaaggtgtggggtaatgagaagatagaagaagatcaaaggcttcttttgtaaatcatggatcaacgggaaaaaacacagcagcagcagcaacagcctgtgatgggagttgtacctggtgctgggcagatgggctattctactgcttaccaaactgcttccatggtcgcttctggcactacaggagtagctgtccctatacaaactcagccttctgctactttctctagttctccacatcagcttgcctaccaacaagctcagcacttccaccaccaacagcagcagcaacaacagcagcagcttcaaatgttctgggctaaccaaatgcatgaaattgagcaaacaacagacttcaagaatcacagtctcccacttgctcggataaaaaagataatgaaagcagatgaagatgtgcggatgatatcagcagaggctcctgtaatttttgcgaaagcttgcgaaatgttcgtcttggaactgactttacgctcttggatccatacagaagagaacaaaaggaggacactacagaagaatgatatagcagccgctatttcgaggactgatgtctttgatttcttggttgatattattccagggactgagtgaagaagaagacttgggtcaccaagcactattccttagttggtccctgctgaattcctatactatgccacagcacctgtggatcctaggatgatatggaagcccatgtcagctgctt

SEQ ID NO: 2214 - protein, 184 aa, Gossypium arboreum
  G3907,CAAT domain coordinates 92-184
MDQREKTQQQQQQPVMGVVPGAGQMGYSTAYQTASMVASGTTGVAVPIQTQPSATFSSSPHQLAYQQAQHFHHQQQQQQQQQLQMFWANQMHEIEQTTDFKNHSLPLARIKKIMKADEDVRMISAEAPVIFAKACEMFVLELTLRSWIHTEENKRRTLQKNDIAAAISRTDVFDFLVDIIPGTE

SEQ ID NO: 2215 - DNA, 865 bp, Zea mays
  G3909,family:CAAT
ccctgaccgccgtaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaaggacgccgactccgccgccatgggagcagccgggatcccgcaccccgccgccggcctgcccgccgccgatcccatgggctactactacgtccagccgccgcagtaacgaatttgcttccttatcatggcttcgcttccatgcagcctttgcgggttttagtaaactattattattactgagagtgccctgttgttacccatgctctgttgttgccacccaataactcgatgacctgatgatcatctgatgtgccccccgttccgtaacaagtgattccatttctgatttcagagaaaaaaaaaaaaaaaaaaaaaaaaaaaaaaaaaaaaaaaaaaaaa

SEQ ID NO: 2216 - protein, 201 aa, Zea mays
  G3909,CAAT domain coordinates 73-170
MEPKSTTPPPPPVMGAPIAYPPPPGAAYPAGPYVHAPAAALYPPPPLPPAPPSSQQGAAAAHQQQLFWAEQYREIEATTDFKNHNLPLARIKKIMKADEDVRMIAAEAPVVFSRACEMFILELTHRGWAHAEENKRRTLQKSDIAAAVARTEVFDFLVDIVPRDEAKDADSAAMGAAGIPHPAAGLPAADPMGYYYVQPPQ

SEQ ID NO: 2217 - DNA, 1446 bp, Zea mays
  G3911,family:CAAT
accacacgtccgcccacgcgtccgcctacgcgtcggcggactcgcgtgcccccacgcgggcgggcttggcttgggactgggccgcccggccgcgaggaataaactcactcctgccttcatacgtatccatagccgcggcagtacgtgtatgtggttagctatacgcgacctcagctcgggcgcaagctacaacgccgaccaggcgagaagaagcatcgatagtgtgacgagctaacccaccagcagcaacgtaatccaaatccatggacaaccagccgctgccctactccacaggccagccccctgcccccggaggagccccggtggcgggcatgcctggcgcggccggcctcccacccgtgccgcaccacctacccgttccatctcaagtgaaagagatgacaactgtcctaacaaacaaactagggctcaaaactaacttcaaaaaaatcacccactaaaagcaccttcctcttcctcttcctccgcccccaatccccctcgtctcacaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaatgtatcatcatcacgttattgttccgtctatgtgcctgagcaataatgtatcatcattgccttattgttccggggcagttgtgttatttgtgtctgtttagttgctgctgctgttaccgcgtaatagcatatgtgttatctgtgtctgtttagttgctgctgctgttgccgcgtaataaaacttggtcatttacggggctccctcaagattaagaattgagttgtttgatggtagaatcctggtaaggttgttgtaactggggggcgcctttgtttgggctggtagtgtatgcctaggcctcacttatctg

SEQ ID NO: 2218 - protein, 200 aa, Zea mays
  G3911,CAAT domain coordinates 70-167
MDPNKSSTPPPPPVMGAPVAYPPPAYPPGVAAGAGAYPPQLYAPPAAAAAQQAAAAQQQQLQIFWAEQYREIEATTDFKNHNLPLARIKKIMKADEDVRMIAAEAPVVFARACEMFILELTHRGWAHAEENKRRTLQKSDIAAAIARTEVFDFLVDIVPRDDGKDADAAAAAAAAAAGIPRPAAGVPATDPLAYYYVPQQ

SEQ ID NO: 2219 - DNA, 2469 bp, Oryza sativa
  G3917,family:TH
atggccatttattacctggaaagggagggattaacccacaacatgccaatgcatggccatttttatactcctctgcccctgaaccattggcacgcggataccaccaacgcggctgacatgacacgtgggcccatgcgcatgtgggccccacatgtcagtggcatgaattttatatttttcatctcaaaagaaaaggtattgatgagagtagaaatggtgagctctcctgatgtactgatcattccatcacctccattccccagtggtaacactcgtgggggaggaggaggaggaggaggtagtagcatgcagcagcagcagccagggggaggagggggaggggtgcagcagttcggcgcggtggcgccggagatgtcgccattctcgccggcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcgggggggaaccggtggccgcggcaggagacgctggcgctgctcaagatccggtcggacatggacgccgcgttccgggacgccaccctcaagggcccgctctgggaggaggtctccaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggctgtgggggtgtccggcggggtgcgcgcccccgccgagccgccgcccgcggtggtgatggggaacgtgatgagcttctcgacgtcgaacacggaggagtattccgacgaggaggactccgacgacgaggggaccgaggacatgggcggcggcggcggtgatgagagggggaagaggaagaggttgtcggagggtggcgccgccgcgggcgtcggtggcggcggcggaggaggaggagggagcgggaagatgatgaggttcttcgaggggttgatgaagcagaagatcaccgggcagaccatcccaatgccgcccatcatcgccgcccccgccatcaccgtcatgcccccaccggcgccatcccagcagcctcagccgccgccaccgccgtctcaccccacccccatcacctccgtcgcgccagctccgccgccgccgccaccagcagcagcagcagcagcagcatcccagccatcgccgcaggccaccaagtcgccattgccggcgacgccgcagacgcaaagcagcatggacattgtcatgacggccgccgaggcgcacgacgcggggtacgacgggtccggcggcggcggggggcagccgtcgtcgtcgcggtggcccaaggcggaggtgcacgcgctgatccagctgcggagcaacctggacaaccggtaccaggaggccgggccgaagggcccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctccgcggccgccggcggcaacccgcccggcaccgccgcccccgccacggcggcggccgcaacgacgaccaccggatctttcttggcaatggtccagtga

SEQ ID NO: 2220 - protein, 822 aa, Oryza sativa
  G3917,TH domain coordinates 192-282,508-601
MAIYYLEREGLTHNMPMHGHFYTPLPLNHWHADTTNAADMTRGPMRMWAPHVSGMNFIFFISKEKVLMRVEMVSSPDVLIIPSPPFPSGNTRGGGGGGGGSSMQQQQPGGGGGGVQQFGAVAPEMSPFSPAGGGGGGRISMAEAASPISSRPPPAQQQFDELGVGGGGGGGGGFDAEALAAAAVGEEGASGGAGGNRWPRQETLALLKIRSDMDAAFRDATLKGPLWEEVSRKLAEEGYRRSAKKCKEKFENVHKYYKRTKESRAGRNDGKTYRFFTQLEALHGTAAGVVAAPSPVTSLAPPPATAVGVSGGVRAPAEPPPAVVMGNVMSFSTSNTEEYSDEEDSDDEGTEDMGGGGGDERGKRKRLSEGGAAAGVGGGGGGGGGSGKMMRFFEGLMKQKITGQTIPMPPIIAAPAITVMPPPAPSQQPQPPPPPSHPTPITSVAPAPPPPPPAAAAAAASQPSPQATKSPLPATPQTQSSMDIVMTAAEAHDAGYDGSGGGGGQPSSSRWPKAEVHALIQLRSNLDNRYQEAGPKGPLWEEISAGMRRLGYSRSSKRCKEKWENINKYFKKVKESNKKRPEDSKTCPYFHQLDALYRNKAALNSSSSSAAAAAPALPPPEHAEPAVTVAAPISQTPPPPPPQPVTTTKNGNGTSSTNGANGEGGGGGSGGMQMQASNGSVVAGNKFFTGAAAKKPEDIMKEMMEQRPQQPAAANNAFNRTDGGGGGGGVDSDNMDEDDEDDYDDDDDDDDDDVDGNKMQYEIQFQHQHHHQQPPQHRHQQSVVRPNAAASAAAGGNPPGTAAPATAAAATTTTGSFLAMVQ

SEQ ID NO: 2221 - DNA, 956 bp, Glycine max
  G3920,family:CAAT
agttggtgctaagatgccagggaaacctgacactgatgattggcgtgtagagcgtggggagcagattcagtttcagtcttccatttactctcatcatcagccttggtggcgcggagtgggggaaaatgcctccaaatcatcttcagatgatcagttaaatggttcaatcgtgaatggtatcacgcggtctgagaccaatgataagtcaggcggaggtgttgccaaagaataccaaaacatcaaacatgccatgttgtcaaccccatttaccatggagaaacatcttgctccaaatccccagatggaacttgttggtcattcagttgttttaacatctccttattcagatgcacagtatggtcaaatcttgactacttacgggcaacaagttatgataaatcctcagttgtatggaatgcatcatgctagaatgcctttgccacttgaaatggaagaggagcctgtttatgtcaatgcgaagcagtatcatggtattttgaggcgaagacagtcacgtgctaaggctgagattgaaaagaaagtaatcaaaaacaggaagccatacctccatgaatcccgtcaccttcatgcaatgagaagggcaagaggcaacggtggtcgctttctcaacacaaagaagcttgaaaataacaattctaattccacttcagacaaaggcaacaatactcgtgcaaacgcctcaacaaactcgcctaacactcaacttttgttcaccaacaatttgaatctaggctcatcaaatgtttcacaagccacagttcagcacatgcacacagagcagagtttcactataggttaccataatggaaatggtcttacagcactataccgttcacaagcaaatgggaaaaaggagggaaactgctttggtaaagagagggaccctaatggggatttcaaataacacttccctcagccatacagcaagagttagg

SEQ ID NO: 2222 - protein, 303 aa, Glycine max
  G3920,CAAT domain coordinates 149-208
MPGKPDTDDWRVERGEQIQFQSSIYSHHQPWWRGVGENASKSSSDDQLNGSIVNGITRSETNDKSGGGVAKEYQNIKHAMLSTPFTMEKHLAPNPQMELVGHSVVLTSPYSDAQYGQILTTYGQQVMINPQLYGMHHARMPLPLEMEEEPVYVNAKQYHGILRRRQSRAKAEIEKKVIKNRKPYLHESRHLHAMRRARGNGGRFLNTKKLENNNSNSTSDKGNNTRANASTNSPNTQLLFTNNLNLGSSNVSQATVQHMHTEQSFTIGYHNGNGLTALYRSQANGKKEGNCFGKERDPNGDFK

SEQ ID NO: 2223 - DNA, 885 bp, Zea mays
  G3921,family:CAAT
atggaggatcattctgtccatcccatgtctaagtctaaccatggctccttgtcaggaaatggttatgagatgaaacatccaggccatgaagtttgcgatagggattcatcatcggagtctgatcggtctcaccaagaagcatcagcagcgagtgaaagcagtccagatgaacacacatcaactcaatcagacaatgatgaagatcatgggaaggataatcaggacacattgaagccagtattgtccttggggaaggaaggctctgccactggggccccaaaattacattacagcccatcttttgcttgtattccttatactgctgacgcttactatggtgccgttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaggtcggaagccataccttcatgagtcccgacatcgtcatgccatgaaacgggcccgtggctcaggagggcggttcctcaacacaaagcagctccaggaccaaaaccagcagtttcaggaagcgtcgagtggttcaatgtgctcaaagatcattggcaacagcataatctcccaaagtggccccacctgcacgccctcttctggcactgcaggtgcttcaacagccagccaggaccgcagctgcttgccctcagttggcttccgccccacaaccaacttcagtgaccaaggtcgaggaggcttgaagctggccgtgatcggcatgcagcagcgtgtttccaccataaggtga

SEQ ID NO: 2224 - protein, 294 aa, Zea mays
  G3921,CAAT domain coordinates 148-207
MEDHSVHPMSKSNHGSLSGNGYEMKHPGHEVCDRDSSSESDRSHQEASAASESSPDEHTSTQSDNDEDHGKDNQDTLKPVLSLGKEGSATGAPKLHYSPSFACIPYTADAYYGAVGVLTGYPPHAIVHPQQNDTTNTPGMLPVEPAEEPIYVNAKQYHAILRRRQTRAKLEAQNKMVKGRKPYLHESRHRHAMKRARGSGGRFLNTKQLQDQNQQFQEASSGSMCSKIIGNSIISQSGPTCTPSSGTAGASTASQDRSCLPSVGFRPTTNFSDQGRGGLKLAVIGMQQRVSTIR

SEQ ID NO: 2225 - DNA, 1959 bp, Oryza sativa
  G3924,family:CAAT
gactggatcctgattggcgttgcggccaatcaggatcctgctggatcctgattggatcctgattggcgttgcggccgtgtctctactgttgttgttgttgtgttttttttttcttttttacctttttttgccgccttggttttgatgcggagtctggatgtttctacttttggatggggtttttttaccttacccgaccgaattcgtgggtggattggatgcggttcatggaagggaacgggatcttggtcggctactcggatggggggtttgccggccggttgggatttcgggaaccggatcgaggaagaggcggaggagaattgatccgcggcggcggcggcggaggaggaggagagaatatgtggtgattttcatctgagcccggttgcagaagtccaactgtatcggagaatcttactcggttcgtactacagtcccccacgctggtattcaaggaatcttctctggatggaccagttcttggttggtcccggttctttcatgtccagttccccatggtggttcagttggcagttgtgccctagttgttgtaggagtaattgtcggtggctttaaatggttcatgctcgtcagttcttccgagcattccgaggtgagcgagcatggagtcgaggccggggggaaccaacctcgtggagccgagggggcagggcgcgctgccgtccggcataccgatccagcagccgtggtggacgacctccgccggggtcggggcggtgtcgcccgccgtcgtggcgccggggagcggtgcggggatcagcctgtcgggcagggatggcggcggcgacgacgcggcagaggagagcagcgatgactcacgaagatcaggggagaccaaagatggaagcactgatcaagaaaagcatcatgcaacatcgcagatgactgctttggcatcagactatttaacaccattttcacagctggaactaaaccaaccaattgcttcggcagcataccagtaccctgactcttactatatgggcatggttggtccctatggacctcaagctatgtccgcacagactcatttccagctacctggattaactcactctcgtatgccgttgcctcttgaaatatctgaggagcctgtttatgtaaatgctaagcaatatcatggaattttaagacggaggcagtcacgtgcgaaggctgaacttgagaaaaaagttgttaaatcaagaaagccctatcttcatgagtctcgtcatcaacatgctatgcgaagggcaagaggaacgggtggacgcttcctgaacacaaagaaaaatgaagatggtgctcccagtgagaaagccgaaccaaacaaaggagagcagaactccgggtatcgccggatccctcctgacttacagctcctacagaaggaaacatgaagtagcggctcgaaacctagaacagtggcttctgtccaccggcattcactcttgagggtggattcttgctccagaattgtgctgccatctttcaaatgatcttcatcgtgcaaagtaattatatgtacattcctctgaatgatctatgcaccaattgttgatcctggcagggtaataatctggatgtattgagtccatcacagtgcgaatgtcacgggtagatctgctgttttcaggcaattcattcttggctttctatcccacccgttgttgttgcaagttaagctagcagtacttgtctcagtgtccgtgagacgtttgtgtaagattaggttaaactagaagttgtaatgctgtattaagtgtttgtatttctaatatgaaccgtaacaaggccagagcagaactcgttatacatacaaaaattgatggccaggtcagtgttaccgtattattatgcaatggcagaagcttgcataaggcgtggtgccactcgttgctttgctgtatgtttttgagtttcattcgatttattttcactgttgagtttgtgggt

SEQ ID NO: 2226 - protein, 258 aa, Oryza sativa
  G3924,CAAT domain coordinates 163-222
MESRPGGTNLVEPRGQGALPSGIPIQQPWWTTSAGVGAVSPAVVAPGSGAGISLSGRDGGGDDAAEESSDDSRRSGETKDGSTDQEKHHATSQMTALASDYLTPFSQLELNQPIASAAYQYPDSYYMGMVGPYGPQAMSAQTHFQLPGLTHSRMPLPLEISEEPVYVNAKQYHGILRRRQSRAKAELEKKVVKSRKPYLHESRHQHAMRRARGTGGRFLNTKKNEDGAPSEKAEPNKGEQNSGYRRIPPDLQLLQKET

SEQ ID NO: 2227 - DNA, 756 bp, Oryza sativa
  G3925,family:CAAT
ggaggaggtttgccggagaggggacatgctccctcctcatctcacagaaaatggcacagtaatgattcagtttggtcataaaatgcctgactacgagtcatcagctacccaatcaactagtggatctcctcgtgaagtgtctggaatgagcgaaggaagcctcaatgagcagaatgatcaatctggtaatcttgatggttacacgaagagtgatgaaggtaagatgatgtcagctttatctctgggcaaatcagaaactgtgtatgcacattcggaacctgaccgtagccaaccctttggcatatcatatccatatgctgattcgttctatggtggtgctgtagcgacttatggcacacatgctattatgcatccccagattgtgggcgtgatgtcatcctcccgagtcccgctaccaatagaaccagccaccgaagagcctatttatgtaaatgcaaagcaataccatgcgattctccgaaggagacagctccgtgcaaagttagaggctgaaaacaagctggtgaaaaaccgcaagccgtacctccatgaatcccggcatcaacacgcgatgaagagagctcggggaacaggggggagattcctcaacacaaagcagcagcctgaagcttcagatggtggcaccccaaggctcgtctctgcaaacggcgttgtgttctcaaagcacgagcacagcttgtcgtccagtgatctccatcatcgtcgtgcgaaagagggcgcttgagatcctcgccg

SEQ ID NO: 2228 - protein, 239 aa, Oryza sativa
  G3925,CAAT domain coordinates 138-197
MLPPHLTENGTVMIQFGHKMPDYESSATQSTSGSPREVSGMSEGSLNEQNDQSGNLDGYTKSDEGKMMSALSLGKSETVYAHSEPDRSQPFGISYPYADSFYGGAVATYGTHAIMHPQIVGVMSSSRVPLPIEPATEEPIYVNAKQYHAILRRRQLRAKLEAENKLVKNRKPYLHESRHQHAMKRARGTGGRFLNTKQQPEASDGGTPRLVSANGVVFSKHEHSLSSSDLHHRRAKEGA

SEQ ID NO: 2229 - DNA, 1000 bp, Oryza sativa
  G3926,family:CAAT
gtggatcttgagtaatgccttctaataatgataatgctgttgcaagaaatggagaatcatcctgtccaatgcatggccaagaccaactatgattttcttgccaggaataactatccaatgaaacagttagttcagaggaactctgatggtgactcgtcaccaacaaagtctggggagtctcaccaagaagcatctgcagtaagtgacagcagtctcaacggacaacacacctcaccacaatcagtgtttgtcccctcagatattaacaacaatgatagttgtggggagcgggaccatggcactaagtcggtattgtctttggggaacacagaagctgcctttcctccttcaaagttcgattacaaccagccttttgcatgtgtttcttatccatatggtactgatccatattatggtggagtattaacaggatacacttcacatgcatttgttcatcctcaaattactggtgctgcaaactctaggatgccattgcctgttgatccttctgtagaagagcccatatttgtcaatgcaaagcaatacaatgcgatccttagaagaaggcaaacgcgtgcaaaattggaggcccaaaataaggcggtgaaaggtcggaagccttacctccatgaatctcgacatcatcatgctatgaagcgagcccgtggatcaggtggtcggttccttaccaaaaaggagctgctggaacagcagcagcagcagcagcagcagaagccaccaccggcatcagctcagtctccaacaggtagagccagaacgagcggcggtgccgttgtccttggcaagaacctgtgcccagagaacagcacatcctgctcgccatcgacaccgacaggctccgagatctccagcatctcatttgggggcggcatgctggctcaccaagagcacatcagcttcgcatccgctgatcgccaccccacaatgaaccagaaccaccgtgtccccgtcatgaggtgaaaacctcgggatcgcggga

SEQ ID NO: 2230 - protein, 317 aa, Oryza sativa
  G3926,CAAT domain coordinates 164-222
MIMLLQEMENHPVQCMAKTNYDFLARNNYPMKQLVQRNSDGDSSPTKSGESHQEASAVSDSSLNGQHTSPQSVFVPSDINNNDSCGERDHGTKSVLSLGNTEAAFPPSKFDYNQPFACVSYPYGTDPYYGGVLTGYTSHAFVHPQITGAANSRMPLPVDPSVEEPIFVNAKQYNAILRRRQTRAKLEAQNKAVKGRKPYLHESRHHHAMKRARGSGGRFLTKKELLEQQQQQQQQKPPPASAQSPTGRARTSGGAVVLGKNLCPENSTSCSPSTPTGSEISSISFGGGMLAHQEHISFASADRHPTMNQNHRVPVMR

SEQ ID NO: 2231 - DNA, 444 bp, Arabidopsis thaliana
  G3930,family:MYB-related
attttttttgtttctctcataatatttgtgttcatactgtttcgctgtttccagtacatactaatggataacacaaaccgtcttcgccgccttcactgtcataaacaacccaagttcactcatagctctcaagaagtgagtagtatgaaatgggagtttatcaatatgaccgaacaagaagaagatctcatctttagaatgtacagacttgttggcgacaggtgggatttaatagcaagaagagtggtgggacgtgaggcaaaggagatagagagatactggattatgagaaattgtgactatttctcccacaaatgacgcaaaagtcactctctttaaaaaatctcgagaatctccctgtttttctatttctcatcctcattaaataatttctgtgattgtggacaagaaaagctttattaagttgtcgagtggggttctcct

SEQ ID NO: 2232 - protein, 84 aa, Arabidopsis thaliana
  G3930,MYB-related domain coordinates 33-77
MDNTNRLRRLHCHKQPKFTHSSQEVSSMKWEFINMTEQEEDLIFRMYRLVGDRWDLIARRVVGREAKEIERYWIMRNCDYFSHK

SEQ ID NO: 2233 - DNA, 1096 bp, Zea mays
  G3931,family:CAAT
ccacgcgtccggagagagcaagggacggggcgactattagctagtactagtagcgaaaaattaaggccaaacgacaacgacgcacggcggcatggcggccggccaccacgggcagccgccggacggggacgacgggcggccgtcggtcgtcggcggggagcaggaccggctgctgcccatcgccaacgtcggccgcatcatgaagcaaatcctgccgcccaacgccaagatctccaaggaggccaaggagacgatgcaggagtgcgtgtccgagttcatcggcttcgtcaccggcgaggcctccgacaagtgccacaaggagaagcgcaagaccgtcaacggcgacgacctctgctgggccttcggcgccctgggcttcgacgactacgtcgaccccatgcgcggctacctccacaagtaccgggaggtcgagggggaccgcgctgccgcagccgcgtcctcctcccgcggcggcggagaccaccaccccgcgtccgcgtccacgtccacctcgccccccgccgcagccccacccgccggtcatttcatgttcggcgccgcagccatcgaccgccccgacaacaacacctcatccgccaggcccttttgatccaacttctacttcgccagctgctctttaatttgcttgttattcgtcagatcaacaacaaaagctacgcgcttatcttattattttttactactgctcattttttgagaggtgaatcgtcataccaaatccaaattactagctatctctatctatctatctatgttccacagttccacacacataaatagcttatttgccttattccttattagtgctagctagccacaacaaaagctatgagcatgcatgtacccagtagtagctagctagaggaggtggactagagttcttgctgctaccgattcatctctggggtacgtatcatcggtgaataaggacttggggttgggacgatggtggatgaagacgaagaccctgccgcctactataccgcgagtcgatgtaactacttcgagtgcccatcatcgatgaatttgattcgattttttattaaaaaaaaaaaaaaaaaaaaaaaaaaaaaag

SEQ ID NO: 2234 - protein, 172 aa, Zea mays
  G3931,CAAT domain coordinates 23-111
MAAGHHGQPPDGDDGRPSVVGGEQDRLLPIANVGRIMKQILPPNAKISKEAKETMQECVSEFIGFVTGEASDKCHKEKRKTVNGDDLCWAFGALGFDDYVDPMRGYLHKYREVEGDRAAAAASSSRGGGDHHPASASTSTSPPAAAPPAGHFMFGAAAIDRPDNNTSSARPF

SEQ ID NO: 2235 - DNA, 1196 bp, Zea mays
  G3937,family:CAAT
acacacaaaccagtagccactactccatccatccaccacgagcgcgcgataaccctagctagcttcaggtagtagcgagagccaatggactccagcagcttcgtccctgccgccggcgcggagaatggctcggcggcgggcggcgccaacaatggccgcgttgctcagcagcaggcgccggcgatccgcgagcaggaccggctgatgccgatcgcgaacgtgatccgcatcatgcggcgcgtgctgccggcgcacgccaagatctcggacgacgccaaggagacgatccaggagtgcgtgtcggagtacatcagcttcatcacgggggaggccaacgagcggtgccagcgggagcagcgcaagaccatcaccgccgaggacgtgctgtgggccatgagccgcctcggcttcgacgactacgtcgagccgctcggcgcctacctccaccgctaccgcgagttcgagggcgacgcgcgcggcgtcgggctcgtcccgggggccgccccatcgcgcggcggcgaccaccacccgcacccccactccatgtcgccagcggcgatgctcaagtcccgcgggcccgtctccggagccgccatgctaccgcaccaccaccaacaccaccacgacatgcagatgcacggcgccatgtacgggggaacggccgtgcccccgccggccgggcctcctcaccacggcgggttcctcatgccacacccacagggtagtagccactacctgccttacgcgtacgagcccacgtacggcggtgagcacgccatggctgcatactatggaggcgccgcgtacgcgcccggcaacggcgggagcggcgacggcagtggcagtggcggtggtggcgggagcgcgtcgcacacaccgcagggcagcggcggcttggagcacccgcacccgttcgcgtacaagtagctagttcgtacgtcgttcgacttgagcaagccatcgatctgctgatctgaacgtacgctgtattgtacacgcatgcacgtacgtatcggcggctagctctcctgtttaagttgtactgtgattctgtcccggccggctagcaacttagtatcttccttcagtctctagtttcttagcagtcgtagaagtgttcaatgcttgccagtgtgttgttttagggccggggtaaaccatccgatgagattatttcatgcacgctttttagaccg

SEQ ID NO: 2236 - protein, 280 aa, Zea mays
  G3937,CAAT domain coordinates 35-124
MDSSSFVPAAGAENGSAAGGANNGRVAQQQAPAIREQDRLMPIANVIRIMRRVLPAHAKISDDAKETIQECVSEYISFITGEANERCQREQRKTITAEDVLWAMSRLGFDDYVEPLGAYLHRYREFEGDARGVGLVPGAAPSRGGDHHPHPHSMSPAAMLKSRGPVSGAAMLPHHHQHHHDMQMHGAMYGGTAVPPPAGPPHHGGFLMPHPQGSSHYLPYAYEPTYGGEHAMAAYYGGAAYAPGNGGSGDGSGSGGGGGSASHTPQGSGGLEHPHPFAYK

SEQ ID NO: 2237 - DNA, 765 bp, Oryza sativa
  G3939,family:CAAT
atggaggccggctacccgggcgcggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgcgcagggctccatggtgacgcaccacgacatgcagatgcacgcggccatgtacggtggcggcgcggtgccgccgccgccgcaccctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtag

SEQ ID NO: 2238 - protein, 254 aa, Oryza sativa
  G3939,CAAT domain coordinates 31-120
MEAGYPGAAANGAAADGNGGAQQAAAAPAIREQDRLMPIANVIRIMRRVLPAHAKISDDAKETIQECVSEYISFITGEANERCQREQRKTITAEDVLWAMSRLGFDDYVEPLGVYLHRYREFEGESRGVGVGVGAARGDHHHGHVGGMLKSRAQGSMVTHHDMQMHAAMYGGGAVPPPPHPPPHHHAFHQLMPPHHGQYAPPYDMYGGEHGMAAYYGGMYAPGSGGDGSGSSGSGGAGTPQTVNFEHQHPFGYK

SEQ ID NO: 2239 - DNA, 891 bp, Oryza sativa
  G3940,family:CAAT
atggatccgatggatatcgtggggaagtccaaggaggacgtctccctccccaaatcaacaatgtttaagattataaaggagatgttgccccctgatgttcgagtggcaagagatgcacaagatcttcttgtggaatgctgtgtagagttcatcaacctcctatcttctgaatccaatgaagtttgcagccgagaggacaagaaaactattgctcctgagcatgttcttagagctctgcaggatcttggctttagggagtacattgaagaggttcaagcggcctacgaacaccataagcatgataccctggattctccaaaagcaagcaaattcactggtgtggagatgacagaggaacaagctgtagctgagcaacagaggatgtttgctgaggcccgagcaaggatgaacaatggtgccgccaaaccgaaggagccagaacctgaagcgcagcaacaaacacaacagccaccacagcctcagctgcaccctcaaccacagcaacccctgcagcctcaacttcagctccatcctcaaccacaacaacagccctcacagctacatcctcaacagctgctgcatcctcaatcgcagcaaactccgcagcctcaacctcaggtccaccctcaaccacagcagcctccacagctgcaaccgcaacctcagcttctccagcaaccgcagctgccccaacagctgcagccgcaatctcagctccccccacaaccgcagcagcccccacagctgcagctgcaatctcagctccacccacaaccgcagcagcccccacagctgcagccgcaacctcagctccatcagcaaccgcagccgcaggcagagctgcaatcacagtcacaaccacaaacagaacatggcttggacagttcatga

SEQ ID NO: 2240 - protein, 296 aa, Oryza sativa
  G3940,CAAT domain coordinates 11-99
MDPMDIVGKSKEDVSLPKSTMFKIIKEMLPPDVRVARDAQDLLVECCVEFINLLSSESNEVCSREDKKTIAPEHVLRALQDLGFREYIEEVQAAYEHHKHDTLDSPKASKFTGVEMTEEQAVAEQQRMFAEARARMNNGAAKPKEPEPEAQQQTQQPPQPQLHPQPQQPLQPQLQLHPQPQQQPSQLHPQQLLHPQSQQTPQPQPQVHPQPQQPPQLQPQPQLLQQPQLPQQLQPQSQLPPQPQQPPQLQLQSQLHPQPQQPPQLQPQPQLHQQPQPQAELQSQSQPQTEHGLDSS

SEQ ID NO: 2241 - DNA, 3522 bp, Arabidopsis thaliana
  G3967,family:VAR
atggctagttcatcttcatctgagagatggatcgatggtcttcagttctcttccttgttatggcctccgccacgagatcctcaacaacataaggatcaagtcgttgcttatgttgaatattttggtcaatttacatcagagcaattcccagatgacattgctgagttggtccggcatcagtatccatcaactgagaagcgacttttagacgatgtgctggcgatgtttgtccttcatcatccggagcatggtcatgcagtcattcttccaatcatttcatgtcttattgatggctcgttggtgtacagcaaggaagctcatccgtttgcctctttcatatctttagtttgcccaagtagtgagaatgactattcggagcaatgggctttggcatgtggagaaatccttcgcattttgactcattacaaccgtcccatttataaaactgagcagcaaaatggagatacagagagaaattgtctgagcaaagctacaactagtggttctccgacttcagagcctaaggctggatcaccaacacagcatgaaaggaaacctttaaggcctttgtctccatggatcagtgatatactacttgctgctcctcttggtataagaagtgactatttccgatggtgtagtggtgtaatgggtaaatatgctgctggagagctcaagccgccaaccattgcttctcgaggatctggtaaacatcctcaactgatgccttcaaccccaagatgggctgttgctaatggagctggtgtcatactgagtgtttgtgatgatgaagttgctcgatatgagactgctacgctgacagcggtcgctgtccctgcacttcttcttcctccgccaacgacatccttagatgagcatctagttgctggccttccagctcttgaaccatatgcacgtttgtttcatagatactatgccattgcaactccaagtgctacgcagagacttcttcttggactcttagaagcaccaccgtcgtgggctccagatgcacttgatgctgctgtacagcttgtggaactccttcgagctgctgaagattatgcatctggtgtaaggctacccaggaactggatgcatttgcacttcttgcgggctataggaattgctatgtctatgagggcaggtgttgctgctgatgctgcagccgctttgcttttccgcatactctcacagccggcactgctttttcctccgctaagtcaagttgagggagtagaaattcagcacgcgcctattggtggctacagttcaaattacagaaaacagatagaagttcctgcagcagaagcaaccattgaagccactgcccaaggaattgcctcaatgctttgtgctcatggtcctgaagttgagtggagaatttgcactatatgggaagctgcttatggtttgatccctttaaattcttcggcggttgatcttcccgaaatcatagttgctaccccactgcaacctcctatcttgtcatggaatttatacattccactcctcaaagtacttgaatatcttccacgggggagtccttcggaagcatgcttgatgaaaatatttgttgccactgtggaaacaatactcagtagaacttttccgcctgaatcttccagggaactaaccagaaaagctagatcgagttttaccacaagatcagcgaccaaaaatcttgctatgtctgagcttcgtgctatggtccatgctctctttttagaatcatgcgctggtgtggaattagcttcacgcctactttttgttgtgttgactgtatgtgttagccatgaagcacagtctagtggtagcaagagaccgagaagtgaatatgctagtactactgaaaatattgaggcgaatcaacctgtatctaacaatcaaactgctaaccgtaaaagtaggaatgtcaagggacagggacctgtggcagcatttgattcatacgttcttgctgctgtttgtgctcttgcctgtgaggttcagctgtatcctatgatctctggtggggggaacttttccaattctgccgtggctggaactattacaaagcctgtaaagataaatgggtcatctaaagagtatggagctgggattgactcggcaattagtcatacgcgccgaattttggcaatcctagaggcactcttttcattaaaaccatcttctgtggggactccatggagttacagttctagtgagatagttgctgcggccatggttgcagctcatatttccgaactgttcagacgttcaaaggccttgacgcatgcattgtctgggttgatgagatgtaagtgggataaggaaattcataaaagagcatcatcattatataacctcatagatgttcacagcaaagttgttgcctccattgttgacaaagctgaacccttggaagcctaccttaagaatacaccggttcagaaggattctgtgacctgtttaaactggaaacaagagaacacatgtgcaagcaccacatgctttgatacagcggtgacatccgcctcaaggactgaaatgaatccaagaggaaaccataagtatgctagacattcagatgaaggctcagggagaccctcagagaagggtatcaaagatttcctcttggatgcttctgatcttgcgaatttcctcacagctgatagactcgcagggttctattgtggtacacaaaagcttttgaggtcagtgcttgcagagaaaccggagctgtctttctccgttgtttcactgttatggcacaaactgattgctgctcctgaaatccagcccaccgcagaaagcacctctgcgcaacaaggatggagacaggttgttgatgcgctatgcaatgtcgtatctgcaacgccagcgaaagcagcagcagcagttgtccttcaggctgaaagggagttgcagccttggatcgccaaagatgatgaagaaggccaaaaaatgtggaaaatcaaccaacggatagtcaaagtgttggtggaactcatgcgcaatcatgacaggcctgagtcactggtgattctcgcaagtgcatcagatcttcttctgcgggcaactgatggaatgcttgttgatggagaagcttgtacattacctcaacttgagctacttgaagccacggcaagagcaatacagccggtgctagcttgggggccatctggactagcagtggtcgacggtttatccaatctattgaagtgtcgtctaccagcaacaatacggtgcctttcacacccaagtgcacacgtacgtgccttaagcacgtcagtactacgtgatatcatgaaccaaagctccatacccatcaaagtaactccaaaactgccaacaacagagaagaacggaatgaatagtccgtcctatcgattcttcaacgccgcctcaatagactggaaagccgatatccaaaactgtttaaactgggaagctcacagcttgctctccacaactatgcctactcagtttctcgacactgcggctcgggaactcggctgtactatatccttgtcccaataa

SEQ ID NO: 2242 - protein, 1173 aa, Arabidopsis thaliana
  G3967,VAR domain coordinates 1-1174
MASSSSSERWIDGLQFSSLLWPPPRDPQQHKDQVVAYVEYFGQFTSEQFPDDIAELVRHQYPSTEKRLLDDVLAMFVLHHPEHGHAVILPIISCLIDGSLVYSKEAHPFASFISLVCPSSENDYSEQWALACGEILRILTHYNRPIYKTEQQNGDTERNCLSKATTSGSPTSEPKAGSPTQHERKPLRPLSPWISDILLAAPLGIRSDYFRWCSGVMGKYAAGELKPPTIASRGSGKHPQLMPSTPRWAVANGAGVILSVCDDEVARYETATLTAVAVPALLLPPPTTSLDEHLVAGLPALEPYARLFHRYYAIATPSATQRLLLGLLEAPPSWAPDALDAAVQLVELLRAAEDYASGVRLPRNWMHLHFLRAIGIAMSMRAGVAADAAAALLFRILSQPALLFPPLSQVEGVEIQHAPIGGYSSNYRKQIEVPAAEATIEATAQGIASMLCAHGPEVEWRICTIWEAAYGLIPLNSSAVDLPEIIVATPLQPPILSWNLYIPLLKVLEYLPRGSPSEACLMKIFVATVETILSRTFPPESSRELTRKARSSFTTRSATKNLAMSELRAMVHALFLESCAGVELASRLLFVVLTVCVSHEAQSSGSKRPRSEYASTTENIEANQPVSNNQTANRKSRNVKGQGPVAAFDSYVLAAVCALACEVQLYPMISGGGNFSNSAVAGTITKPVKINGSSKEYGAGIDSAISHTRRILAILEALFSLKPSSVGTPWSYSSSEIVAAAMVAAHISELFRRSKALTHALSGLMRCKWDKEIHKRASSLYNLIDVHSKVVASIVDKAEPLEAYLKNTPVQKDSVTCLNWKQENTCASTTCFDTAVTSASRTEMNPRGNHKYARHSDEGSGRPSEKGIKDFLLDASDLANFLTADRLAGFYCGTQKLLRSVLAEKPELSFSVVSLLWHKLIAAPEIQPTAESTSAQQGWRQVVDALCNVVSATPAKAAAAVVLQAERELQPWIAKDDEEGQKMWKINQRIVKVLVELMRNHDRPESLVILASASDLLLRATDGMLVDGEACTLPQLELLEATARAIQPVLAWGPSGLAVVDGLSNLLKCRLPATIRCLSHPSAHVRALSTSVLRDIMNQSSIPIKVTPKLPTTEKNGMNSPSYRFFNAASIDWKADIQNCLNWEAHSLLSTTMPTQFLDTAARELGCTISLSQ

SEQ ID NO: 2243 - DNA, 435 bp, Saccharomyces cerevisiae
  G3969,family:CAAT
atgaataccaacgagtccgaacatgttagcacaagcccagaggatactcaggagaacggtggaaacgctagctccagcggcagtttgcagcaaatttccacgctaagagagcaggacagatggctacccatcaacaatgtagcgcgactcatgaagaatactctcccaccgagtgctaaggtatcgaaagatgcgaaagagtgcatgcaggagtgtgtcagtgagctcatttcttttgtgactagcgaggccagcgatcgatgcgctgctgacaaaagaaagacgataaacggggaagacattctcatatcattgcacgccttaggattcgagaactatgcagaggtgttgaaaatctacttggctaaatacaggcaacaacaggcgctgaagaatcaactaatgtatgagcaggacgacgaagaggtgccttga

SEQ ID NO: 2244 - protein, 144 aa, Saccharomyces cerevisiae [sequence omitted]

SEQ ID NO: 2245 - DNA, 687 bp, Glycine max
  G3980,family:MADS
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccgcaggaaaatgatgggggaagaactgtcaggcttgacagtcaaagaattacaaaatttggagaaccaattagaaattagccttcatggtgtccgaatgaaaaaggatcaacttttaatgggtgaaatacaagagctaaatcgaaagggaaacctcatacaccaagaaaatgtggaactgtataagaaggtctatggaacacaagatgataacgaaacaaacagagattctgttctgacaaatggtctaggcataggagaggatttgcaagtgcctgtgaatctccagctaagccagccacagcaacagcaacaacactacaaggcatcttcaggaactacaaaattgggattgcaattgcattga

SEQ ID NO: 2246 - protein, 228 aa, Glycine max
  G3980,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRRKMMGEELSGLTVKELQNLENQLEISLHGVRMKKDQLLMGEIQELNRKGNLIHQENVELYKKVYGTQDDNETNRDSVLTNGLGIGEDLQVPVNLQLSQPQQQQQHYKASSGTTKLGLQLH

SEQ ID NO: 2247 - DNA, 678 bp, Glycine max
  G3981,family:MADS
atggggagaggtaagatcgtgataaggaggatcgacaattccacgagcaggcaagtgacgttctcgaagcgaaggaacggtttgctgaagaaggcgaaggagcttgcgatcttgtgcgatgctgaagtcggagttatgatcttctccagcaccggaaaactctacgatttcgccagctccagcatgaaatcagtaatggaccgatacagcaaatcaaaagaagaaccttgtcaacttgggagttcagcctctgaaattaagttttggcaaagggaggcagcaatgttaaggcaacaattacacaatttgcaagaaagtcaccggaaaatgatgggggaagaactgtcaggcttgacagtcaaagaattacaaaatttggagaaccaattagaaattagccttcgaggtgtccgaatgaaaaaggatcaacttttaatggatgaaatacaagagttaaatcggaagggaaacctcatacaccaagaaaatgtggaactgtatcagaaggtctatggaacaaaagatgataacaaaacaaacagagattctgttctcacaaatggtctaggcataggagaggatttgcaagtgcctgtgaatctccagctaagccagccacagcaacaacactacaaggaaccttcaggaactacaaaattgggattgcaattgcattag

SEQ ID NO: 2248 - protein, 225 aa, Glycine max
  G3981,MADS domain coordinates 2-57
MGRGKIVIRRIDNSTSRQVTFSKRRNGLLKKAKELAILCDAEVGVMIFSSTGKLYDFASSSMKSVMDRYSKSKEEPCQLGSSASEIKFWQREAAMLRQQLHNLQESHRKMMGEELSGLTVKELQNLENQLEISLRGVRMKKDQLLMDEIQELNRKGNLIHQENVELYQKVYGTKDDNKTNRDSVLTNGLGIGEDLQVPVNLQLSQPQQQHYKEPSGTTKLGLQLH

SEQ ID NO: 2249 - DNA, 709 bp, Zea mays
  G4000,family:Z-CO-like
gacgtcgggaatgggcgctgctcgtgactccgcggcggcgggccagaagcacggcaccggcacgcggtgcgagctctgcgggggcgcggcggccgtgcactgcgccgcggactcggcgttcctctgcctgcgctgcgacgccaaggtgcacggcgccaacttcctggcgtccaggcacgtgaggcggcgcctggtgccgcgccgggccgccgaccccgaggcgtcgtcggccgcgtccagcggctcctcctgcgtgtccacggccgactccgcggagtcggccgccacggcaccggctccgtgcccttcgaggacggcggggaggagggctccggctcgtgcgcggcggccgcgcgcggaggcggtcctggaggggtgggccaagcggatggggttcgcggcggggccggcgcgccggcgcgccgcggcggcggccgccgcgctccgggcgctcggccggggcgtggccgctgcccgcgtgccgctccgcgtcgggatggccggcgcgctctggtcggaggtcgccgccgggtgccgaggcaatggaggggaggaggcctcgctgctccagcggctggaggccgccgcgcacgtgccggcgcggctggtgctgaccgccgcgtcgtggatggcgcgccggccggacgcccggcaggaggaccacgaggagggatgggccgagtgctcctgagttcctgatccagacggg

SEQ ID NO: 2250 - protein, 226 aa, Zea mays
  G4000,Z-CO-like domain coordinates 20-61
MGAARDSAAAGQKHGTGTRCELCGGAAAVHCAADSAFLCLRCDAKVHGANFLASRHVRRRLVPRRAADPEASSAASSGSSCVSTADSAESAATAPAPCPSRTAGRRAPARARRPRAEAVLEGWAKRMGFAAGPARRRAAAAAAALRALGRGVAAARVPLRVGMAGALWSEVAAGCRGNGGEEASLLQRLEAAAHVPARLVLTAASWMARRPDARQEDHEEGWAECS

SEQ ID NO: 2251 - DNA, 732 bp, Glycine max
  G4004,family:Z-CO-like
atgaagcccaagacttgcgagctttgtcatcaactagcttctctctattgtccctccgattccgcatttctctgcttccactgcgacgccgccgtccacgccgccaacttcctcgtagctcgccacctccgccgcctcctctgctccaaatgcaaccgtttcgccgcaattcacatctccggtgctatatcccgccacctctcctccacctgcacctcttgctccctggagattccttccgccgactccgattctctcccttcctcttctacctgcgtctccagttccgagtcttgctctacgaatcagattaaggcggagaagaagaggaggaggaggaggaggagtttctcgagttcctccgtgaccgacgacgcatctccggcggcgaagaagcggcggagaaatggcggatcggtggcggaggtgtttgagaaatggagcagagagatagggttagggttaggggtgaacggaaatcgcgtggcgtcgaacgctctgagtgtgtgcctcggaaagtggaggtcgcttccgttcagggtggctgctgcgacgtcgttttggttggggctgagattttgtggggacagaggcctcgccacgtgtcagaatctggcgaggttggaggcaatatctggagtgccagcaaagctgattctgggcgcacatgccaacctcgcacgtgtcttcacgcaccgccgcgaattgcaggaaggatggggcgagtcctag

SEQ ID NO: 2252 - protein, 243 aa, Glycine max
  G4004,Z-CO-like domain coordinates 6-51
MKPKTCELCHQLASLYCPSDSAFLCFHCDAAVHAANFLVARHLRRLLCSKCNRFAAIHISGAISRHLSSTCTSCSLEIPSADSDSLPSSSTCVSSSESCSTNQIKAEKKRRRRRRSFSSSSVTDDASPAAKKRRRNGGSVAEVFEKWSREIGLGLGVNGNRVASNALSVCLGKWRSLPFRVAAATSFWLGLRFCGDRGLATCQNLARLEAISGVPAKLILGAHANLARVFTHRRELQEGWGES

SEQ ID NO: 2253 - DNA, 756 bp, Glycine max
  G4005,family:Z-CO-like
aggcgaagatgaagggtaagacttgcgagctttgtgatcaacaagcttctctctattgtccctccgattccgcatttctctgctccgactgcgacgccgccgtgcacgccgccaactttctcgtagctcgtcacctccgccgcctcctctgctccaaatgcaaccgtttcgccggatttcacatctcctccggcgctatatcccgccacctctcgtccacctgcagctcttgctccccggagaatccttccgctgactactccgattctctcccttcctcttctacctgcgtctccagttccgagtcttgctccacgaagcagattaaggtggagaagaagaggagttggtcgggttcctccgtgaccgacgacgcatctccggcggcgaagaagcggcagaggagtggaggatcggaggaggtgtttgagaaatggagcagagagatagggttagggttagggttaggggtaaacggaaatcgcgtggcgtcgaacgctctgagtgtgtgcctgggaaagtggaggtggcttccgttcagggtggctgctgcgacgtcgttttggttggggctgagattttgtggggacagagggctggcctcgtgtcagaatctggcgaggttggaggcaatatccggagtgccagttaagctgattctggccgcacatggcgacctggcacgtgtcttcacgcaccgccgcgaattgcaggaaggatggggcgagtcctagctagctccaatgtgtaatcgtc

SEQ ID NO: 2254 - protein, 241 aa, Glycine max
  G4005,Z-CO-like domain coordinates 6-51
MKGKTCELCDQQASLYCPSDSAFLCSDCDAAVHAANFLVARHLRRLLCSKCNRFAGFHISSGAISRHLSSTCSSCSPENPSADYSDSLPSSSTCVSSSESCSTKQIKVEKKRSWSGSSVTDDASPAAKKRQRSGGSEEVFEKWSREIGLGLGLGVNGNRVASNALSVCLGKWRWLPFRVAAATSFWLGLRFCGDRGLASCQNLARLEAISGVPVKLILAAHGDLARVFTHRRELQEGWGES

SEQ ID NO: 2255 - DNA, 732 bp, Citrus sinensis
  G4007,family:Z-CO-like
atgaaacgagcttgcgagctttgcagccaagaagcggccctccactgcgcttccgacgaagccttcctttgtttcgactgcgacgatagggttcataaggccaactttctcgtggctcgtcacgttcgtcaaactctgtgctctcagtgcaaatctttgaccggaaagttcatctccggtgaacgttcatcgtcatcgctggtacccatttgcccgtcttgttgttcttctactacttcgacgtcgtctgattgtatttcttcaactgaaagctccgctgcggagaaaatgggcagagaacgtaaaagggttcgtgcatgttcgagttctgtgtcggatatttccggcgaaaaggcggcggctgtgacggattccaaggcggagggtatttttgcgatttggtgtaggaggctggggctgaatggtaataatagtaattgtaattcggttgttgttgtctctttggcgagtcgggcgctggggttgtgtttggaaaggacgacggcgttgcccttacgggcttgcttggcggcgtcgttttggtttggtctgagaatgtgcggggacaaaacggtcgccacgtggccgaatctgagaaggcttgaggcgatatcaggagtgccggcgaagttgatcgtggccgttgaggggaagatcgcgcgtgtgatggcggtgagaaggagaagacccaggcaggtcttggaggaaggatgggctgagtgcaacgtatga

SEQ ID NO: 2256 - protein, 243 aa, Citrus sinensis
  G4007,Z-CO-like domain coordinates 5-50
MKRACELCSQEAALHCASDEAFLCFDCDDRVHKANFLVARHVRQTLCSQCKSLTGKFISGERSSSSLVPICPSCCSSTTSTSSDCISSTESSAAEKMGRERKRVRACSSSVSDISGEKAAAVTDSKAEGIFAIWCRRLGLNGNNSNCNSVVVVSLASRALGLCLERTTALPLRACLAASFWFGLRMCGDKTVATWPNLRRLEAISGVPAKLIVAVEGKIARVMAVRRRRPRQVLEEGWAECNV

SEQ ID NO: 2257 - DNA, 750 bp, Populus trichocarpa
  G4009,family:Z-CO-like
atggctgttaaggtctgcgagctttgcaaaggagaagctggtgtctactgcgattcagatgctgcgtatctttgttttgactgtgattctaacgtccataatgctaacttccttgttgctcgccatattcgccgtgtaatctgctccggttgcggttctatcacaggaaatccgttctccggcgacaccccatctcttagccgtgtcacctgttcctcttgctcgccaggaaacaaagaactggactccatctcctgctcctcctctagtactttatcctctgcttgcatttcaagcaccgaaacgacgcgctttgagaacacaagaaaaggagtcaagaccacgtcatcttccagctcggtgaggaatattccgggtagatccttgagggataggttgaagaggtcgaggaatctgaggtcagagggtgttttcgtgaattggtgcaaaaggctggggctcaatggtagtttggtggtacagagagccactcgggcgatggcgctgtgttttgggagattggctttgccgttcagagtgagcttagcggcgtcgttttggttcgggctcaggttatgtggggacaagtcggttacgacgtgggagaatctgaggagattagaggaggtatctggggttcccaataagctgatcgttaccgttgaaatgaagatagaacaggcgttgcgaagcaagagactgcagctgcagaaagaaatggaagaagggtgggctgagtgctctgtgtga

SEQ ID NO: 2258 - protein, 249 aa, Populus trichocarpa
  G4009,Z-CO-like domain coordinates 6-51
MAVKVCELCKGEAGVYCDSDAAYLCFDCDSNVHNANFLVARHIRRVICSGCGSITGNPFSGDTPSLSRVTCSSCSPGNKELDSISCSSSSTLSSACISSTETTRFENTRKGVKTTSSSSSVRNIPGRSLRDRLKRSRNLRSEGVFVNWCKRLGLNGSLVVQRATRAMALCFGRLALPFRVSLAASFWFGLRLCGDKSVTTWENLRRLEEVSGVPNKLIVTVEMKIEQALRSKRLQLQKEMEEGWAECSV

SEQ ID NO: 2259 - DNA, 726 bp, Oryza sativa
  G4011,family:Z-CO-like
atgggtggcgaggcggagcggtgcgcgctctgtggcgcggcggcggcggtgcactgcgaggcggacgcggcgttcctgtgcgcggcgtgcgacgccaaggtgcacggggcgaacttcctcgcgtcgcggcaccaccggaggcgggtggcggccggggcggtggtggtggtggaggtggaggaggaggaggggtatgagtccggggcgtcggcggcgtcgagcacgtcgtgcgtgtcgacggccgactccgacgtggcggcgtcggcggcggcgaggcgggggaggaggaggaggccgagggcagcggcgcggccccgcgcggaggtggttctcgaggggtggggcaagcggatgggcctcgcggcgggggcggcgcggcggcgcgccgcggcggccgggcgcgcgctccgggcgtgcggcggggacgtcgccgccgcgcgcgtcccgctccgcgtcgccatggcggccgcgctgtggtgggaggtggcggcccaccgcgtctccggcgtctccggcgccggccatgccgacgcgctgcggcggctggaggcgtgcgcgcacgtgccggcgaggctgctcacggcggtggcgtcgtcgatggcccgcgcgcgcgcaaggcggcgcgccgccgcggacaacgaggagggctgggacgagtgctcgtgttctgaagcgcccaacgccttgggtggcccacatgtcagtgacacagctcgtcagaaatga

SEQ ID NO: 2260 - protein, 241 aa, Oryza sativa
  G4011,Z-CO-like domain coordinates 8-49
MGGEAERCALCGAAAAVHCEADAAFLCAACDAKVHGANFLASRHHRRRVAAGAVVVVEVEEEEGYESGASAASSTSCVSTADSDVAASAAARRGRRRRPRAAARPRAEVVLEGWGKRMGLAAGAARRRAAAAGRALRACGGDVAAARVPLRVAMAAALWWEVAAHRVSGVSGAGHADALRRLEACAHVPARLLTAVASSMARARARRRAAADNEEGWDECSCSEAPNALGGPHVSDTARQK

SEQ ID NO: 2261 - DNA, 666 bp, Oryza sativa
  G4012,family:Z-CO-like
atggaggtcggcaacggcaagtgcggcggtggtggcgccgggtgcgagctgtgcgggggcgtggccgcggtgcactgcgccgctgactccgcgtttctttgcttggtatgtgacgacaaggtgcacggcgccaacttcctcgcgtccaggcaccgccgccgccggttgggggttgaggtggtggatgaggaggatgacgcccggtccacggcgtcgagctcgtgcgtgtcgacggcggactccgcgtcgtccacggcggcggcggctgcgctggagagcgaggacgtcaggaggagggggcggcgcgggcggcgtgccccgcgcgcggaggcggttctggaggggtgggcgaagcggatggggttgtcgtcgggcgcggcgcgcaggcgcgccgccgcggccggggcggcgctccgcgcggtgggccgtggcgtcgccgcctcccgcgtcccgatccgcgtcgcgatggccgccgcgctctggtcggaggtcgcctcctcctcctcccgtcgccgccgccgccccggcgccggacaggccgcgctgctcctgcggctggaggccagcgcgcacgtgccggcgaggctgctcctgacggtggcgtcgtggatggcgcgcgcgtcgacgccgcccgccgccgaggagggctgggccgagtgctcctga

SEQ ID NO: 2262 - protein, 221 aa, Oryza sativa
  G4012,Z-CO-like domain coordinates 15-56
MEVGNGKCGGGGAGCELCGGVAAVHCAADSAFLCLVCDDKVHGANFLASRHRRRRLGVEVVDEEDDARSTASSSCVSTADSASSTAAAAALESEDVRRRGRRGRRAPRAEAVLEGWAKRMGLSSGAARRRAAAAGAALRAVGRGVAASRVPIRVAMAAALWSEVASSSSRRRRRPGAGQAALLLRLEASAHVPARLLLTVASWMARASTPPAAEEGWAECS

SEQ ID NO: 2263 - DNA, 951 bp, Glycine max
  G4218,family:MYB-(R1)R2R3
ccacgcggcccgctctctccacacacatatataaacccaaacaagtgaacaacactccctcctttgtcccattactagtacatacattcccctaaccaagttttaagtttttctcaacagaatggaagcaaccaacagaagctcttcctccacttcctcttcctctgattgctgctcttccgagtccaaccccaacaagcccgacagaatcaaaggcccatggagcgccgaagaggatcggatcctgaccggactcgtcgaacgatacggcccacgaaattggtccctcatcagccgctacattaagggaaggtccggcaagtcatgccggctccgatggtgcaatcagcttagccccgccgtggagcaccgccccttctcggcccaagaggacgacaccatcatcgcggcccatgcccagtatggtaacaggtgggccactatagcccgattgctaccgggccgaaccgataacgccgttaagaaccactggaactccactctcaagcgcagagccaaaggtattaacattaatgttaatcacgccaacaacgaagtggctgcttcttcttccgctccttctcgccacttcgacttcgaggatgatccgttgaccgcgttgactctcgctcctcctggtattgctaatggcactgtggcggaggacgccgtgccggaccatcgtgcctcgccggaggggttttgggatatgatgagggatgtgatcgcgagggaagtgagggaatatgtgtcttccaatttttctgataactcgggttttcattaaatcaatcataatcataattgttattatgcttcttcttttttctttttttttttttaactttaggcaaattattctgcaatttgattttgccttactggactttggaatcggatcagagaattaaattaaattagacccttctgaaaaaaaaaaaaaaaaaaaag

SEQ ID NO: 2264 - protein, 221 aa, Glycine max
  G4218,MYB-(R1)R2R3 domain coordinates 31-131
MEATNRSSSSTSSSSDCCSSESNPNKPDRIKGPWSAEEDRILTGLVERYGPRNWSLISRYIKGRSGKSCRLRWCNQLSPAVEHRPFSAQEDDTIIAAHAQYGNRWATIARLLPGRTDNAVKNHWNSTLKRRAKGININVNHANNEVAASSSAPSRHFDFEDDPLTALTLAPPGIANGTVAEDAVPDHRASPEGFWDMMRDVIAREVREYVSSNFSDNSGFH

SEQ ID NO: 2265 - DNA, 928 bp, Glycine max
  G4219,family:MYB-(R1)R2R3
ggaattcgtttacgcccgactatacataaacccagtttcctggaagtaccccctgtctctaatctcattcatgccattaattataattataaacccaaacaagtgaacaaccctctctcctggggcccattccccctaaccaagtttaagtttctagattggtagaaatgaacagaagctcctcctccacttcctcttcctctcactgttgctctttagagtccaaccataggagccccaacaagccagacagaatcaaaggcccatggagcgcccaagaggatcggatcctgacacgactagtcgaacaatacggccctcgaaactggtccctcatcagccgctacattaagggcaggtccggcaaatcgtgccggctgcggtggtgcaatcagctgagccccaccgtggagcaccgccccttctcgacccaagaggacgagaccatcatcgctgcccatgcccggtacggtaacaggtgggccaccatagcccgattattaccgggccgaaccgataacgccgttaagaaccactggaactccacgctcaagcgcagagccaagggtattaacgttaatgttaatgatgccgacaacgaggatgacccgttgaccgcattgactcttgctcctcccggtattgctaatgccactttgaccgaagacgccgtaccggaccaccgggcctcgccggagagtgcggcggaggggttttgggatatgatgaagggatgtgatccgcgagggaggtgaggggatatgtgtcttctaatttttctgataataactagggttttcattaaatcaatcatcataagcataatttgttattatgtcttccttttttttttaggcaaattattctgcaatttgattttgccttactggactttggaatcggatcagggaaataaattaaaaccctt

SEQ ID NO: 2266 - protein, 195 aa, Glycine max
  G4219,MYB-(R1)R2R3 domain coordinates 31-131
MNRSSSSTSSSSHCCSLESNHRSPNKPDRIKGPWSAQEDRILTRLVEQYGPRNWSLISRYIKGRSGKSCRLRWCNQLSPTVEHRPFSTQEDETIIAAHARYGNRWATIARLLPGRTDNAVKNHWNSTLKRRAKGINVNVNDADNEDDPLTALTLAPPGIANATLTEDAVPDHRASPESAAEGFWDMMKGCDPRGR

SEQ ID NO: 2267 - DNA, 987 bp, Glycine max
  G4220,family:MYB-(R1)R2R3
tcacttcttcttcttcctcctcctccctctctcacaatttttattttttaatgatactattttgttattgttattgatggtatcatcatcgggaaaaagcagagaaatggatagggtgaagggtccatggagcccagaagaggacgaggccctgcgggcgctggttcaggcccacgggcctcgaaactggtcggtgataagcaagtccattccggggagatccgggaaatcgtgccgcttacggtggtgcaaccagctctcgccgcaggtggcccatcgccccttctcgcaggaggaggacgaggccatcatcatggcccacgccaagttcggcaacaagtgggccaccatagctcgcctgctcaacggccgcaccgataacgccgtcaaaaaccactggaattccactctcaagagaaaatcctccgccgttagtgacgacgacgtcgtcacgcatcgtcagcctcttaaaagatccaacagcgtcggcccggcccacttgaaccctgccagcccatcagtctccgatttgagcgatccgggccttcccgctctgtcaaacccctcaccttcggcccattacatgcccaatctcatggaaactgcttcttccgctcccgatccagccacgtcacttagtttgtctctccctgggttcactgtacctcaaccagtgtctccgccgccgccgccactgccactgccggcggagacggtggaggagcgagggaagcaaatgttcaacgcggagttcttgagagtgatgcaagagatgataaaaaaggaagtgaggagttacatgtcagggatggaagaacagaagaatgggttcagaatgcaaaccgaagcgattgggaacgcggtggtgaagcgcatgggaattagcaacatcgagtgaagaaaaagaaaacggtgtcgtttcgagattcgaatcaagccaactggcacatgaatgatgatgaatcacaagagtaggagaaaagtgag

SEQ ID NO: 2268 - protein, 273 aa, Glycine max
  G4220,MYB-(R1)R2R3 domain coordinates 15-115
MVSSSGKSREMDRVKGPWSPEEDEALRALVQAHGPRNWSVISKSIPGRSGKSCRLRWCNQLSPQVAHRPFSQEEDEAIIMAHAKFGNKWATIARLLNGRTDNAVKNHWNSTLKRKSSAVSDDDVVTHRQPLKRSNSVGPAHLNPASPSVSDLSDPGLPALSNPSPSAHYMPNLMETASSAPDPATSLSLSLPGFTVPQPVSPPPPPLPLPAETVEERGKQMFNAEFLRVMQEMIKKEVRSYMSGMEEQKNGFRMQTEAIGNAVVKRMGISNIE

SEQ ID NO: 2269 - DNA, 845 bp, Glycine max
  G4221,family:MYB-(R1)R2R3
tattgttaagacggcatcatcagggaaatggatcgggtgaagggtccatggagcccagaagaggacgaggctttgcggaggctggttcaggcccacgggcctcgaaactggtcggtgataagcaagtccgttccgggacgatccgggaaatcgtgccgcttacggtggtgcaaccagctctcgccgcaggtggcccaccgccccttctcgccggacgaggacgaggccatcgtcagggctcacgccaggttcggcaacaagtgggccaccatagctcgccttctcaacaacggccgcaccgataacgccgtcaaaaaccactggaactccactctcaagagaaaaaaatgttccgccgttagtgacgacgtcaccgatcgtccgcctcttaaaagatctgcaagcgtcggcccggcccatttgaaccctggcagcccatcgggctccgatttgagcgatccgagcctgcccgctctctcaaacccctccccctcggcccattacaggcccaatctcatggaaaccgcttcttctgcttgcgatccagccacgtcactgagtttgtctctccccgggttcgggtccgggtctaacccagtttgcgcacctcgaccggtatcggtgtctccgccgtcaccgcctccggcggagccggtggagcagcgggggaagcaaatgttcaacgcggagttcttgagagtgatgcaagagatgataagaaaggaagtgaggagttacatgtcagggatggaacagaagaatggcttcagaataccaaccgaagcgattgggaacgcggtggtgaagcgcatgggaattagcaacatcgagtgaaggaaagaaac

SEQ ID NO: 2270 - protein, 268 aa, Glycine max
  G4221,MYB-(R1)R2R3 domain coordinates 5-106
MDRVKGPWSPEEDEALRRLVQAHGPRNWSVISKSVPGRSGKSCRLRWCNQLSPQVAHRPFSPDEDEAIVRAHARFGNKWATIARLLNNGRTDNAVKNHWNSTLKRKKCSAVSDDVTDRPPLKRSASVGPAHLNPGSPSGSDLSDPSLPALSNPSPSAHYRPNLMETASSACDPATSLSLSLPGFGSGSNPVCAPRPVSVSPPSPPPAEPVEQRGKQMFNAEFLRVMQEMIRKEVRSYMSGMEQKNGFRIPTEAIGNAVVKRMGISNIE

SEQ ID NO: 2271 - DNA, 983 bp, Glycine max
  G4222,family:MYB-(R1)R2R3
ctttaaccttaccagctcgagataagacatggaccggatcaaaggcccatggagtccggaggaggacgaggctctgcagaagctggtggagaaacacgggcccaggaactggtctctgatcagcaagtccatcccgggccggtccggcaagtcctgcaggctccggtggtgcaaccagctgtccccccaggtggagcaccgggccttcacggccgaagaggacgacaccataatccgggcccatgcccgcttcggcaacaagtgggccaccatagcccgcctcctccacggcagaaccgacaacgctatcaaaaaccactggaactccaccttgaagcgcaagtgctcttcaaccatgatcgacgacaacacccaaccgctgaaaagatccgtgagtgccggcgcggctattccagtctctactggactctacatgaacccgcccacaccgggtagtccctccggatccgatgtgagcgagtccagcttaccggttgcatcctcttcgcacgtgttccgtcccgtgcctagaactgtcaaggttctaccacccgtagaaaccacgtcgtcctccaatgaccctccaacttcactttctctatcactccccggtgttggtgttgttgactcatccgaagtctccaatcggacaactgagccgattcattttacaccgccaatgccacatcggtcgaatactatgcctttgctgccaatgatgacgtcggtttcagcgacggtgatggcgccgtttaattttagcgcagagtttcggtcggtgatgcaggaaatgataaggaaggaggtgaggagttatatagagttgcacaatcagaatgggatgtgttttcaggctgcggtgaatgatgggtttaggaacgcttccgtcaagcgtattggaattagcagggttgattcgtaaatagtatcatcggagaaaagaatgttcatttgctcctcctaatgggaaaaaaataagaaga

SEQ ID NO: 2272 - protein, 297 aa, Glycine max
  G4222,MYB-(R1)R2R3 domain coordinates 5-105
MDRIKGPWSPEEDEALQKLVEKHGPRNWSLISKSIPGRSGKSCRLRWCNQLSPQVEHRAFTAEEDDTIIRAHARFGNKWATIARLLHGRTDNAIKNHWNSTLKRKCSSTMIDDNTQPLKRSVSAGAAIPVSTGLYMNPPTPGSPSGSDVSESSLPVASSSHVFRPVPRTVKVLPPVETTSSSNDPPTSLSLSLPGVGVVDSSEVSNRTTEPIHFTPPMPHRSNTMPLLPMMTSVSATVMAPFNFSAEFRSVMQEMIRKEVRSYIELHNQNGMCFQAAVNDGFRNASVKRIGISRVDS

SEQ ID NO: 2273 - DNA, 1209 bp, Glycine max
  G4223,family:MYB-(R1)R2R3
ttccatttcctctcacaaaaatcacttattatgaacacacgaaaagacatggaccggatcaaaggcccatggagcccggaggaggacgaggctctgcagaagctggtggagaaacacgggcccaggaactggtccctcatcagcaagtccatcccgggccgctccggcaagtcctgcaggctccgctggtgcaaccagctgtccccccaggtggagcaccgggccttcacccacgaagaggacgacaccattatccgggcccatgcccgcttcggcaacaagtgggccaccatagcccgcctcctccacggcagaactgacaacgccatcaaaaaccactggaactccaccttgaagcgcaagtgcacttcaaccatgattgacgacgacaacactcccccgctcaaaagatccctcagtgccggcgctgctattccagtctccactggactctacatgaaccctcccactcctggtagcccctctggatcagatgtgagtgagtccagcgtactggttgcatcctcctcacatgttttccgacccgtgcctagaacaggcgcggttctaccacccgtagaaacaacaacgactttgtcttccaatgaccctccaacttcactttccctatccctccccggtgttgactcatccgaagtttccaatcgaacaactgagccgattcatgccgcacctcctccgccgccacagccacagccacagccgttgaatactatccctttgctcccaatgatgacggtgccctcggtttctccgacggggatggcgccgtttaattttagcgcagagtttctggcggtgatgcaggaaatgataaggaaggaggtgaggagttatatggagttgcacaatcagaagaatgggatgtgttttcaggctgcggtgaatgatgggtttaggaacgcttcggtgaagcgtattggaattagcagggttgattcgtaaatattatcatcgaagaatggaacaacacaagtagagatgaggaaaaaaactaagaacctgtttttttccctgtttttttttaatcaatgttcttaggcaataattttggttgatgtacagcgagacagaactctcgatccctaaagaggctgaatggaaattggaacgaaagagggagatagatgttacccattagataaaatctgaaatctctgttgtaactttttgtatcctcgcggccgc

SEQ ID NO: 2274 - protein, 311 aa, Glycine max
  G4223,MYB-(R1)R2R3 domain coordinates 11-111
MNTRKDMDRIKGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRKCTSTMIDDDNTPPLKRSLSAGAAIPVSTGLYMNPPTPGSPSGSDVSESSVLVASSSHVFRPVPRTGAVLPPVETTTTLSSNDPPTSLSLSLPGVDSSEVSNRTTEPIHAAPPPPPQPQPQPLNTIPLLPMMTVPSVSPTGMAPFNFSAEFLAVMQEMIRKEVRSYMELHNQKNGMCFQAAVNDGFRNASVKRIGISRVDS

SEQ ID NO: 2275 - DNA, 1061 bp, Glycine max
  G4224,family:MYB-(R1)R2R3
attcggctcggctgcttcggcaaaggacatggatcggataaaagggccatggagtcctgaagaggacgaagcgttacggaggttggttcagacttacggccctaggaactggtccgttataagcaaatccattccgggtcggtctgggaaatcgtgccgcttgcggtggtgcaaccagctgtctccggaggtggagcgccggcctttcacggcggaggaagacgaggcgatcctgaaggctcacgccaggttcgggaacaagtgggccaccatcgcgcgcttcctcaatggccgcaccgacaacgccatcaagaaccattggaattccaccctcaagaggaagtgctccgagcctctctccgagcctcggcctctgaagagatccgccaccgtttcgggtagtcaatccggatccgatttgagcgattcgggtttacccattattcttgcaagaagcgtgagcgtgacggtagctccctctaaccaccttgcggaaaccgcgtcttcttcagtaactgatcctgccacgttattgagtttgtctctaccgggattcgattcgtgcgatggggctaataatgggcctgggccgaatcaggggcccagttgcggcccgttccaggagataccgatgcttggttcccaaaagcagttgttcagccaagagtttatgaaggtgatgcaagagatgatacgagtggaagtgagaaattacatgtctgtactggaacgtaatggtgtgtgtatgcaaaccgatgccattaggaactcggtgttggagaggatgggaattggtagggttgaataatgaattcaagagcggaaaattatattcatattaggtcatggaaaaatgattaggtgaaatcgcagagaaatagtgattctatctttttattttttgttaggttaattatcctttttttaaatgataattattttttatctgtgccgaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2276 - protein, 259 aa, Glycine max
  G4224,MYB-(R1)R2R3 domain coordinates 5-105
MDRIKGPWSPEEDEALRRLVQTYGPRNWSVISKSIPGRSGKSCRLRWCNQLSPEVERRPFTAEEDEAILKAHARFGNKWATIARFLNGRTDNAIKNHWNSTLKRKCSEPLSEPRPLKRSATVSGSQSGSDLSDSGLPIILARSVSVTVAPSNHLAETASSSVTDPATLLSLSLPGFDSCDGANNGPGPNQGPSCGPFQEIPMLGSQKQLFSQEFMKVMQEMIRVEVRNYMSVLERNGVCMQTDAIRNSVLERMGIGRVE

SEQ ID NO: 2277 - DNA, 939 bp, Glycine max
  G4225,family:MYB-(R1)R2R3
caaaccccaaaaaaagaaaagatgaaagcaatgaaacgctgctcttcatcatcttcctcttcttattcttctgcttctgagtccaccccacaaagcaatcaaaataaaaatagtaataacttttgctacaaaataaaaggcccatggagtgccaaggaggatcggattctgaccggcctcgtggaggcccatggcccgagaaactgggcctcgataagccgtcacattaagggtcggtccgggaagtcctgccggcttcggtggtgtaaccaactgagtccaacggtggagcaccgacctttctccacgcgcgaggacgaggttatattacacgcgcacgcgcggttcgggaacaagtgggccaccatcgcgagaatgctaccgggccgaaccgacaatgccgtcaagaaccactggaacgccacgctcaagcggcgtcgttttggtgctgacgtggtggtggaggatgatccgttgaccgcgttgactctggcgccgcccgggagtggttgttgtggccgtggagaggagcggcggggagtttcgccggcggggttttgggatgcgatgcgggacgtggtggcgagggaagtgagagggcacgtgtcttcctcgttttctgacaacttggcctctaatgagggattatccaaatattaatgtttttttttcatgatttattaagggaatttatgtggtttagttattattggacttcaggacccataaggggaacagttcagtgtaaaatttgtattattgattaattaaaaatcaatttaaatatcatactactatttcatatgtaattattataaattttaattatgtaataattgattattaagtgatattataaatattagtatatgtaaatttttttagcgaatggtatatgtaaatatttaaatcaacttatcctaatcatttcgtttgatt

SEQ ID NO: 2278 - protein, 212 aa, Glycine max
  G4225,MYB-(R1)R2R3 domain coordinates 39-139
MKAMKRCSSSSSSSYSSASESTPQSNQNKNSNNFCYKIKGPWSAKEDRILTGLVEAHGPRNWASISRHIKGRSGKSCRLRWCNQLSPTVEHRPFSTREDEVILHAHARFGNKWATIARMLPGRTDNAVKNHWNATLKRRRFGADVVVEDDPLTALTLAPPGSGCCGRGEERRGVSPAGFWDAMRDVVAREVRGHVSSSFSDNLASNEGLSKY

SEQ ID NO: 2279 - DNA, 1340 bp, Zea mays
  G4226,family:MYB-(R1)R2R3
aattcggcacgcgggacgtcccaatcgagctaatctcacaccgccagtgccagtgccagcggcagctgctaatccgtgccgtgttccagcagcgatgggagtggagtcggagtgcgacaggataaagggcccctggagccccgaggaggacgaggcgctgcggcgtctcgtggagcgccacggcgcgcggaactggacggcgatcgggcgcggcatcccggggcggtcggggaagtcgtgccggctgcggtggtgcaaccagctgtcgccgcaggtggagcgccgccccttcacgcccgaggaggacgccgcgatcctggccgcgcacgcccggctgggcaaccggtgggccgccatcgcgcgccttctcccggggcgcaccgacaacgccgttaagaaccactggaactcgtcgctcaagcggaagctcgccaccgccacggcgacctccagcggcagcgatgctgagcgggcgtgcaagcgcgcaagccctggcccggggagcccgacggcgtcggaccgcagcgacctcagccacggctgcggcgccgcgcaggtgttccgtcccgtcccgcgcgccggaggcttcgacgccatcagcgccgcagacgtgcgccctccgcccccgccagcagtcgcagacgaggacccgctcacctcgctctccctctcgctgccggggctggaccagtcgccgtcgggcttccaccacgacagcgcccggagccacttccaggagctctccccctcgtcgtccccgtcgccgcagtctactccacccgccttccctccgcaggcggctccgtctcagtcgtcgtacgcgttcagcggcgagctggttgccgcgatgcaggagatgatccgcgccgaggtgcgcaagtacatgtccggcgcggggctccgcgccggatgcgggcccggggccgtgggcgaggtgtgcatgccgcagctggtggagggtgtgatgcgcgcccccgcggagcgcgtcggcgtcgtcacacggccgtagaaacccggaaacggaccaaatcagatctgatcaatgcgaagcattgtgttaattaagatcccgtccgtcctgtgtagcagcgctacgtagactactactactactagtcgttctctggccgttgtatttagcagaggagctcgcgtttgtttattcttcggcggctgtcgctctgaatccagaaaggaacagagcggcggtgtaaagccgggagcggaagcggaggttggcaataatcgagatcgagcctgccatttctataaccggatgtggccgcggcttgctccaaaaaaaaaaaaaaaaaaaaaaaaaaaaaaaaaaaaaaaaaaaa

SEQ ID NO: 2280 - protein, 304 aa, Zea mays
  G4226,MYB-(R1)R2R3 domain coordinates 11-111
MGVESECDRIKGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLKRKLATATATSSGSDAERACKRASPGPGSPTASDRSDLSHGCGAAQVFRPVPRAGGFDAISAADVRPPPPPAVADEDPLTSLSLSLPGLDQSPSGFHHDSARSHFQELSPSSSPSPQSTPPAFPPQAAPSQSSYAFSGELVAAMQEMIRAEVRKYMSGAGLRAGCGPGAVGEVCMPQLVEGVMRAPAERVGVVTRP

SEQ ID NO: 2281 - DNA, 1018 bp, Zea mays
  G4227,family:MYB-(R1)R2R3
ttgggtaccccctcgaggggccggcccgggccgggggcccgggggccgtgcagagtgcaggtgaagatgatgaagaactaccctggtcctgctagcagcagtagtgttgctgtagaggtgaagaaggggtcatggagccccgaggaggacgccctgctgaccaggctggtggagcagcacgggccccaccgctggagcctcatcagcgccccaatccctggccgctccggcaagtcctgccgactccgctggtgcaaccagctcagccccgacgtgcaccaccgccctttcacgccgcacgaggacgcgctcatcctcgccgctcacgcccgctacggcaacaagtgggccaccatcgcgcgcctccttcccggccgcaccgacaactccatcaagaaccactggaactccaacctccggaggtgcaggcgccgagcggcggcggcggcggtggcctcccgaccgcaggtgcaggacagcgacgacgctcctgctgctgctgctgctcatgatgatcagccggcggctgtggttgctgctggtggtttaggtggtggcaacagcagcagcggtctgccgcctgcagcagcaggggccgcaactgccgaggccgagccgtctctgtccctcagccttggcctcccgctgccagcagcagaaccagctgaagccgcggctgacgacgagagccgcaacagccagggccaggcatcgccgttactggaggaaggagaaggaaacgcgcagctgttggcagtggtgcgccggatggtcagggaggaggtgcaacgccagacgggacagctcgcctactcgctcatggccgcagcagcagccagagccaagggacaccaccgttaatctgtgtgtgatccattgtgcatgctgctgctgctgctgcttcttggatttcccctcctttctccgatatgatcctctctgccaagtgtattttgttttccttcgtttcttgtactaccttcccttgtgttcgtttatgcgattgcgattggacttc

SEQ ID NO: 2282 - protein, 264 aa, Zea mays
  G4227,MYB-(R1)R2R3 domain coordinates 20-120
MMKNYPGPASSSSVAVEVKKGSWSPEEDALLTRLVEQHGPHRWSLISAPIPGRSGKSCRLRWCNQLSPDVHHRPFTPHEDALILAAHARYGNKWATIARLLPGRTDNSIKNHWNSNLRRCRRRAAAAAVASRPQVQDSDDAPAAAAAHDDQPAAVVAAGGLGGGNSSSGLPPAAAGAATAEAEPSLSLSLGLPLPAAEPAEAAADDESRNSQGQASPLLEEGEGNAQLLAVVRRMVREEVQRQTGQLAYSLMAAAAARAKGHHR

SEQ ID NO: 2283 - DNA, 1105 bp, Zea mays
  G4228,family:MYB-(R1)R2R3
ggccacgcgccccaatactcagaactagtcttgagtaaagcatggcgtcgtcttctccgtcctgccgtggcagcggcggcaagtcggacgtggaccggatcaagggcccctggagccccgaggaggacgaggccctgcagcgcctggtggcccgccacggcgcccgcaactggtccctcatcagccggtccatcccgggccgctccggcaagtcgtgccgcctccggtggtgcaaccagctgtcgccgcaggtggagcaccggcccttcacggccgaggaggacgacaccatcctccgcgcgcacgccaggttcggcaacaagtgggccaccatcgcgcgcctcctctccggccgcaccgacaacgccatcaagaaccactggaactccacgctaaagcgcaagtactacgccgccagcgacgctgttgttgctgacgctgacgacgagcgcccgctgaagcgcacaagcagcgacggccacccagggctctgcttcagccccggaagcccatccgggtccgacctcagcgactctagcaaccacagccttccctccgtcatgccgtcagccgcttctgctgccgccgtcacctcccaccagcagcagcagcacgtgtaccgccccgtgccgcgcgcgggcggcgtggtcatgctaccggtggcgcctcttgcgccgccgccgccgccacagcctccggcgacctccttatcactgtccctctccctgcccgggctggacggccagaagcccgaagcatcccaagcggttctgacgccggcaccggcaccgcctcaacctcctcttcagatacagcagcagcagcctgctccacctcagatgccgccaccacaagcccaaccgagcttgccgttccagctgcaggcggccgcgacgaacctcacgtcgcagcagccggcagcagcgccgttcagctcggagttcctgttgttgatgcaggagatgatccggatcgaggtacggaactacatgtccgggtcggggctcgatccgcgcaccgacggcgccgccgtgcacgccgtgagcaagcgtatgatgggtatggccaagatcgagtagtttcagcgcgcatgcacacagcggca

SEQ ID NO: 2284 - protein, 345 aa, Zea mays
  G4228,MYB-(R1)R2R3 domain coordinates 21-121
MASSSPSCRGSGGKSDVDRIKGPWSPEEDEALQRLVARHGARNWSLISRSIPGRSGKSCRLRWCNQLSPQVEHRPFTAEEDDTILRAHARFGNKWATIARLLSGRTDNAIKNHWNSTLKRKYYAASDAVVADADDERPLKRTSSDGHPGLCFSPGSPSGSDLSDSSNHSLPSVMPSAASAAAVTSHQQQQHVYRPVPRAGGVVMLPVAPLAPPPPPQPPATSLSLSLSLPGLDGQKPEASQAVLTPAPAPPQPPLQIQQQQPAPPQMPPPQAQPSLPFQLQAAATNLTSQQPAAAPFSSEFLLLMQEMIRIEVRNYMSGSGLDPRTDGAAVHAVSKRMMGMAKIE

SEQ ID NO: 2285 - DNA, 1036 bp, Zea mays
  G4229,family:MYB-(R1)R2R3
cattgggtacctcgaggccggccgggaaccttcactcccgactccacctctctccgatcgtctcatcttcttccttctcttccaccacatccttggcatctcatccggatcgaccagtacacgccccagtagtactaaagaaccagtttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgcccgacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcaagcgcgagtactacgccgatgcgcgccccggccccggcgaccagcgctcgctcaagcgcaccagcagcgacgggccccccggaagcccgtccgggtccgacctcagcgactccagccaccagagccttcccaccgtgatgccgtcagccgcttctaccgccgtcacctcccagcagcagctacaacacgtgtactaccgccccgtgccgcgcgcgggcggcgtggtcctgctcccggtggcgccgccttctccgcaggctcctccagcaacctccttgtcgttgtccctctccctgccagggctggaccagcagcccgaaccatccccgccgccgccgccaacacctcaagcacaagcaagctcgccgttgagcgcggagttcctgttgatgatgcaggagatgatccggatcgaggtccggaactacatgtccgggtcgggcttcgacgcacacgccgtgatgggcatggccgagatcgactagtttcagcggcaggggtcc

SEQ ID NO: 2286 - protein, 285 aa, Zea mays
  G4229,MYB-(R1)R2R3 domain coordinates 21-121
MAASPSPSGSGGGKAGVDRIKGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKRERERKREYYADARPGPGDQRSLKRTSSDGPPGSPSGSDLSDSSHQSLPTVMPSAASTAVTSQQQLQHVYYRPVPRAGGVVLLPVAPPSPQAPPATSLSLSLSLPGLDQQPEPSPPPPPTPQAQASSPLSAEFLLMMQEMIRIEVRNYMSGSGFDAHAVMGMAEID

SEQ ID NO: 2287 - DNA, 1339 bp, Zea mays
  G4230,family:MYB-(R1)R2R3
tcctccaccactgccccgtcgtggaataggggcaagttcaggcatctcgcttctgtcctggtcgaggggatcggagaaaaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccgcctgcggtggtgcaaccagctgtcgccgcaggtggagcgccggcccttcacggcggaggaggacgcggccatcgtccgcgcccacgcgcgcctcggcaaccgctgggccgccatcgcgcgcctcctccccggccgcaccgacaacgccgtcaagaaccactggaactgctccctcaagcgcaagctcgccgccgcgtccgccccggcgggttcctccgacgtcgacgcgcgcccgaccaagcgcgtcagcctctcgcccgacagcccgtcggggtcggggtcagggtccgggtccgggtccgggtccgaccgtagcgacctgagccacggcgccggccaggtttaccgccccgtggcgcggtccggtgggttcgagccggcggactgcgcgatgagccgtccgctggaggaagaggaggaggaaaaggaggacccgctcacctccctcagcctctcgcttcccggcacggaccagcggttccaccacgaccgcgcccacagccagttccaggagctcccggcgtcgccgccctcgccctccccgcctccgccgccggcgggtccgacctcggcgtacccgttcagccccgtgttcatggaggcgatgcaggagctgatccgcacggaggtgcagcggtacatggcgagcgtgggcgtgcgcgccgggtgcggcgccgccggcggggccgacctctgcatgccgcagctcgtcgacggcgtcatgcgcgccgccgccgagcgggtcggccggatgcagtagctcctgggcgtgcatgagccatcaaatactctcccaaaccgtcaatcgatcttctaggacgaacgcgcagcagctgttcttatcagtagcaaacttccaagttattattttcctttttttaaaactttattctctcgaaccgctgtgaaaccgaaacagcagtgaaaagagtcagcaactgaaaaaaaaaaatatgtgggaactgaaaggtggagaaaaatgtagtaaaggcttgctgaaagccgtgtaaagcgctgcctgcctcctctctctctctctctctctacaggaatgaatcggatcggaacggaatgaaacgagaagagggggacgacgcacattctggtttc

SEQ ID NO: 2288 - protein, 302 aa, Zea mays
  G4230,MYB-(R1)R2R3 domain coordinates 11-111
MGSEADCDRIRGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRKLAAASAPAGSSDVDARPTKRVSLSPDSPSGSGSGSGSGSGSDRSDLSHGAGQVYRPVARSGGFEPADCAMSRPLEEEEEEKEDPLTSLSLSLPGTDQRFHHDRAHSQFQELPASPPSPSPPPPPAGPTSAYPFSPVFMEAMQELIRTEVQRYMASVGVRAGCGAAGGADLCMPQLVDGVMRAAAERVGRMQ

SEQ ID NO: 2289 - DNA, 1402 bp, Zea mays
  G4231,family:MYB-(R1)R2R3
attgctctccaaccaacctccgccctctcctcgtctcgtcttctctccgctaccaccaccactgctcgttttacagaaaccggaaggaaccaaacgcctttccgccccgggccgccgctacccaagcccagcaaccaccactcgttgtcgtcgactactaggcggcaagcaggcgtcctgttttttttttttggtcctcgtcgtcgtccggactccggacaggacaggacatgggcgcggaggcggcggagcgcgacagaatcaggggcccgtggagccccgaggaggacgaggcgctgcggcggctggtggagcggcacggcgcgcgcaactggacggcgatcgggcgcggcgtcccgggccggtcgggcaagtcgtgccgcctgcggtggtgcaaccagctcggacgcgggggggcgcgccgccccttcacggccgacgaggacgcggccatcgcccgcgcccacgcccgcctcggcaaccgctgggccgccatcgcgcgcctgctccccggccgcaccgacaacgccgtcaagaaccactggaactgctccctcaagcgcaagctcggcgccgccgccgccgcgtccggttcggcggtttccgctgacgactccgccgccgccgccgagaccgaggcgcgccggggcaagatgatgatgatgagcatctcgccgcccgacagcccctcggggtcggggtcggggtccgaccgtagcgacctcagcagccacggcgccgggtccgggtccgggtccgggtccggccagatttaccgccccgtggccgcgcgctccggcgggttcgagccggcggactgcgccatgagccgtccgcaggaggaggacccgctcaccgccctcagcctctcgcttcccggcacggaccagcggtttcaccaccacagcgccgccgccgacagccacttccaggagctcccgccgtcgccctcctcacccgcgccctcggcctacccgttcagccccgagttcgcggcggcgatgcagcagctgatccgcaccgaggtgcagcggtacatggcgagcgcgggcctgcgcgccggctgcggcgccgttggcgcgaccgacctctgcatgccgcagctggtggacggcgtcatgcgcgctgccgccgaacaggtcggccggatgcagtagccccgcgcccccggcgggggcatcaaaccgtcagtgctcccaaatcgtcgtctagctagggcgaccgcaacgcaacggttgttggagtagcaaacttggttttaaggtggagggaaaaattggctgggctgaaagcagaaagccttgtaatgtacatgaaagaaacggaacggatggcgcgctacaatctgagctcgccattgccgcatatatctgctttaagagagcattgcgctgccttgcct

SEQ ID NO: 2290 - protein, 308 aa, Zea mays
  G4231,MYB-(R1)R2R3 domain coordinates 12-112
MGAEAAERDRIRGPWSPEEDEALRRLVERHGARNWTAIGRGVPGRSGKSCRLRWCNQLGRGGARRPFTADEDAAIARAHARLGNRWAAIARLLPGRTDNAVKNHWNCSLKRKLGAAAAASGSAVSADDSAAAAETEARRGKMMMMSISPPDSPSGSGSGSDRSDLSSHGAGSGSGSGSGQIYRPVAARSGGFEPADCAMSRPQEEDPLTALSLSLPGTDQRFHHHSAAADSHFQELPPSPSSPAPSAYPFSPEFAAAMQQLIRTEVQRYMASAGLRAGCGAVGATDLCMPQLVDGVMRAAAEQVGRMQ

SEQ ID NO: 2291 - DNA, 927 bp, Zea mays
  G4232,family:MYB-(R1)R2R3
gtacctcgaggccggccgggaaccaaactcctggtcttctcttctccactacccacccgcccgcccgcccgccttctcctccaccactgccccgccgctaaccaaccactctgtgcgccacaagtctcccgtcgtggaatagggcaaaggccaggcatctcgcttctgtcctctgtcgaggggatcggacccgatcggagaaagaatgggctcggaggcggactgcgacaggatcaggggcccgtggagccccgaggaggacgacgcgctgcggcggctcgtggagcggcacggcgcgcgcaactggacggcgatcgggcgcgagatcccggggcggtcgggcaagtcgtgccccctgcggtggtgcaaccagctgtcgccgcaggtggagcgcccccccttcacgcccgaggaggacgccgcgatcctggccgcgcacgcccggctgggcaaccggtgggccgccatcgcgcgccttctcccggggcgcaccgacaacgccgttaagaaccacgacagcgcccggagccacttccaggagctctccccctcgtcgtccccgtcgccgcagtctactccacccgccttccctccgcaggcggctccgtctcagtcgtcgtacgcgttcagcggcgagctggttgccgcgatgcaggagatgatccgcgccgaggtgcgcaagtacatgtccggcgcggggctccgcgccggatgcgggcccggggccgtgggcgaggtgtgcatgccgcagctggtggagggtgtgatgcgcgccgccgcggagcgcgtcggcgtcgtcacacggccgtagaaacccggaaacggaccaaatcagatctgatcaatgcgaagcattgtgttaaaaaaaaaaaaaaaaaaaaaaaaaaaaaaaaaaaaaaaaaaaaaaaaaaaaaaaaaaaaaaaaaa

SEQ ID NO: 2292 - protein, 201 aa, Zea mays
  G4232,MYB-(R1)R2R3 domain coordinates 11-103
MGSEADCDRIRGPWSPEEDDALRRLVERHGARNWTAIGREIPGRSGKSCPLRWCNQLSPQVERPPFTPEEDAAILAAHARLGNRWAAIARLLPGRTDNAVKNHDSARSHFQELSPSSSPSPQSTPPAFPPQAAPSQSSYAFSGELVAAMQEMIRAEVRKYMSGAGLRAGCGPGAVGEVCMPQLVEGVMRAAAERVGVVTRP

SEQ ID NO: 2293 - DNA, 1008 bp, Oryza sativa
  G4234,family:MYB-(R1)R2R3
gaggagattgatcggtgagggaggatgatggcgtcttgtcggagaggagggggaggggatgtggataggataaaggggccgtggagtccggaggaggacgaggcgctgcagcggctggtggggcggcacggggcgcgcaactggtcgctgataagcaagtccatcccggggaggtcggggaagtcgtgccggctgcggtggtgcaaccagctgtcgccgcaggtggagcaccggcccttcactcccgaggaggacgacaccatcctccgcgcccacgcccgcttcggcaacaagtgggccaccatcgccaggctcctcgccggccgcaccgacaacgccatcaagaaccactggaactccaccctcaagcgcaagcaccactcttctctcctcgccgacgacctccgccctctcaagcggacaaccagcgacggccacccgacgctctcctccgccgccgcccccgggagcccctccggctccgacctcagcgactccagccaccatagcctcccctcccagatgccctcctcacccccacacctcctcctccctcagcacgtctaccgcccggtcgcgagggccggcggggtcgtcgtccctcctcctcctcccccgccgcctccggcgacctcgctctccctctctctctcccttcccggcctggatcacccacaccccgatccctccaccccgtcggagcctgcggtacagttgcagccgcctccaccgtctcagatgccgccaccaacaccatcttgtgtacgccaagagccgcctcagatgccgttccagctgcagcccccaccgccgccgcgcccatcggcgccgttcagcgcggagttcttggccatgatgcaggagatgatccggatcgaggtccggaattacatgtccggctccgccgccgtggatcctcggtcgtcgcccgacaacggcgtgcgcgccgccagccgcatcatgggcatggccaagatcgagtaatcaaccagccgcagcagcatacgg

SEQ ID NO: 2294 - protein, 319 aa, Oryza sativa
  G4234,MYB-(R1)R2R3 domain coordinates 17-117
MMASCRRGGGGDVDRIKGPWSPEEDEALQRLVGRHGARNWSLISKSIPGRSGKSCRLRWCNQLSPQVEHRPFTPEEDDTILRAHARFGNKWATIARLLAGRTDNAIKNHWNSTLKRKHHSSLLADDLRPLKRTTSDGHPTLSSAAAPGSPSGSDLSDSSHHSLPSQMPSSPPHLLLPQHVYRPVARAGGVVVPPPPPPPPPATSLSLSLSLPGLDHPHPDPSTPSEPAVQLQPPPPSQMPPPTPSCVRQEPPQMPFQLQPPPPPRPSAPFSAEFLAMMQEMIRIEVRNYMSGSAAVDPRSSPDNGVRAASRIMGMAKIE

SEQ ID NO: 2295 - DNA, 1369 bp, Oryza sativa
  G4235,family:MYB-(R1)R2R3
gaacccccatcgccaccaccaccaccaccactcgcgaactagacagaaaccgcaagaaaccaaacaccttttggctcctccactagtagcaactactcgttgtcgtcgtcgtcgtcgactcgtcgtggtagtagtagtcttcttcgcgtgacgccatgggaggaggaggaggagttgaggcggattgcgacaggatcagggggccgtggagccccgaggaggacgaggcgctgcggcggctggtggagcggcacggcgcgaggaactggacggcgatcgggcgggagatccccgggaggtcggggaagtcgtgccggctgcggtggtgcaaccagctctcgccgcaggtggagcggcggccgttcaccgccgaggaggacgccaccatcctccgcgcacacgcgcggctcgggaacaggtgggccgccatcgcgcgcctcctccagggccgcaccgacaacgccgtgaagaaccactggaactgctccctcaagcgcaagctcgccgtcgccaccaccaccaccaccaccaccaccggcgccgccgccgcgccgggagtggtcgccgatgccgccgagctcgtcgagcggccgtgcaagcggttcagccccacgccggacagcccgtcggggtctggttccgggtcggaccgcagcgacctcagccacggcggcgggttcgggcagattttccggccggtggcgaggaccggcgcgttcgagcccgtcgactgcgccatcagccggcggcaggaggaggatcccttcacctcgctctccctctcgctccctgggacggatcagcggttcaaccacgacagcgcccacagccacttccaagaactcccgtcctccccctcgccgccaccaccacctccccccgccgccgccgcctcgacgacacagtacccgttcaccccggagttcgccgccgcgatgcaggagatgatccgcgccgaggtgcacaagtacatggcgagcgtcggcgtccgcgccgggtgcggcgacgccggcggtgccgacctccacatgccgcagctggtggagggcgtcatgcgcgccgccgcggagcgcgtcgggaggatgcactgatcaaaaacctagcgtccattagaatctctactatcgtttcaactttttttttccttaaaaatttgtttccaaaactgctgtgaaaaccgaaacagcagtccgaaacggaagaaccaaaaaaaaatgcgaggagagatgggaaagaaatgtttcgagctacgaaaaaaaaccgaaaagctcggctacctatgtacaggaaatggaaatggaaatgcaaatgggggaagtgagtggtgaatcatgcaaaaaaaaaaaaatcagaattcaccatttttgct

SEQ ID NO: 2296 - protein, 311 aa, Oryza sativa
  G4235,MYB-(R1)R2R3 domain coordinates 15-115
MGGGGGVEADCDRIRGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRKLAVATTTTTTTTGAAAAPGVVADAAELVERPCKRFSPTPDSPSGSGSGSDRSDLSHGGGFGQIFRPVARTGAFEPVDCAISRRQEEDPFTSLSLSLPGTDQRFNHDSAHSHFQELPSSPSPPPPPPPAAAASTTQYPFTPEFAAAMQEMIRAEVHKYMASVGVRAGCGDAGGADLHMPQLVEGVMRAAAERVGRMH

SEQ ID NO: 2297 - DNA, 912 bp, Oryza sativa
  G4236,family:MYB-(R1)R2R3
atgctgattcacggggagggctcgtcgtcgtcggcggcggcggcgggggggaagatcaaggggtcgtggagcccggaggaggacgagcagctgagaggggcggtggcgaggcacgggccgaggaactggacggcgatcagcgaggaggtgcccgggaggtcggggaagtcgtgccggctgcggtggtgcaaccagctcagccccggggtgcaccgccgccccttcacccccgacgaggacgcgctcatcgtcgccgcccacgccaagtacggcaacaagtgggccaccatcgcgcgcctcctcgacggccgcaccgacaactccgtcaagaaccactggaactcctcgctccgccgcaaccgcagggccgccgccgcggccgccgcggcggctgcatccgtgtcgtaccagtccatggatctcaccgaggaggccgacaacgacgacgagggcaccagcgacgactcggtggcgatccctgcgcagtcgtcgccggcggcggtcgtcgctggtgtccctgtgcttccgccgccgccgcccccggccaagaggctgtgcgtggcgccgcccaccggcgtggagcaccgggctccgccgcccgacccgcctacgtcgctgtcgctcagcccgccgggcgccgccgccgccgccatctcagcctccaccgtggtcggcgggtcgtcggcggcgcgcgcggaggaggaggccgtggcgagggagaaggcgaggatggagcaggacccgtggctgatggcgatgatgcggcagatgatcaccgaggaggtgcagcggcaggtgagcgtggtgtactcgctggtggcatcctccgcggcgatggcggcacagacgggcaacgccggcggcgtcggccggaaagggcccgacggccgcccatccaacggtcaggattga

SEQ ID NO: 2298 - protein, 303 aa, Oryza sativa
  G4236,MYB-(R1)R2R3 domain coordinates 20-120
MLIHGEGSSSSAAAAGGKIKGSWSPEEDEQLRGAVARHGPRNWTAISEEVPGRSGKSCRLRWCNQLSPGVHRRPFTPDEDALIVAAHAKYGNKWATIARLLDGRTDNSVKNHWNSSLRRNRRAAAAAAAAAASVSYQSMDLTEEADNDDEGTSDDSVAIPAQSSPAAVVAGVPVLPPPPPPAKRLCVAPPTGVEHRAPPPDPPTSLSLSPPGAAAAAISASTVVGGSSAARAEEEAVAREKARMEQDPWLMAMMRQMITEEVQRQVSVVYSLVASSAAMAAQTGNAGGVGRKGPDGRPSNGQD

SEQ ID NO: 2299 - DNA, 838 bp, Oryza sativa
  G4237,family:MYB-(R1)R2R3
gaaggtaaatggggatgtgtagcaagacaaggaagaaggggtcgtggagggcggaagaggacgcgctgctgacgaggctggtggcgcagcatggcccccaccggtggagcatcatcagcggcgccatcccggggcgctccggcaagtcgtgccggctgcggtggtgcaaccagctgagcccggccgtgcagcaccgccccttcaccccgcaagaggatgccctcctcgccgccgcccatgcccgccacgggaacaagtgggccaccatcgcccgcctcctccccggccgcaccgacaactccgtcaagaaccactggaactccaacctccggaggtgcctccgccgccaagccaaattcaaatccaaggaccctgatctgctgcccgatccaattaatattccacctgactgcatcgtcgtgctcaacgacgacgacgagcctgcagatcggccggtcacgccgcccgccatcatccaggcccaggcccaggagacactaccgtcgctgaccctgagccttagcctttccctgcccggcgccgctgctgctgctgctgaggttgaggtggcaccgccgccgcccagggcactggcagctgcttctgagatccaagacggcagcagcagatcatcatcggcatcgcgtgtcatgttgcaggtgatgcgacagatggtgagggaagaggtgcagcgccatactgcgcagctcgcctactccctcatggccctggcctcctgcagccgtaggcccccaaattaggagcattcattttcagactttgttcaaacatcgatcgatcatcaaataaaaatttctcaggaggagttgcatgcttg

SEQ ID NO: 2300 - protein, 250 aa, Oryza sativa
  G4237,MYB-(R1)R2R3 domain coordinates 10-110
MGMCSKTRKKGSWRAEEDALLTRLVAQHGPHRWSIISGAIPGRSGKSCRLRWCNQLSPAVQHRPFTPQEDALLAAAHARHGNKWATIARLLPGRTDNSVKNHWNSNLRRCLRRQAKFKSKDPDLLPDPINIPPDCIVVLNDDDEPADRPVTPPAIIQAQAQETLPSLTLSLSLSLPGAAAAAAEVEVAPPPPRALAAASEIQDGSSRSSSASRVMLQVMRQMVREEVQRHTAQLAYSLMALASCSRRPPN

SEQ ID NO: 2301 - DNA, 906 bp, Oryza sativa
  G4238,family:MYB-(R1)R2R3
atggggatggaggcggagtgcgataggataaaggggccatggagccctgaggaggacgaggcgctgcggcggctggtggagcggcacggggcgaggaactggacggcgatcgggagggggatcccggggaggtcggggaagtcgtgcaggctgcggtggtgcaaccagctgtcgccgcaggtggagcgccgcccgttcacggcggaggaggacgccgcgatactccgggcgcacgcccgcctcggcaaccgctgggccgccatcgcgcgcctcctccccggccgcaccgacaacgccgtcaagaaccactggaactcctccctcaagcgcaagctcgccaccgccacggacggcggcgagatcgaccggccgtgtaagcgcgtgagccccgggccggggagcccgacgggatcggagcgcagcgagctcagccacggcggctgcggaagcggaagcggcggcgggcaggtgttccgccccgtgccgcgccccggcggcttcgacgccatcagcgcggcggacgtcgtgcggccgccgcggcggcgggacgacaacgacgacgacggcgacgacgacccgctcacctcgctgtccctctccctctccctcccggggttccaccacgacagcgcgcggagccacttccaggagctcccctccccctcccgctccccttcgccgccgccgtcgccgccggcagcatctccatccgcatacccgttcaacgccgatctcgtctccgcgatgcaggagatgatccgcacggaagtccgcaactacatggccggcgtcgggctccgcgccggctgcggcccgggcgccgtggccgagtccttcatgccgcagctcgtcgacggcgtcatgcgcgccgccgccgagagggtcggcgtcgtgacccgccaataa

SEQ ID NO: 2302 - protein, 301 aa, Oryza sativa
  G4238,MYB-(R1)R2R3 domain coordinates 11-111
MGMEAECDRIKGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRKLATATDGGEIDRPCKRVSPGPGSPTGSERSELSHGGCGSGSGGGQVFRPVPRPGGFDAISAADVVRPPRRRDDNDDDGDDDPLTSLSLSLSLPGFHHDSARSHFQELPSPSRSPSPPPSPPAASPSAYPFNADLVSAMQEMIRTEVRNYMAGVGLRAGCGPGAVAESFMPQLVDGVMRAAAERVGVVTRQ

SEQ ID NO: 2303 - DNA, 1165 bp, Zea mays
  G4253,family:CAAT
tttgctggtggaacgtggaagaagagcgagaacgccaaacgagaaaagaaacccaagccttcgccatcaaaaaaaaaagaaaaaaagaaaaaaaaagagcagaaaaagtagagtagactacgacagcgtccggcgaggaggcggaggcgaagatgaggaagaagctcggcacccggttccccgcggctcgaatcaaaaagataatgcaagcagatgaggatgttggaaagattgcactagcagttcctgttttagtttcgaggtctcttgaattgtttttacaagatttaattgaccgtacttatgaaattactcttcaaagtggagcaaagacactgaattccttccacctgaagcaatgtgtgaagaggtacagttcttttgatttcctaactgaagttgtcagcaaggtaccagatcttggtggcgctgattcctgtggagatgaaagaggattacctagaagaagaaagtcaaatggcagtgacccagagaatgatgaatcaagatctagtaaaatggccataagaaatgcaaacatcagccccagaggacgtgggaggggtcgaggcagaggacgaggtcggccaccaaccaagagaaaggaggttggttatgtacaatttgaagatgagagcagcatgtttgctgaacaaggtgagcccttgccaggagaggaaacagttcaagagatcaatggcaacgagaccatgcctcaaagcacgcaacctccagtagaggctccgccaacagcccttgcacaagctacaacaagttctaaggcggaagaagcgaacagtgatcatcagtcagattggcctatgccagatgccattggaagcatcggtgtcgtgccatctggttttggacatctgacagtgcaggttgaagatgaggactacgacaatgaggattagtcagggtcatcttctcattgtatgcactaacaggactgttctggtgttgtaaaatgtaaatatagtttgaaatagttgccgcagtttacctgtgattgtctgtcgttttatgcggttatgtagtcctgtgtaactttcgttctccaataattgcttggtagttgcttttttacatgattcaagtgttttgtcatatttaacacagtatttgagcaggggtcgactattacaaaaaaaaaaaaaaaaaa

SEQ ID NO: 2304 - protein, 254 aa, Zea mays
  G4253,CAAT domain coordinates 10-86
MRKKLGTRFPAARIKKIMQADEDVGKIALAVPVLVSRSLELFLQDLIDRTYEITLQSGAKTLNSFHLKQCVKRYSSFDFLTEVVSKVPDLGGADSCGDERGLPRRRKSNGSDPENDESRSSKMAIRNANISPRGRGRGRGRGRGRPPTKRKEVGYVQFEDESSMFAEQGEPLPGEETVQEINGNETMPQSTQPPVEAPPTALAQATTSSKAEEANSDHQSDWPMPDAIGSIGVVPSGFGHLTVQVEDEDYDNED

SEQ ID NO: 2305 - DNA, 1165 bp, Zea mays
  G4254,family:CAAT
tcggcgtcacaagacttcgtcgtcaccaaaaaaataaaggtcgtcaccaaaaaaataaagcagaaaaaaacagagagtagtagactacgacagcgtccgtcgaaccggagggtcggaggcggaggcggcgaagatgaggaagaagctcggcacccggttccccgcggctcgaatcaaaaagataatgcaagcagatgaggatgttggaaagattgcattagcagtgcctgttttagtctcgagggctcttgaattgtttttacaagatttaattgaccggacttatgaaattactcttcaaagtggagcaaagacactgaattccttccacctgaagcaatgtgtgaagaggtacagttcttttgatttcctaactgaagttgtcagcaaggtaccagatcttggtggtgctgattcatgtggagatgaaagagtgttacctagaagaagaaagtcaaatggcagtgacccagagaatgatgaatcaagatctagtaaaatggctataagaaatgcaaataccagccccagaggacgtgggaggggtcgaggcagagggcgaggtcggccaccaaccaagagaaaggaagttggttacgtacaatttgaagatgagagcagcatgtttgctgaacaaggtgaaaccttaccaggagagggaacagttccagagatcaacagcggcaacgagattacgcctcaaagcacgcaacctccgctaacagcccctgcgcaagctacaaattctaaggtggaagaagcaagcaccgatcatcagtcagattggcctatgccagatgccactggaaacatcggtgttgggccatctggttttggacatctgacagtgcaggttgatgaagatgaggactacgacaatgaggactagtcagggccatcctctcactgtatgcgctaacaggactgttctggtgttgtaaaatgtaaatatagcttgaagtagctgccgcagcttagctatgattgtctgttatgaggttatgtagttgccctgtgtaacttctgtaattgctttttagttgccttttctctacatgattgactgtcaaagcgttttgtcatatttaactcaaaaaaagggagcacgctctaaaggattctaagtattttgactttattcaactagtatttgagcagtcctgtg

SEQ ID NO: 2306 - protein, 251 aa, Zea mays
  G4254,CAAT domain coordinates 10-86
MRKKLGTRFPAARIKKIMQADEDVGKIALAVPVLVSRALELFLQDLIDRTYEITLQSGAKTLNSFHLKQCVKRYSSFDFLTEVVSKVPDLGGADSCGDERVLPRRRKSNGSDPENDESRSSKMAIRNANTSPRGRGRGRGRGRGRPPTKRKEVGYVQFEDESSMFAEQGETLPGEGTVPEINSGNEITPQSTQPPLTAPAQATNSKVEEASTDHQSDWPMPDATGNIGVGPSGFGHLTVQVDEDEDYDNED

SEQ ID NO: 2307 - DNA, 1388 bp, Zea mays
  G4255,family:CAAT
cgaatttctatttaatgttcctgttcttcccctccgatccgatgtccccaactgcgctcccgtcggcgatcaaacaccggatcgcggcactcgccgccgttgaggaggaggtttccggcgctgcttccagcgccttgccgtcagcaccatgaggaagaagctggacacgcgtttccccgctcctcggattaaaaagatcatgcaaacagatgaagacgtcggcaagattgctcaagctgtacctgttctagtgtccaaagcattggagctatttctgcaagatttatgtgataggacatatgatattacaattcggaagggggtcaagactgtgggttcttcccatttgaaacaatgcatacaaacgtacaacgtctatgacttcttgagggaagtagtcagcaaagttccagacattggtccttctgatgttattgctgatgataagcttggcaaaaggaggaaagccgaagaagatggaagtgaggaagaattgaagaggacaagaaatgagacagaaagctatacaagcaatggcagaggccgtgggagaggtcgtgggagaggtcgccgtggtgtacgtggagcttggcgggaggtggtcacaagtcctgagcaattcaaggaggagaatcaatctagcaaggtagccagcctaaaggtggaggtagcagatgaggtctcgaatgtaactgaagcaaaacaggacactacaccaatgagcaacgccaggccttccttaaggaacattgacttgaatttagatccaaccgatgaagaggatgaggttacagtgccaccccaaccccagctgtcagctccagcaactagttgcgatgcagccactgcagcacctggaccatctgttccacggttaagggaaggagcaaaactcaaggacttctttggtgcttgggaactggctgacatgaacaagatggagatggaccctgtccagtttgctctgtcaacaaaccatagattggaggaggacgaggattatgacaatgaagactagctccgccgttatatagcttcagagttgatgagtaggaatagcaggacaactgtaggttcagcttaactctgtagcagttctcatgtatcatatagccgccaaagctgccgatgtagcttataatgtcccagaggttaaggtcgtttgactagttgactgtaatgttctcaagttaggttctattagcagctattgctttcgcagatagtaccgtttgtacattccagttgctctccagttttatgttatctatccttctgctttcttggatagctgagacctgttggcggatgtatcatgtatggcaagttggcaacaaaaagcaagaaggctttcagattcaaaaaaaaaaaaaaaactattacagtgg

SEQ ID NO: 2308 - protein, 289 aa, Zea mays
  G4255,CAAT domain coordinates 10-86
MRKKLDTRFPAPRIKKIMQTDEDVGKIAQAVPVLVSKALELFLQDLCDRTYDITIRKGVKTVGSSHLKQCIQTYNVYDFLREVVSKVPDIGPSDVIADDKLGKRRKAEEDGSEEELKRTRNETESYTSNGRGRGRGRGRGRRGVRGAWREVVTSPEQFKEENQSSKVASLKVEVADEVSNVTEAKQDTTPMSNARPSLRNIDLNLDPTDEEDEVTVPPQPQLSAPATSCDAATAAPGPSVPRLREGAKLKDFFGAWELADMNKMEMDPVQFALSTNHRLEEDEDYDNED

SEQ ID NO: 2309 - DNA, 1278 bp, Zea mays
  G4256,family:CAAT
agcgatcccaatccccgactcctccggcagcccgcaacgactcgcgccgcctccggtcgcgccgggtccaggtaaagcggcttccatctcctcggtctcagcgcgtcatcccctcctccttcctcttccgtttcccttagggttggagtagacacgtcggctcaaggatccttcgagggtcaggacacttattgattttcaacaaagatctagcatggaaccatcctcacagcctcaaccaatgatgggtgttgggtcacaaccttatcctgctgctgctccctatgtgccagtacctggatctcttgctgttcctcctggctcacagccagcagcagcattccccaatccaactcaactcagtgctcagcaccagatggtgtaccagcaggctcagcaatttcatcaacaacttcagcaacagcaggaacaacagctcagggagttctggactacccagatggatgagatcaagcaagcaaatgacttcaagatccacaccttgccacttgcaaggataaagaagataatgaaggctgatgaggatgtgcggatgatctctgcagaagctcctgttgtgtttgcgaaggcatgcgaggtattcatattagagctgacattgaggtcatggatgcacacagaggagaacaagcgccggaccttgcagaagaacgacattgcagctgccatcaccaggactgatatatatgacttcctggtggacataatcccgagggatgaaatgaaagaggaggggctcggacataatcccatagttggcctgccgcctgctatgggggctccagctgatcatggttctcatccatattactatgtgccagctcagcaggtgcaaggagcaggtatgatgtatggtggccagcagggtcacccagtgacttatatgtggcagacgccgcaagggcaagcggcagagccccccgaagaggagcagcagcagtctgcctgaatgtagcaaatagacgataacagcgaagcaattacatcttatctgaagttctgaacttagttctctaaacaaacaaatatgatttggttatgttaattgtgcagatgattgcaggctgaaacaattgtcgctaattaggtgtcatagcctcatagggtttcctaatggtagtttcgactcccgacgctgccacggcagcagtagaaaatgattgtaatttgcagactaatgtagtaagattagccttttctgtctaatccaatatacgattgaggccctcgaaaaaaaaaagaaaaaaaaaaaaaaaa

SEQ ID NO: 2310 - protein, 251 aa, Zea mays
  G4256,CAAT domain coordinates 84-180
MEPSSQPQPMMGVGSQPYPAAAPYVPVPGSLAVPPGSQPAAAFPNPTQLSAQHQMVYQQAQQFHQQLQQQQEQQLREFWTTQMDEIKQANDFKIHTLPLARIKKIMKADEDVRMISAEAPVVFAKACEVFILELTLRSWMHTEENKRRTLQKNDIAAAITRTDIYDFLVDIIPRDEMKEEGLGHNPIVGLPPAMGAPADHGSHPYYYVPAQQVQGAGMMYGGQQGHPVTYMWQTPQGQAAEPPEEEQQQSA

SEQ ID NO: 2311 - DNA, 1158 bp, Zea mays
  G4257,family:CAAT
ggaggggactaggggagagagagagggggaaggccaagaagaggcttcctctccccccattctccaatccgtgccctagtcgagccagccgcgaggaaggaggcgtctcgcctagcgcccgcccgtcggccgaccttctgctgcaccttcgaactctggaaagatcatagatttttgggcaatagcaagtggacatggaaccatcctctcagcctcagcctgcgatgggtgtcgccgccggtgggtcacaagtgtatcctgcgtctgcctacccgcctgcagcaacagtagctcctcctgctgttgcatctgctggtttacagtcagtgcaaccattcccagccaaccctgcccatatgagtgctcagcaccagattgtctaccagcaagctcaacagttccaccaacagctccagcagcagcaacagcagcagcttcaccagttctgggtcgaacgcatgactgaaatcgaggcaacagctgatttcaggaaccacaacttgccacttgcgaggataaagaagatcatgaaggccgacgaagatgtccgcatgatctcagccgaagctcccgtggtcttcgcaaaagcttgcgagatattcatactggagctgacgctgaggtcgtggatgcacaccgaggagaacaagcgccgcaccttgcagaagaacgacattgccgcagccatcaccaggaccgacatttacgacttcttggtcgacattgttcccagggatgagatgaaggacgacggaatcgggcttcctaggcccgggctgccacccatgggagccccagctgacgcatatccatactactacatgccacagcagcaggtgcctggtcctgggatggtttatggcgcccagcaaggccacccggtgacgtatctgtggcaggatcctcaggaacagcaggagcaagctcctgaagagcagcagtctctgcatgaaagggactgaggatgtcgctcaagctatcacctgatttttcagagctctcattttaggttctctaaactgcaggttttcgttggctaatatcgttgggtatcaaactgaaacaggtagggtgtagcatcatggtagtttgatttctgctgtggtgttagttggagggataatgattagcggctagtggattaaagttacccatacc

SEQ ID NO: 2312 - protein, 255 aa, Zea mays
  G4257,CAAT domain coordinates 90-186
MEPSSQPQPAMGVAAGGSQVYPASAYPPAATVAPPAVASAGLQSVQPFPANPAHMSAQHQIVYQQAQQFHQQLQQQQQQQLHQFWVERMTEIEATADFRNHNLPLARIKKIMKADEDVRMISAEAPVVFAKACEIFILELTLRSWMHTEENKRRTLQKNDIAAAITRTDIYDFLVDIVPRDEMKDDGIGLPRPGLPPMGAPADAYPYYYMPQQQVPGPGMVYGAQQGHPVTYLWQDPQEQQEQAPEEQQSLHERD

SEQ ID NO: 2313 - DNA, 1247 bp, Zea mays
  G4258,family:CAAT
aaatggagacgccgacagcccgacacagcacatcgcagaggtgtctcctttctcccctgttgttgttgatccaaaaagccacctccccccaacccaatcccgtcgtcactctctcactccactgcctccggaacaccctagcaatggagcccaactccagcatccctcccccggtgatgggcgcggcggtggcgtaccctccggcgcccggcgccgcgtaccccgccgggccgtacgcgcacgcgcacgcggccgcgctgtacccgcctcccccggcgccgggtcccccctcctcgcaccagggcggcgcggcggcggcgcagctgcagctgttctgggcggagcagtaccgcgagatcgaggcgacgacggacttcaagaaccacaacctgccgctggcccgcatcaagaagatcatgaaggcggacgaggacgtgcgcatgatcgccgccgaggcgccggtggtgttcgcccgcgcctgcgagatgttcatcctggagctgacccaccgcggctgggcgcacgcggaggagaacaagcggcgcacgctgcagaagtcggacatcgccgccgccgtggcgcgcaccgaggtcttcgacttcctcgtggacatcgtgccgcgggacgaggccagggacgccgaccccgccgccgccgccatgggggcagcagcgcccgggatcccgcagcaccccgccgccgccgaccccaccaccatgggctactactacgtccagccgcagtaaccgatctgccctgttggtattggtacccacgttcttgttgttgttgcccttgccaaccaataactcttaagatggcgttccatcgccgcatctcgtttctggtttcgtaatcaagagggaggcttgtgtgatggtcatggctcatgccatgcttaacagagtgtaagggggtttgcctgtggactgtcgtaactggagtattaatcagtgtattactacttaccctgtccatgcaactcccaactgcctgtcttgttactttgtcatgaacctatctgtataatgtcatgctgttctttagatctctggtaggatagagaagcagtgatctcaggcttgttggtgtcgcgcgcaaatttgatccattttctatgtgtgtgtgtgtgtgtgtttttccccactggtgtgtaatcatgctcctccttggaatagtttcagggacctaattatgtctgctaaatttccagaacatgaatgcgtttctcgccaaaattccagatt

SEQ ID NO: 2314 - protein, 200 aa, Zea mays
  G4258,CAAT domain coordinates 70-167
MEPNSSIPPPVMGAAVAYPPAPGAAYPAGPYAHAHAAALYPPPPAPGPPSSHQGGAAAAQLQLFWAEQYREIEATTDFKNHNLPLARIKKIMKADEDVRMIAAEAPVVFARACEMFILELTHRGWAHAEENKRRTLQKSDIAAAVARTEVFDFLVDIVPRDEARDADPAAAAMGAAAPGIPQHPAAADPTTMGYYYVQPQ

SEQ ID NO: 2315 - DNA, 1247 bp, Zea mays; identical to SEQ ID NO: 2313
  G4258,family:CAAT

SEQ ID NO: 2316 - protein, 200 aa, Zea mays; identical to SEQ ID NO: 2314
  G4258,CAAT domain coordinates 70-167

SEQ ID NO: 2317 - DNA, 1243 bp, Zea mays
  G4259,family:CAAT
aaaaaaagaagcttgccatttcgctcagggccctgcaacgcgcggcagcgcgccacgcgccgagcttggcttgggactgggccgcccggccgcgaggaataaactcactcctgccttcatacgtatccaaatagccgcggcagtacgtgtatgtggttagctatacgcgacctcagctcgggcgcaagctacaacgccgaccaggcgagaagaagcatcgatagtgtgacgagctaacccaccagcagcaacgtaatccaaatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtagacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctggcctcctggcttagctacatgtgcatgatgtcaatcgttcaatgtgccatgctgtgtatattctacagcaaacgtggtaatggagctgctatgcatacagaacgaataaggcgtgacgtgtgagaccgtaagagtacgtagtactaatatgtagatgcacgtgacgtgccaattaatcaaagattaacatgcagttaattaattagatcctccct

SEQ ID NO: 2318 - protein, 245 aa, Zea mays
  G4259,CAAT domain coordinates 55-153
MDNQPLPYSTGQPPAPGGAPVAGMPGAAGLPPVPHHHLLQQQQAQLQAFWAYQRQEAERASASDFKNHQLPLARIKKIMKADEDVRMISAEAPVLFAKACELFILELTIRSWLHAEENKRRTLQRNDVAAAIARTDVFDFLVDIVPREEAKEEPGSALGFAAPGTGVVGAGAPGGAPAAGMPYYYPPMGQPAPMMPAWHVPAWDPAWQQGAADVDQSGSFSEEGQGFGAGHGGAASFPPAPPTSE

SEQ ID NO: 2319 - DNA, 1505 bp, Zea mays
  G4261,family:CAAT
gcgcgagggagagacagagtgaggaaacgagggaaggagacgacgcgctcgcctattggccgccggctccgctccttcgcgcccagtgcgacggccacggcctgagcggcgctgccagcaaggcggctagtatgagcagcatggagtcgcggccgggccgaacgaacctggtggagcccatagggcacggcgccgcgctgccgtccggcggccaggcagtgcagccgtggtggacgagctccggggctgtgctcggtgcagtctcgccagccgtcgtggcggtggcgcccgggagcgggacggggattagcctgtcgagcagcccggcaggtggtagtggtggtggcggcgcggctaaaggagccgcgagtgacgagagcagcgaggattcacggagatctggggaaccaaaagatggaagcgctagtcaagaaaagaaccatgccacatcgcagatacccgctctggcgccagagtatttggcaccatactcgcagctggaactgaaccaatcaattgcttctgcagcatatcagtacccagatccttactatgcaggcatggttgctccctatggaagtcatgctgtggctcattttcagctacctggactaactcaatctcgaatgccattacctcttgaagtatccgaggagcctgtttatgtaaatgccaagcagtaccatggtatcttaagacgacggcagtcccgtgctaaggctgaacttgagaaaaaggtggtcaaagccagaaagccataccttcacgagtctcgtcatcagcacgcgatgaggagggcaagaggaaacgggggacgcttcctgaacacaaagaaaagtgacagtggtgctcccaatggaggcgaaaacgccgagcatctccatgtccctcccgacttactacagctacgacagaacgaggcttgaagtagcggtatggctctggcatccttgaacagcagttcctgtccacgggcgtaggcattcgagaccggattcatatagctctccacagcatacgcgcagccatctctgcggtaacgcacgttctcctgaacgagctttgtagcgagataggtatgcaagtgcaatctgggcgcaggaatccatcatcaagtgcccaatgcccatggggtaggtacgctgtttcaggcaattcattcttggctttcacgttccacccttgtgtaactggtgtgttgtaaatgtgtggaaaactaagcttgtgctctgtatcgggccgttcagcggaactgcaaaacgcctgtataattaagatcgaactttggattaactcggtaatgctttgtctggttttcttttagcttttcaactgtaacacggccacagctgattcatgtgatgtgcttgctaatatttaaataaacaccttgacccggccgggcgcggagtaattttatattttttatattcgggagtccacacaatcgtgtaaggttcctgcgaaccagttctgactttaattgaaccgcccggattcatatg

SEQ ID NO: 2320 - protein, 264 aa, Zea mays
  G4261,CAAT domain coordinates 175-234
MSSMESRPGRTNLVEPIGHGAALPSGGQAVQPWWTSSGAVLGAVSPAVVAVAPGSGTGISLSSSPAGGSGGGGAAKGAASDESSEDSRRSGEPKDGSASQEKNHATSQIPALAPEYLAPYSQLELNQSIASAAYQYPDPYYAGMVAPYGSHAVAHFQLPGLTQSRMPLPLEVSEEPVYVNAKQYHGILRRRQSRAKAELEKKVVKARKPYLHESRHQHAMRRARGNGGRFLNTKKSDSGAPNGGENAEHLHVPPDLLQLRQNEA

SEQ ID NO: 2321 - DNA, 1120 bp, Zea mays
  G4262,family:CAAT
gagagagagagagagggaggagaccttgcagaggagcgaagcaagcaaggtgggaaagaggcagcagcaagggcggcgggctgccggaaggggaacatgctccctcctcatctcacagagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggctgaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattggcggtcgttctgttctactactagtacctgagtacctgctacgcgtcgttgctggttctttgatgaacttggctggacttgaggtgttgactagcgcgaagctgagttccatgtaaacttttgcttcaagaccgatgactggcggcataataa

SEQ ID NO: 2322 - protein, 249 aa, Zea mays
  G4262,CAAT domain coordinates 142-201
MLPPHLTENGAVMIQFGHQMPDYDSPATQSTSETSHQEASGMSEGSLNEHNNDHSGNLDGYSKSDENKMMSALSLGNPETAYAHNPKPDRTQSFAISYPYADPYYGGAVAAAYGPHAIMHPQLVGMVPSSRVPLPIEPAAEEPIYVNAKQYHAILRRRQLRAKLEAENKLVKSRKPYLHESRHLHAMKRARGTGGRFLNTKQQPESPGSGGSSDAQRVPATASGGLFTKHEHSLPPGGRHHYHARGGGE

SEQ ID NO: 2323 - DNA, 1207 bp, Zea mays
  G4263,family:CAAT
gagagagagagagagggaggagaccttgcagaggagcgaagcaagcaaggtgggaaagaggcagcagcaagggcggcgggctgccggaaggggaacatgctccctcctcatctcacagtacgaactgaaaaacaagagtaaagaatttccgtgagatgagacagaatggcgcggtgatgattcagtttggccatcagatgcctgattacgactccccggctacccagtcaaccagtgagacgagccatcaagaagcgtctggaatgagcgaagggagcctcaacgagcataataatgaccattcaggcaaccttgatgggtactcgaagagtgacgaaaacaagatgatgtcagcgttatccctgggcaatccggaaacagcttacgcacataatccgaagcctgaccgtactcagtccttcgccatatcatacccatatgccgatccatactacggtggcgcggtggcagcagcttatggcccgcatgctatcatgcaccctcagctggttggcatggttccgtcctctcgagtgccactgccgatcgagccagccgctgaagagcccatctatgtcaacgcgaagcagtaccacgctattctccggaggagacagctccgtgcaaagctagaggcggaaaacaagctcgtgaaaagccgcaagccgtacctccacgagtctcggcacctgcacgcgatgaagagagctcggggaacaggcgggcggttcctgaacacgaagcagcagccggagtcccccggcagcggcggctcctcggacgcgcaacgcgtgcccgcgaccgcgagcggcggcctgttcacgaagcatgagcacagcctgccgcccggcggtcgccaccactatcacgcgagagggggcggtgagtagggagccccgacactggcaactcatccttggcttatcagcgattcgactcggctctcgctcgtctgaaactgaactctctgcaactactgtaactgtaactaaactgggtgtgcccggattagcggtcgttctgttctactactactagtaccttagtacctgctacgcgtcgttgggtctggactagagccgtgctggttctttgatgaacttggctggacttgaggtgttgactagcgcgaaactgagttccatgtaaacttttgcttcaagaccgatgactggcggcataataagtagcagtaataaccattctt

SEQ ID NO: 2324 - protein, 244 aa, Zea mays
  G4263,CAAT domain coordinates 137-196
MRQNGAVMIQFGHQMPDYDSPATQSTSETSHQEASGMSEGSLNEHNNDHSGNLDGYSKSDENKMMSALSLGNPETAYAHNPKPDRTQSFAISYPYADPYYGGAVAAAYGPHAIMHPQLVGMVPSSRVPLPIEPAAEEPIYVNAKQYHAILRRRQLRAKLEAENKLVKSRKPYLHESRHLHAMKRARGTGGRFLNTKQQPESPGSGGSSDAQRVPATASGGLFTKHEHSLPPGGRHHYHARGGGE

SEQ ID NO: 2325 - DNA, 1091 bp, Zea mays
  G4264,family:CAAT
agatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatacttctgatgcttattatagtgcggttggggtcttgacaggatatcctccacatgccattgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaaatcggaagccatatcttcatgagtcccgacatcgtcatgccatgaaacgggctcgtggatcaggaggacggttcctcaacacaaagcagctccaggagcagaaccagcagtatcaggcatcgagtggttcattgtgctcaaagatcattgccaacagcataatctcccaaagtggccccacctgcacgccctcttctggcactgcaggtgcttcaacagccggccaggaccgcagctgcttgccctcagttggcttccgccccacgacaaacttcagtgaccaaggtcgaggaggcttgaagctggccgtgatcggcatgcagcagcgtgtttccaccataaggtgaagagaagtgggcacaacaccattcccaggcacactgcctgtggcaactcatccttggctcttggaactttgaatatgcaatcgacatgtagcttgagttcctcagaataaccaaaccgtgaagaatatg

SEQ ID NO: 2326 - protein, 300 aa, Zea mays
  G4264,CAAT domain coordinates 155-214
MPVILREMEDHSVHPMSKSNHGSLSGNGYEMKHSGHKVCDRDSSSESDRSHQEASAASESSPNEHTSTQSDNDEDHGKDNQDTMKPVLSLGKEGSAFLAPKLHYSPSFACIPYTSDAYYSAVGVLTGYPPHAIVHPQQNDTTNTPGMLPVEPAEEPIYVNAKQYHAILRRRQTRAKLEAQNKMVKNRKPYLHESRHRHAMKRARGSGGRFLNTKQLQEQNQQYQASSGSLCSKIIANSIISQSGPTCTPSSGTAGASTAGQDRSCLPSVGFRPTTNFSDQGRGGLKLAVIGMQQRVSTIR

SEQ ID NO: 2327 - DNA, 830 bp, Zea mays
  G4265,family:CAAT
agaggaaggagatacaggttcatgttcatttaggtgtcagttcatctgatttctcagaagcaaaatgttgtttggagctcagtgacaccatcttgtaatgcatgtgccttttacgggaaatggaggatcattctgtccatccaaagtctaagtctaaccatggttccttgtcaggaaatggttatgagatgaaaaatccaggccatgaagtttgtgatagggattcatcatcagagtctgatcgatctcacccagaagcatcagcagtgagtgaaagcagtctagatgaacacacatcaactcaatcagacaatgatgaagatcatgggaaggataatcaggacacattgaagccagtattgtccttggggaaggaagggtctgcctttttggccccaaaaatagattacaacccgtcttttccttatattccttatactgctgacgcttactatggtggcgttggggtcttgacaggatatgctccacataccattgtccatccccagcaaaatgatacaacaaatagtccggttatgttgcctgcggaacctgcagaagaagaaccaatatatgtcaatgcaaaacaataccatgcaatccttaggaggaggcagacacgtgctaaactggaggcgcagaacaagatggtgaaaggccggaagccataccttcatgagtctcgacaccgtcatgccatgaagcgggcccgtggctcaggagggcggttccctcacacaaagcagcagccccaggagcagaaccagcagtaccaggcgtcaagtggttcaatgtgctcaaagaccattggcaacagcgtaatctcctag

SEQ ID NO: 2328 - protein, 236 aa, Zea mays
  G4265,CAAT domain coordinates 149-208
MEDHSVHPKSKSNHGSLSGNGYEMKNPGHEVCDRDSSSESDRSHPEASAVSESSLDEHTSTQSDNDEDHGKDNQDTLKPVLSLGKEGSAFLAPKIDYNPSFPYIPYTADAYYGGVGVLTGYAPHTIVHPQQNDTTNSPVMLPAEPAEEEPIYVNAKQYHAILRRRQTRAKLEAQNKMVKGRKPYLHESRHRHAMKRARGSGGRFPHTKQQPQEQNQQYQASSGSMCSKTIGNSVIS

SEQ ID NO: 2329 - DNA, 953 bp, Zea mays
  G4267,family:CAAT
ccttcatccacgaagagctgaagatatcacatgactagttgcagttagtgtggcttttctccctgcttggtcctgattgtgtgctttgccttgcaaaggaaggaatcatgacctctgttgttcagagcgtttcaggtgaccacagggctgaggatcaaagtcatcagaagaagcaaactgaacctggggaccagcaagaagccccagttactagttcagatagccaaccaacagtgggcacaccatcaacagattatgtggcaccctatgcccctcatgacatgagccatgcaatgggtcaatatgcttatccaaatattgatccatactatggaagtctttatgcggcggcttatggtggacatccattgatgcatccaacattagtcggaatgcatccggctggcttacctttgcctaccgatgcaattgaagagccagtgtatgtaaatgcaaagcaatacaatgccatattaagacggcgtcaatctcgggctaaagctgaatcagaacggaagcttgtcaagggccgcaagccctatctccatgagtcacggcatcagcatgccttgaaaagggccaggggagctggaggtcggtttctcaattcgaagtcagatgacaaggaagagaactccgactcaagtcaaaaagagattcagaacggagttgcgccccaaaagggtggccaaccgtcaacccctccgtctcccaacggtgcgtcgtcagcttatcaggcgcctagtcgtgaatgatgattcggaactcacaactgaagagattttagtccctgacgctagttgtggcagcagctttgtacagtaagtgctagcgggcagcagcgaaatggtgtcatagaaaaacgttgacgagtcagacaggttttggagtcttggttttttttcctctgtttattttacctgtctgcaattttagtagctttgtgtcccttc

SEQ ID NO: 2330 - protein, 215 aa, Zea mays
  G4267,CAAT domain coordinates 110-169
MTSVVQSVSGDHRAEDQSHQKKQTEPGDQQEAPVTSSDSQPTVGTPSTDYVAPYAPHDMSHAMGQYAYPNIDPYYGSLYAAAYGGHPLMHPTLVGMHPAGLPLPTDAIEEPVYVNAKQYNAILRRRQSRAKAESERKLVKGRKPYLHESRHQHALKRARGAGGRFLNSKSDDKEENSDSSQKEIQNGVAPQKGGQPSTPPSPNGASSAYQAPSRE

SEQ ID NO: 2331 - DNA, 1228 bp, Zea mays
  G4268,family:CAAT
cgcgcgcagccctcgtccggccgcccgggtccgagcccgctcgctcctcctccccacgttggacagtttaagtgtggcttcattgcatgagtagttgcagttagcgtggcttttctccgtgcttgctcctggtcgtgctttgccttgcaaaggaaggaatcatgacatctgttgttcacagtgtttcaggtgaccacagggctgaggatcaaaatcaacagaagaagcaagctgaacctggggaccagcaagaagccccagttactagttcagatagccaaccaacagtaggcacaccatcaacagattatgtggcaccctatgcccctcatgacatgagccatgcaatgggtcaatacgcttatccaaatattgacccatactatggaagcctttatgcagcagcttacggtggacagccattgatgcatccaccgttagttggaatgcatccggctggcttacctttgcctaccgatgcaattgaagagcctgtgtatgtaaatgcaaagcaatacaatgccatattaagacggcgtcaatctcgggctaaagctgaatcagaacgaaagcttatcaaggggcgtaagccctatctccatgagtcacgtcatcagcatgccttgaaaagggccaggggagctggaggtcggtttctcaactcaaagtcagatgacaaggaagagaactccgactcgagtcacaaagagaatcagaacggagttgcgccccacaggagcggccaaccgtcaacccctccgtctcccaacggtgcatcgtcagctaatcagggcaggcagtcgtgaatgatgattcaaaactcacagctgaagagatttcagcccctgagctagatatggcagcagttttgtacagaaaacgctagtgggcagcagcaacatggtgtcgatcggtcggtcggttgttgtaggacatgttccatagaaaaagcatagacgagtctacaggttttggagccttggtttggtcctctgtgtattcacctttctgtacaatcttagtagcgttgtgtaccttcccctggaaggatagcttcagttagcgcttcagaaagtcaagtgtgtagcatattggcttattgtttgctttgcttggacaatggagatttgggagtggagttcataaccctgctgaataaatactcttagctggctatgtgtatgttggacgacaatatgatccctaatgtagtacacgtgaccacctc

SEQ ID NO: 2332 - protein, 214 aa, Zea mays
  G4268,CAAT domain coordinates 110-169
MTSVVHSVSGDHRAEDQNQQKKQAEPGDQQEAPVTSSDSQPTVGTPSTDYVAPYAPHDMSHAMGQYAYPNIDPYYGSLYAAAYGGQPLMHPPLVGMHPAGLPLPTDAIEEPVYVNAKQYNAILRRRQSRAKAESERKLIKGRKPYLHESRHQHALKRARGAGGRFLNSKSDDKEENSDSSHKENQNGVAPHRSGQPSTPPSPNGASSANQGRQS

SEQ ID NO: 2333 - DNA, 1293 bp, Zea mays
  G4269,family:CAAT
attgggtacctcgaggccggccgggacaagatgagggataaaagaacagcgcaagtggagtgatgcagccgagggggccagaccagaggaagggacggcggggaggtggcaaggcgcagagagcaggttcgtttggcggacgcaccgagggaggcgtgtgggagccatgcttcttccctcttcgtcttcgtcttccgcttccgcttccaaaggtaactcctttgggaaaaccgttaacgatcatctgaggtcaactttgagttttgataacaagcaacctccatttgcaagtcaaaactttgactacggtcaaacaatagcttgcatttcatacccgtacaatcgttctagatcaggagatgtttgggcagcctatgagtcacgcaccagcactgccactgtgttccgttcccaaattgctggtgggggttcatccacaagaattcccttgcctttggaattagcagagaatgaacccatatatgtgaatcccaaacaatatcacgggatacttcgcagaagacagttacgtgccaagttagaggctcagaacaagctagtcagagcccgaaagccttaccttcatgagtctaggcatcttcatgcaatgaagagggcacgaggttccggtggacgattcctcaacactaagcagctccagcagtctcacacagccctcaccaggtccaccaccacaagtggcacaagctcctcaggctcaactcatctgcggcttggtggtggcgcagccgcagctggagatcgatctgtgctggcacccaaaacaatggcctcacaagacagtagcaagaaggctgtttcttcagctctcgccttcactgtgactccaatgctgcgcagagatgacggcttcttgcagcacccaagccatcttttcagtttttctggtcattttgggcaggcaagcgcgcaagctggcgtccataatggaagtcagcatagggttccagttatgagatgacaggtttgcgaaccatagctggtgatccaggcgtctagggtcaacttcgctgtggtgtcttagtctctcaggcaattcatccttggcttaatttctggctttttattagaaggtaccaaaatgtgttccataccgttgtggccacagagcccataaaccagggggtttgatggttggcactcctacccaaactattgttgcagtggtgtttgttagaataaaccttgactattattctgtacaatttgcctttatcttgtactgccaattattgtgtagtggtcacctgtccagtttatggcctcaagact

SEQ ID NO: 2334 - protein, 271 aa, Zea mays
  G4269,CAAT domain coordinates 103-162
MLLPSSSSSSASASKGNSFGKTVNDHLRSTLSFDNKQPPFASQNFDYGQTIACISYPYNRSRSGDVWAAYESRTSTATVFRSQIAGGGSSTRIPLPLELAENEPIYVNPKQYHGILRRRQLRAKLEAQNKLVRARKPYLHESRHLHAMKRARGSGGRFLNTKQLQQSHTALTRSTTTSGTSSSGSTHLRLGGGAAAAGDRSVLAPKTMASQDSSKKAVSSALAFTVTPMLRRDDGFLQHPSHLFSFSGHFGQASAQAGVHNGSQHRVPVMR

SEQ ID NO: 2335 - DNA, 801 bp, Zea mays
  G4270,family:CAAT
cccgagggcttcggcttcggccacgccgccgccgcggccagcggagcgccgctgccgtggtgggcagggccggccccgatgctgagcggcgagccgctggccctgtcgccggaggcccactgccgggacggccgcatccaggcccccctggcacctcccgtgccgtcggtcaaggctcctgtactggcaccccagcagccgcctccgctgccggagagggggatccctgagctcctcaacctctccgtggatcctcaaggtaaagggaagaaaggatctgatcactctgccactattgctttgcaatcaccatttgcaatatacaatgctcattttgagctgggccttggtcaatcaatgatttccgctgataattcttatgctgatcaacactatggcctgctttctccttatccaatgggtgcaacgcctggaggtcgtctgcttataccactgaataggccaacagaagcaccaatttatgtgaacgctaagcaatatgacgccatcatgcgtcggcgctgtgcccgtgccaaagcagagagggaaaacaggctggtcaaaggcaggaagccatatctccatgagtcacgccatcagcatgcactgcgtcgcccgcgaggctctggcggacgcttcctgaacacaaagaaagaatccagcgggaaggatgctggtggtggcagcaaggcaatgttcagcaaccccctcatgcgccaggtggcgtctccaagctcagagatccagcagtcagacctgggcaacccgagcagcgtgtccagcctgtcgggttcagagtga

SEQ ID NO: 2336 - protein, 240 aa, Zea mays
  G4270,CAAT domain coordinates 131-191
MLSGEPLALSPEAHCRDGRIQAPLAPPVPSVKAPVLAPQQPPPLPERGIPELLNLSVDPQGKGKKGSDHSATIALQSPFAIYNAHFELGLGQSMISADNSYADQHYGLLSPYPMGATPGGRLLIPLNRPTEAPIYVNAKQYDAIMRRRCARAKAERENRLVKGRKPYLHESRHQHALRRPRGSGGRFLNTKKESSGKDAGGGSKAMFSNPLMRQVASPSSEIQQSDLGNPSSVSSLSGSE

SEQ ID NO: 2337 - DNA, 1069 bp, Zea mays
  G4272,family:CAAT
ttgggtacctcgaggccggccgggagagactcgccaaatttccctccctcctcctagccttctcgtcgctcctgttcttctcgcatcctgctctcccatccccatccccagcccaggtggtgtcccctgtcgcgttgatgcatgctccctcggcggtggccttgagctgaggcggcggagcgatgccggactcggacaacgactccggcgggccgagcaacgccgggggcgagctgtcgtcgccgcgggagcaggaccggttcctgcccatcgccaacgtgagccggatcatgaagaaggcgctcccggccaacgccaagatcagcaaggacgccaaggagacggtgcaggagtgcgtgtccgagttcatctccttcatcaccggcgaggcctccgacaagtgccagcgcgagaagcgcaagaccatcaacggcgacgacctgctgtgggccatgaccacgctcggcttcgaggactacgtcgagccgctcaagcactacctgcacaagttccgcgagatcgagggcgagagggccgccgcgtccgccggcgcctcgggctcgcagcagcagggcgagctgcccagaggcgccgccaatgccgccgggtacgccgggtacggcgcgcctggctccggcggcatgatgatgatgatgatggggcagcccatgtacggcggctcgcagccgcagcaacagccgccgcagcctcagccgccacagcagcagcagcagcaacatcaacagcatcacatggcaatgggaggcagaggaggattcggccaacaaggcggcggcggtggctcctcgtcgtcgtcagggcttggccggcaagacagggcgtgagttgcgacgatacgttcagaatcagaatcgctgatactcctacgtagaattatacctacctaattgatgacaccgcaccgcacctcgttgtgctgcctgtccttgtacgtttactaattactgctgcctgtatgtaaatcaaaatctgaggctcccatttcgaaacggacggtgaactactcttcccgtttcgtttcatacgagaatcgaactcgttttcaatt

SEQ ID NO: 2338 - protein, 220 aa, Zea mays
  G4272,CAAT domain coordinates 22-118
MPDSDNDSGGPSNAGGELSSPREQDRFLPIANVSRIMKKALPANAKISKDAKETVQECVSEFISFITGEASDKCQREKRKTINGDDLLWAMTTLGFEDYVEPLKHYLHKFREIEGERAAASAGASGSQQQGELPRGAANAAGYAGYGAPGSGGMMMMMMGQPMYGGSQPQQQPPQPQPPQQQQQQHQQHHMAMGGRGGFGQQGGGGGSSSSSGLGRQDRA

SEQ ID NO: 2339 - DNA, 958 bp, Zea mays
  G4273,family:CAAT
acaagcacaaagagaggccccgaccgcgatggatcgtcagcgacagaccgaccgtgacacagccaacaactaacacgcacgcgcgcgagagagaaagagagctgcccgggagagagagagagaggaaatcaaacgaaggcgacgacgtacggagacggcatggccgatcaccaccaccaccaccaccacgggcatccgccggacgggcccggcggcgcgggggaccagctggaggtaatcaaggagcaggaccggctgctgcccatcgccaacgtcggccgcatcatgaagcagatcctgccgcccaacgccaagatctccaaggaggccaaggagacgatgcaggagtgcgtgtccgagttcatcagcttcgtcacgggcgaggcctccgacaagtgccacaaggagaagcgcaagaccgtcaacggcgacgacgtctgctgcgccttcggcgcgctcggcttcgacgactacgtcgaccccatgcgcaggtacctgcacaagtaccgcgagctcgagggcgaccgcgccgcgtcctcccgcggcggaggcggaggcggaccggccggcgccggagaccccgcgtccgcctcggccgccgccggtcccagccccagcgccgcatcagccggtcatttcatgttcggcgccgccatggaccggcccgacaacaactcatccgccggcgccaggcccttttaatccatccttcctcatcttgcttgttattattcatcagattcagatcaacaacaaaagctacctgcgacgagctagcttaattagcttattgatttctactactgctactcattcttttgggacaggtgagtccccggtctcgtatcgcatatacaatccaaattcttgcaagctatatctatctctttattagcgctagctagtcacaacagtccgcatatatgtatcggggaaaaaagaatcgggggttgggatg

SEQ ID NO: 2340 - protein, 180 aa, Zea mays
  G4273,CAAT domain coordinates 28-117
MADHHHHHHHGHPPDGPGGAGDQLEVIKEQDRLLPIANVGRIMKQILPPNAKISKEAKETMQECVSEFISFVTGEASDKCHKEKRKTVNGDDVCCAFGALGFDDYVDPMRRYLHKYRELEGDRAASSRGGGGGGPAGAGDPASASAAAGPSPSAASAGHFMFGAAMDRPDNNSSAGARPF

SEQ ID NO: 2341 - DNA, 1443 bp, Zea mays
  G4275,family:CAAT
attttaacaaattttacgactgtcgtgcatatgtccggatatcaacccctcccctcgtattaggccccacctccccgcgcgccctaaccctagcttctcgattcaactctgcgcgagacgaattctctcccgaattcgctcgccgaaagcacctgctacctcgcgcccgccttccgtcgcgcggattcggtgccgtgcgtggagatggacccgatggacatcgtggggaagtctaaggaggacgtttccctccccaaatcaacaatggttaagataattaaggagatgcttcctcctgatgtacgagtggcaagagatgcacaggatcttcttgttgaatgctgcgtagagttcatcaatctcctttcgtctgaatccaatgaagtgtgcagcagagaagagaagaaaacaattgctcctgagcatgttatcaaggctctaagtgatcttggcttcagagagtacattgaggaggtttatgctgcgtatgaacagcacaaactcgagactctggattctccaaaagctggcaagttcactaggattgagatgacagaggaagaagctgttgctgagcaacaaaggatgtttgctgaggctcgagcaaggatgaataacggagcccccaagccaaaggagccagaacaagaaccgccacagctaccacaagcacaaccccaacttcagctgcatactgaaccacagcaacccatgcaatctcaagttcagttgcattcgcaaacacaacactccctccaacctcaactgcagctccaccatcagccacaacagctcccacaagtgcagctgcactctcagccgcagctgcaaccccaagtgcatctgcaccctcagccgcagttgcccccacaattgcaggtccatcagcagctgcagcaatccccacaagtgcaggtccacgagcagccccaagtgcagccccaagaagcgcagttgcaatcatcagcccagcaaacctcccaaccccaacctcaggtacaactacaatcacaggggcactcacaagcgcaactgcaagccggactgctgggtcagttgcagacacaggcgcaaaccggacctggcatggatagttagagactattgtgtagcctgagtataagcaaaaaagggaaaaaaaaccaggcacttttgctgcatctactagaaacctgtatgcctgcttgtgactcattagatcctgatttaggtttccgtgcttcctgtagaatgtaaatgcagtgtgattgcagttgccttgttgctaataatgcgaagccgttagttactgatgatgtcattattgtgtggaatactgaattcgtgacaagtgtcatggcatggttttatgtgacgtgctgaaagatattccgttgccattgtaataaccgaacttcgacatttgtccatggtgatagcgactgatttgaaatgagtcttgct

SEQ ID NO: 2342 - protein, 297 aa, Zea mays
  G4275,CAAT domain coordinates 11-99
MDPMDIVGKSKEDVSLPKSTMVKIIKEMLPPDVRVARDAQDLLVECCVEFINLLSSESNEVCSREEKKTIAPEHVIKALSDLGFREYIEEVYAAYEQHKLETLDSPKAGKFTRIEMTEEEAVAEQQRMFAEARARMNNGAPKPKEPEQEPPQLPQAQPQLQLHTEPQQPMQSQVQLHSQTQHSLQPQLQLHHQPQQLPQVQLHSQPQLQPQVHLHPQPQLPPQLQVHQQLQQSPQVQVHEQPQVQPQEAQLQSSAQQTSQPQPQVQLQSQGHSQAQLQAGLLGQLQTQAQTGPGMDS

SEQ ID NO: 2343 - DNA, 543 bp, Zea mays
  G4276,family:CAAT
ctcctcttctccagcgtccgatccccgtttcccacgaatcccactctactcctccatctgcggcctcctccattctcctgcccccttctctctcctccttgcttccccgcgcgcacgtttttacaagggtttcggcggaggcgaccggtcgccgacgatggcggacgacagcggcagccacgagggcggcggcggcggcggcgacgacgtccgggagcaggacatgttcttgcctattaccaacatcacccggatcatgaagaaggccgtcccggccaatgccaagatcactaaggacgctaaggagataatgcagtactgcgtctccgagttcatattctttgtgacgagcgaggcgagggagaaaagcaaaaaggaggagcgtaagagaatcaacgtggacgatttgctctggtcagtggatacggcaggattcgagtacgtggagcttctcaggatttgcctacaaaagtacagagagacggggaagtgcacggtgtacacgacgtgatcaggttattaacctgtaacaccttaatgaga

SEQ ID NO: 2344 - protein, 117 aa, Zea mays
  G4276,CAAT domain coordinates 19-108
MADDSGSHEGGGGGGDDVREQDMFLPITNITRIMKKAVPANAKITKDAKEIMQYCVSEFIFFVTSEAREKSKKEERKRINVDDLLWSVDTAGFEYVELLRICLQKYRETGKCTVYTT

SEQ ID NO: 2345 - DNA, 732 bp, Oryza sativa
  G4294,family:AP2
atgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctga

SEQ ID NO: 2346 - protein, 243 aa, Oryza sativa
  G4294,AP2 domain coordinates 5-72
MGQSKKKFRGVRQRHWGSWVSEIRHPLLKRRVWLGTFETAEEAARAYDEAAILMSGRNAKTNFPVARNATGELTPAAAVAGRDGRVGGGSGSSSSMTANGGGNSLSQILSAKLRKCCKTPSPSLTCLRLDPEKSHIGVWQKRAGARADSSWVMTVELNKDTAVSSAATVAAATAVSSSDQPTPSDSTVTTTSTSTTGSPSPPPPAMDDEERIALQMIEELLGRSGPGSPSHGLLHGGEGSLVI

SEQ ID NO: 2347 - DNA, 893 bp, Zea mays
  G4297,family:Z-CO-like
cggacgcgtgggcggacgcgtgggcggacgcgtgggcctggagggtgcaagggagggaggcggtcggactagttctagggcggtcgaatccgccagcgcatccgctgagcaccgccagccccgcacgcggaggtcggagggctacgctccggagtccgaggggaaggcagaggaggcaagcaggcaggatgggtgccgctggtgacgccgcggcagcgggcacgcggtgcgagctctgcgggggcgcggcggccgtgcactgcgccgcggactcggcgttcctctgcccgcgctgcgacgccaaggtgcacggcgccaacttcctggcgtccaggcacgtgaggcgccgcctgccgcgcgggggcgccgactccggggcgtccgcgtccagcggctcctgcctgtccacggccgactccgtgcagtcgagggcggcgccgccgccagggagaggcagagggaggagggcgccgccgcgcgcggaggcggtgctggaggggtgggccaggaggaagggggtcgcggcggggcccgcgtgccgtcgtcgcgtcccgctccgcgtcgcgatggccgccgcgcgctggtcggaggtcagcgccggcggtggagcggaggctgcggtgctcgcagttgcggcgtggtggatgacgcgcgcggcgagagcgagacccccggcggcgggcgctccggacctggaggagggatgggccgagtgctctcctgaattcgtggtccggcagggcccacatccgtctgcaacaacatgtgggcgacgttagtttgtccttttcctccctaattattttagtaattaacgagatcgatcgtgtggtggtggtgtcgttggcttcctctcgtcgtccgattaacaaaagccggttcgatttgattac

SEQ ID NO: 2348 - protein, 196 aa, Zea mays
  G4297,Z-CO-like domain coordinates 14-55
MGAAGDAAAAGTRCELCGGAAAVHCAADSAFLCPRCDAKVHGANFLASRHVRRRLPRGGADSGASASSGSCLSTADSVQSRAAPPPGRGRGRRAPPRAEAVLEGWARRKGVAAGPACRRRVPLRVAMAAARWSEVSAGGGAEAAVLAVAAWWMTRAARARPPAAGAPDLEEGWAECSPEFVVRQGPHPSATTCGRR

SEQ ID NO: 2349 - DNA, 1094 bp, Oryza sativa
  G4298,family:Z-CO-like
gcacgaggcctcgtgccgaattcgggacggcgccagcgtctcgctcccaagccagacctcccccctcgccgtccgcgcgcgcgcccgcggtttcccccgctcgccgccggtttcccccgctcgccgccggtttccccgaagcgcgccgcgcccgcgcctgcgcccgccggtcgccatcgccatctcgccctcgcgcggagactggtgtccctgttttgctctgtagtataaagccacgcaaacccccgccaggtgttcgaccgagtgacacaagagtccagcctcttgcaacctgtaatggaggtcggcaacggcaagtgcggcggtggtggcgccgggtgcgagctgtgcgggggcgtggccgcggtgcactgcgccgctgactccgcgtttctttgcttggtatgtgacgacaaggtgcacggcgccaacttcctcgcgtccaggcacccccgccgccggtggggcgttgagctggtggatgatggggggcgcgcccggcgccgccccccgcccccggggggggctgggccgagtgctcctgatccgccgccgccgccggccaccgcacgacgaatcttccggccgcctgagatagaaagtactaaaaatgcgaaacttgtgggcaatgattgtttgtttgcttcctccctaattaattaaattaatctcaaattcttaatcaccatcaaggacccaaaaatcttgtggtttaggaaggcctctcttgtggttaacatcaaatcacaagtctaaatccaatggatgggactctaatttttctgtgtagtattagtataccatgatgatagtacatttgatttgttattaattggttattaattaaaggtgatttgatcaactagactttatgtggtcaaaaatgtctccctgtattgtatgagtgaccactaccactcgatatttttttccttccatcttggctgagtcctgtcttgtgtttgtttattggtatctcaatgtactgggcttaccacttgtatggacagtattgttacactaacacagtgtgtaccccccagtcgtgttagcttgaatgggaagaccatgatcaaaaaaaaaaaaaaaaaaaa

SEQ ID NO: 2350 - protein, 121 aa, Oryza sativa
  G4298,Z-CO-like domain coordinates 15-56
MEVGNGKCGGGGAGCELCGGVAAVHCAADSAFLCLVCDDKVHGANFLASRHPRRRWGVELVDDGGRARRRPPPPGGAGPSAPDPPPPPATARRIFRPPEIESTKNAKLVGNDCLFASSLIN

SEQ ID NO: 2351 - DNA, 1662 bp, Solanum lycopersicum
  G4299,family:Z-CO-like
ttattaaataataacaaactagtcaaatattacatctaccatgtaatacagtataatataaatacaatatgaatcaatggataacaaatgatccaaatgtaaatctaaatgaagataaaagagtgaatttcgcactttttatatatagagtggttaacttttgagtccacactccacaatatggtaaatgcatttatggttaatacaaagtccacaaccacaacacttggctttccttcaatctctcctttctttcctttactcaataatattactggacactcctcactttttcttttaaaccacatatataaattcaatcaataatacacttcacaaatcattctaaagtctaaattctcattacgtagcactctttgctatctcaccttactcattcctcttcctcctatatcttttctctccgccccattttcactatcacaaatcaaagcttccaaaatttagaaattgtatacaaaaatggaacttctgtcctctaaactctgtgagctttgcaatgatcaagctgctctgttttgtccatctgattcagcttttctctgttttcactgtgatgctaaagttcatcaggctaatttccttgttgctcgccaccttcgtcttactctttgctctcactgtaactcccttacgaaaaaacgtttttccccttgttcaccgccgcctcctgctctttgtccttcctgttcccggaattcgtctggtgattccgatctccgttctgtttcaacgacgtcgtcgtcgtcttcgtcgacttgtgtttccagcacgcagtccagtgctattactcaaaaaattaacataatctcttcaaatcgaaagcaatttccggacagcgactctaacggtgaagtcaattctggcagatgtaatttagtacgatccagaagtgtgaaattgcgagatccaagagcggcgacttgtgtgttcatgcattggtgcacaaagcttcaaatgaaccgcgaggaacgtgtggtgcaaacggcttgtagtgtgttgggtatttgttttagtcggtttaggggtctgcctctacgggttgccctggcggcctgtttttggtttggtttgaaaactaccgaagacaaatcaaagacgtcgcaatctttgaagaaattagaggagatctcgggtgtgccggcgaagataatattagcaacagaattaaagcttcgaaaaataatgaaaaccaaccacggccaacctcaagcaatggaagaaagctgggctgaatcctcgccctaattttctttgtttttggagaatattcccacacctcttttgattttcattttctatttttctatcttctaaatttgtgaaaaacattagaaaaatggaaaagtttgaactggaaaatccattttaccacagtattttccttttgtttttcgttttttctacatttttatcaagctgttgaaaccataaagtccgtgtcggaccaccggaaaaaatgaaaaaaaaattggaggaagaatcttctcaaaggacaaactaaaagttagacccacactatataatacatgggttcaaattcaacaaaaaataatccagggttggccccccactattaataaacttggtcaaaaattaagttttttaaaatctggggtattcacaccaaatttttatata

SEQ ID NO: 2352 - protein, 261 aa, Solanum lycopersicum
  G4299,Z-CO-like domain coordinates 9-54
MELLSSKLCELCNDQAALFCPSDSAFLCFHCDAKVHQANFLVARHLRLTLCSHCNSLTKKRFSPCSPPPPALCPSCSRNSSGDSDLRSVSTTSSSSSSTCVSSTQSSAITQKINIISSNRKQFPDSDSNGEVNSGRCNLVRSRSVKLRDPRAATCVFMHWCTKLQMNREERVVQTACSVLGICFSRFRGLPLRVALAACFWFGLKTTEDKSKTSQSLKKLEEISGVPAKIILATELKLRKIMKTNHGQPQAMEESWAESSP

SEQ ID NO: 2353 - DNA, 564 bp, Glycine max
  G4340,family:IAA
atggccaaagaaggtcttggacttgaaatcaccgagctaaggttgggtctacccgatgcggagcatgtaactgtggtcaataagaatgagaagaagagggccttctcgcaaattgatgatgaaaatagctcctccggcggcgaccggaaaatcaagaccaataagagtcaagtggtggggtggcctccggtgtgctcttaccggaagaagaacagcatgaacgaaggttcaaagatgtacgtgaaggttagcatggacggtgctcctttcttgcgcaaaattgatttgggtctccataaggggtactcagatttagccttggctttggacaagctctttggttcctatggaatggtggaggccttgaagaatgcggacaattctgaacacgttcccatttatgaggacaaagatggtgactggatgcttgttggagatgtcccttgggaaatgtttatggagtcatgcaagaggctgaggattatgaagaggtcagatgccaagggcttcggtttgcaaccaaaaggatctctgaagggattcatagaaagcgcggcaaagtag

SEQ ID NO: 2354 - protein, 187 aa, Glycine max
  G4340,IAA domain coordinates 11-19,57-69,80-96,134-167
MAKEGLGLEITELRLGLPDAEHVTVVNKNEKKRAFSQIDDENSSSGGDRKIKTNKSQVVGWPPVCSYRKKNSMNEGSKMYVKVSMDGAPFLRKIDLGLHKGYSDLALALDKLFGSYGMVEALKNADNSEHVPIYEDKDGDWMLVGDVPWEMFMESCKRLRIMKRSDAKGFGLQPKGSLKGFIESAAK

SEQ ID NO: 2355 - DNA, 540 bp, Glycine max
  G4346,family:IAA
atggagaaagaagctgttggccttgaaatcactactgagctaaggttgggccttcccggtggggaattacctgacaagaacgagaagataaagaagagggtgttctccgagattcaagctcatgatgatgatgaaaacagttcctccgaacaagaccgcaaaatccaaaccaagaatcaagtggtggggtggcctccggtgtgttcgtaccgcaagaagaacaccgtcaatgaaaccaaaatgtacgtcaaagttagcatggacggggctcctttcttgcgtaaaattgatttagctatgcacaagggatattcggagctggtcttggccttggagaagttcttcggttgctatggaattcgcgaagcgttgaaggatgcggagaatgctgaacacgttcccatatacgaggacaaagatggtgactggatgctcgttggagatgtcccttgggagatgtttattgagtcatgcaagaggttgaggattatgaagagatcagatgcaaagggcttcgatgtggaacacagagggctttag

SEQ ID NO: 2356 - protein, 179 aa, Glycine max
  G4346,IAA domain coordinates 12-20,60-72,82-98,136-169
MEKEAVGLEITTELRLGLPGGELPDKNEKIKKRVFSEIQAHDDDENSSSEQDRKIQTKNQVVGWPPVCSYRKKNTVNETKMYVKVSMDGAPFLRKIDLAMHKGYSELVLALEKFFGCYGIREALKDAENAEHVPIYEDKDGDWMLVGDVPWEMFIESCKRLRIMKRSDAKGFDVEHRGL

SEQ ID NO: 2357 - DNA, 732 bp, Populus trichocarpa
  G4347,family:IAA
gaagaaaattgaaacctttgcccatcaccaagaaaagaaaatggcacaacctcttggacttgaaatcacagagctaaggttgggtctaccgggcaacgatgatggacataaaaatgacaagaaaagggttttctctgaggtgtccggcgaagcaaacagcacaaccgatgaccgaaaagttcaaacaaagagtcaagttgtggggtggccaccagtttgttcgtatcgaaaaaacattagtttcaatgagagagatcgccatcatgaaacttcaaaaatttacgtgaaagtaagcatggatggagctccttttcttcgaaaaattgatttgggcatgcataaagagtattcggatcttgttgtcgcgttggagaggttgtttggctgttatggaattggcaaagccttgaaggatgaatacgttcccatatatgaagacaaggatggagactggatgctagtgggagacgtgccttgggagatgttttttgagtcttgcaagaggctaaggatcatgaagagttcagaagccaaaggttttgggctgcagccaagaggcgctcttaagggaatttcaaaagatgatcgtcactgagaaactacaacatattgaactcgggagaacttgaatgaattgtcttaatttttcgtaagcataaacatttctgtttaattcgtgattattggttaattaagaacagacgatcgattcaccatcaagttgtagcttaa

SEQ ID NO: 2358 - protein, 184 aa, Populus trichocarpa
  G4347,IAA domain coordinates 10-18,52-64,81-96,131-165
MAQPLGLEITELRLGLPGNDDGHKNDKKRVFSEVSGEANSTTDDRKVQTKSQVVGWPPVCSYRKNISFNERDRHHETSKIYVKVSMDGAPFLRKIDLGMHKEYSDLVVALERLFGCYGIGKALKDEYVPIYEDKDGDWMLVGDVPWEMFFESCKRLRIMKSSEAKGFGLQPRGALKGISKDDRH

SEQ ID NO: 2359 - DNA, 570 bp, Populus trichocarpa
  G4348,family:IAA
atggcacaacctcttggacttgaaatcacagagctaaggttgggtccaccgggcagcgaaaatggaccaaaaaatgaaaagaaaagggttttctcagagttgtccggcgaagcaaacagcacaaccgatgggcgaaaaacccaaacaacgagtcaagttgtggggtggccaccagtatgttcctatcgaaagaagaatagtttcaatgagaaagatagccatgaaacttcaaaaatttacgtgaaagttagtatggacggagctccttttctcagaaaagttgatttgggcatgcacaaggagtattcggatcttgttgtcgcgttggagaagttgtttggctgttttggaatcggcaaagccttgaaggatacagacgactgcgaatacgttcccatatatgaagacaaggatggagactggatgctagtgggagacgtgccttgggagatgtttattgagtcttgcaagaggctaaggataatgaagaggtcagaagccaagggttttggactgcagccaagaggtgctcttcagcagggaaatatttcaaacgatgatcgtgactag

SEQ ID NO: 2360 - protein, 189 aa, Populus trichocarpa
  G4348,IAA domain coordinates 9-18,52-64,80-96,134-167
MAQPLGLEITELRLGPPGSENGPKNEKKRVFSELSGEANSTTDGRKTQTTSQVVGWPPVCSYRKKNSFNEKDSHETSKIYVKVSMDGAPFLRKVDLGMHKEYSDLVVALEKLFGCFGIGKALKDTDDCEYVPIYEDKDGDWMLVGDVPWEMFIESCKRLRIMKRSEAKGFGLQPRGALQQGNISNDDRD

SEQ ID NO: 2361 - DNA, 694 bp, Vitis vinifera
  G4349,family:IAA
gcacagaaccctagctctacctcccataacctacctcaaccctcctccaagaaatggccctaggactcgagatcactgagctgaggctgggtctgcccggtcatgccgactcacaccaccctgctggtgttaatgcagtggagagaaacgagaagaagagggtgttttctgagatgtccggggatagcagcgccaccacgtgtgaacggaaagcccagaacaagaaccaagttgtggggtggccgccagtctgctcatatcggaggaaaaacagttttaatgacaaggatcgaacagaagctaccaaaatgtacgtgaaagtgagcatggacggcgcaccttttcttcgtaagatcgatttgagttcccaccaaggctacttcaatcttgtcaccgcttttgaggagcttttcgggtgtttcggcatcggtgaagcattgaaagatgcagatagttcagagtatattcccatatatgaggacaaagatggggactggatgcttgtaggagatgttccttgggagatgttcattgaatcttgcaagaggctgaggatcaagaaaaaatccgaaaccaagaatttcggcctgcagttaaattctctgaaggaactccagaagataaatgattagaagtttgtgattgtaatgcagaaattaatcttattgtctttttccttgaacaaattttaagt

SEQ ID NO: 2362 - protein, 192 aa, Vitis vinifera
  G4349,IAA domain coordinates 8-16,59-71,87-103,141-174
MALGLEITELRLGLPGHADSHHPAGVNAVERNEKKRVFSEMSGDSSATTCERKAQNKNQVVGWPPVCSYRRKNSFNDKDRTEATKMYVKVSMDGAPFLRKIDLSSHQGYFNLVTAFEELFGCFGIGEALKDADSSEYIPIYEDKDGDWMLVGDVPWEMFIESCKRLRIKKKSETKNFGLQLNSLKELQKIND

SEQ ID NO: 2363 - DNA, 837 bp, Gossypium hirsutum
  G4350,family:IAA
aaaacaaaaatggctaaggaaggactggggttggaaatcacagagctgaggttgggtctacctggaggcgggactgaaaaaaatgagaagaaaagagtgttctcagagatttcagaggaggaggaaaatgagaagagcaatgggccgccggagttgcaaagcaagagtcaagtggtggggtggccgccggtatgttcgtataggaaaaagaacagtttcggcgataaagatgggtctaaaacatcaaaattttacgtcaaagtcagcatggatggagctccttttcttcgcaaaatcgatcttgcactgcacaaaggttactctgatcttgttaaggctttggagaagctgtttggagaggcgttaagggatgcagagagctgtgagttcgttcccatatacgaggacaaagatggagactggatgttagcgggggacgttccttgggagatgtttattgaatcgtgcaagaggttgagaattatgaaaaaggcggatgcgaagggattcggagtactgcaatcgagggtagctctcaatggaactttgaaggagtgactagaaaagccccatgcatgaattaatgccctagttgaagaattgcttaactaaagtttctttgatactttgttaaaatgttaatgatggttattagctacttttgattaattaaggagacaatatttcttgctttatgtgacaatactactcgaaatctacagctcattgtcgatgttcaaggcgttttatgttatagtgtatttgggactagaacccctaattgatagggcataatttgcttcctcatcatcaatttcaaattgttatgagttattt

SEQ ID NO: 2364 - protein, 182 aa, Gossypium hirsutum
  G4350,IAA domain coordinates 11-19,54-66,82-98,131-164
MAKEGLGLEITELRLGLPGGGTEKNEKKRVFSEISEEEENEKSNGPPELQSKSQVVGWPPVCSYRKKNSFGDKDGSKTSKFYVKVSMDGAPFLRKIDLALHKGYSDLVKALEKLFGEALRDAESCEFVPIYEDKDGDWMLAGDVPWEMFIESCKRLRIMKKADAKGFGVLQSRVALNGTLKE

SEQ ID NO: 2365 - DNA, 867 bp, Zea mays
  G4637,family:MYB-(R1)R2R3
atggggaggtccccgtgctgcgagcaggcgcacaccaacaagggcgcgtggaccaaggaggaggaccagcgcctcgtcgcctacatcaaggcccacggcgagggctgctggagatcgctaccaaaagccgcaggtctgctgcgctgcgggaagagctgccggctgcggtggatcaactacctgcgcccggacctcaagcgcggcaacttcaccgaggaggaggatgacctcatcatcaagttccacgagctcttcggcaacaagtggtcgctcatcgccgggaggctgccgggcaggacggacaacgagatcaagaactactggaacacgcacatcaagcgcaagctcctcgcccgcggcatggacccgcagacgcaccgcccgctcgccagcgcgaccgcggggcagcagcattaccagctgcaggagccgcagaagcgagcggccggcggcggtccagcaggccatccgcaccaggaccacttggaggtcgtcgtcatctccaactcgccggacgaggcctacagccgtagcagcgacgacgagccgcggtccgccacgccgccgcggcgccacctcgacatcgacctcaacctgtccatcagcctagcggcctaccagccgccggaggaaaccggcatcatcaagcagccactggtgatgaagcaggagcaggaaacggcggcgggcggcaccaatgccgcggcggtgtgcctgtgcctcaacagcctcgggtaccggccgggcgtcgagtgcgtttgcggcgacggcagctcctcctcctcctcctggcactcccactcccactcccaccaatgggctctgaattttttacaggcggcggcgccctgctacagaggccaatag

SEQ ID NO: 2366 - protein, 288 aa, Zea mays
  G4637,MYB-(R1)R2R3 domain coordinates 14-116
MGRSPCCEQAHTNKGAWTKEEDQRLVAYIKAHGEGCWRSLPKAAGLLRCGKSCRLRWINYLRPDLKRGNFTEEEDDLIIKFHELFGNKWSLIAGRLPGRTDNEIKNYWNTHIKRKLLARGMDPQTHRPLASATAGQQHYQLQEPQKRAAGGGPAGHPHQDHLEVVVISNSPDEAYSRSSDDEPRSATPPRRHLDIDLNLSISLAAYQPPEETGIIKQPLVMKQEQETAAGGTNAAAVCLCLNSLGYRPGVECVCGDGSSSSSSWHSHSHSHQWALNFLQAAAPCYRGQ

SEQ ID NO: 2367 - DNA, 678 bp, Zea mays
  G4638,family:MYB-(R1)R2R3
atggggaggtcgccgtgctgcgagaaggcgcacacgaacaagggcgcctggaccaaggaggaggaccagcggctcgtcgcctacatcaaggcccacggcgaaggctgctggaggtcgctccccaaggccgcgggcctgctgcgctgcggcaagagctgccgcctccggtggatcaactacctgcgccccgacctcaagcgcggcaacttcacccaggaggaggacgacgtcatcatcaagctccaccaggtcctcggaaacaagtggtcgctgatcgccgcccagctgccggggcggacggacaacgagatcaagaactactggaacacgcacatcaagcgcaagctcatcgcccggggcatcgacccacggacgcaccagtcggcgagtgccgccgcagttgcccccgccgccgccgccgccgcgcaaagcagctatcgccaccatggcgacgacgaggcggtggcgcggcgcagctgctcgcgagacagcggctgcatcgcggcgcacagcagcgacgacgacgacagcacgtccgggtccgtgccacaccaacatgctgtcggcggcatcgacctcaacctgtcgctaagcccaccgacgacgagccaaccgtcatcgccggccgccgccaagggagtcgtagctagcggatatggccaagggagtgagagctag

SEQ ID NO: 2368 - protein, 225 aa, Zea mays
  G4638,MYB-(R1)R2R3 domain coordinates 14-116
MGRSPCCEKAHTNKGAWTKEEDQRLVAYIKAHGEGCWRSLPKAAGLLRCGKSCRLRWINYLRPDLKRGNFTQEEDDVIIKLHQVLGNKWSLIAAQLPGRTDNEIKNYWNTHIKRKLIARGIDPRTHQSASAAAVAPAAAAAAQSSYRHHGDDEAVARRSCSRDSGCIAAHSSDDDDSTSGSVPHQHAVGGIDLNLSLSPPTTSQPSSPAAAKGVVASGYGQGSES

SEQ ID NO: 2369 - DNA, 633 bp, Glycine max
  G4639,family:MYB-(R1)R2R3
atgggaaggtccccttgctgtgagaaagcacacacaaacaaaggtgcatggaccaaagaagaagatcatcgcctcatttcttacattagagctcacggtgaaggctgctggcgctctctccccaaagccgccggccttctccgttgcggcaagagctgtcgtctccgctggatcaactatctccgccctgacctcaagcgcggcaatttcaccctcgaagaagaccaactcatcatcaaactccacagcctccttggcaacaagtggtctctaattgctagaagattgccgggtagaacggacaatgagataaagaattactggaatactcacataagaaggaagcttctgagcagaggaattgaccctgccactcacaggcctctcaacgatgacaaggtattggaacgctgccctgacttgaaccttgagctaaccattagtcctccccgtcaacctcaatctgatcagcatcacttgaagcccgttgggagaaactcaaacctttgctttgcctgcagtttgggtttgcaaaatagcaaagatcattgtagctgtgcgctcaacactgccaacgctgcttctggccatgatttcttggccttgaaaaccagcgttttggaaatgaaatga

SEQ ID NO: 2370 - protein, 210 aa, Glycine max
  G4639,MYB-(R1)R2R3 domain coordinates 14-116
MGRSPCCEKAHTNKGAWTKEEDHRLISYIRAHGEGCWRSLPKAAGLLRCGKSCRLRWINYLRPDLKRGNFTLEEDQLIIKLHSLLGNKWSLIARRLPGRTDNEIKNYWNTHIRRKLLSRGIDPATHRPLNDDKVLERCPDLNLELTISPPRQPQSDQHHLKPVGRNSNLCFACSLGLQNSKDHCSCALNTANAASGHDFLALKTSVLEMK

SEQ ID NO: 2371 - DNA, 975 bp, Zea mays
  G4640,family:MYB-(R1)R2R3
atgtatgccctccgttgcacttgcactgcaccccctgtctgtccccacccttctgccctggcttatctctttccgcttccccctgttataatagcaaccaaaccaaaccaaaccagagctcaggaggagcttccacgcaaactcaggggaggcgcgcgcaagcaagcacacgagggagaaccaggcatggggaggtctccgtgctgcgagaaggcgcacacgaacaagggcgcctggaccaaggaggaggaccagcgcctgatcgcctacatcagggcgcacggcgaagggagctggcgctcgctgcccaaggccgcgggactcctccgctgcggcaagagctgcaggctccgctggatgaactacctccgcccggacctcaagcgcggcaacttcaccggcgacgacgacgagctcatcatcaagctccacgccctgctcggcaacaagtggtcgctcatcgcggggcagctgcccggccggacggacaacgagatcaagaactactggaacacgcacatcaagcgcaagctgctcagccgcggcatcgacccgcagacgcaccgcccgctcagcggcggcgcgggcagcgcgctcaccaccacgtccagcaccgccggcttcccgtcccccgcgccggcgtccaggtccaggcccacgcccacgcccccgcccaccgtcgtcgtcccgcccaatgcgatcttcgtgcgcccggcgccgtcggaggacggccacagcagcagcggcgcgagcacggacgcgccgcgctgccccgacctcaacctggacctggacctgtccgtgggcccgccgcccaagacgccggcggccacgcagcagcagcggcggcggacgaccatctgcctgtgctaccacctcggtgtccgcggcggcgaggcctgcagctgcgagaccgcgtcgtcgctggcgggcttccggtttctccagccgctggaggagggccagtacatatag

SEQ ID NO: 2372 - protein, 324 aa, Zea mays
  G4640,MYB-(R1)R2R3 domain coordinates 76-178
MYALRCTCTAPPVCPHPSALAYLFPLPPVIIATKPNQTRAQEELPRKLRGGARKQAHEGEPGMGRSPCCEKAHTNKGAWTKEEDQRLIAYIRAHGEGSWRSLPKAAGLLRCGKSCRLRWMNYLRPDLKRGNFTGDDDELIIKLHALLGNKWSLIAGQLPGRTDNEIKNYWNTHIKRKLLSRGIDPQTHRPLSGGAGSALTTTSSTAGFPSPAPASRSRPTPTPPPTVVVPPNAIFVRPAPSEDGHSSSGASTDAPRCPDLNLDLDLSVGPPPKTPAATQQQRRRTTICLCYHLGVRGGEACSCETASSLAGFRFLQPLEEGQYI

SEQ ID NO: 2373 - protein, 64 aa, Arabidopsis thaliana
  G28,AP2 domain
GKHYRGVRQRPWGKFAAEIRDPAKNGARVWLGTFETAEDAALAYDRAAFRMRGSRALLNFPLRV

SEQ ID NO: 2374 - protein, 65 aa, Oryza sativa
  G3430,AP2 domain
RGKHYRGVRQRPWGKFAAEIRDPAKNGARVWLGTFDSAEEAAVAYDRAAYRMRGSRALLNFPLRI

SEQ ID NO: 2375 - protein, 66 aa, Arabidopsis thaliana
  G47,AP2 domain
SQSKYKGIRRRKWGKWVSEIRVPGTRDRLWLGSFSTAEGAAVAHDVAFFCLHQPDSLESLNFPHLL

SEQ ID NO: 2376 - protein, 68 aa, Arabidopsis thaliana
  G2133,AP2 domain
DQSKYKGIRRRKWGKWVSEIRVPGTRQRLWLGSFSTAEGAAVAHDVAFYCLHRPSSLDDESFNFPHLL

SEQ ID NO: 2377 - protein, 90 aa, Arabidopsis thaliana
  G481,CAAT domain
REQDRYLPIANISRIMKKALPPNGKIGKDAKDTVQECVSEFISFITSEASDKCQKEKRKTVNGDDLLWAMATLGFEDYLEPLKIYLARYR

SEQ ID NO: 2378 - protein, 90 aa, Arabidopsis thaliana
  G482,CAAT domain
REQDRFLPIANVSRIMKKALPANAKISKDAKETMQECVSEFISFVTGEASDKCQKEKRKTINGDDLLWAMTTLGFEDYVEPLKVYLQRFR

SEQ ID NO: 2379 - protein, 45 aa, Oryza sativa
  G3392,MYB-related domain
VHFTEEEEDIVFRMHRLVGNRWELIAGRIPGRTAEEVEKFWAIKH

SEQ ID NO: 2380 - protein, 66 aa, Arabidopsis thaliana
  G867 AP2 domain
SSKYKGVVPQPNGRWGAQIYEKHQRVWLGTFNEEDEAARAYDVAVHRFRRRDAVTNFKDVKMDEDE

SEQ ID NO: 2381 - protein, 93 aa, Arabidopsis thaliana
  G867 B3 domain
AEALFEKAVTPSDVGKLNRLVIPKHHAEKHFPLPSSNVSVKGVLLNFEDVNGKVWRFRYSYWNSSQSYVLTKGWSRFVKEKNLRAGDVVSFSR

SEQ ID NO: 2382 - protein, 9 aa, Arabidopsis thaliana
  G1073 AT-hook domain
RRPRGRPAG

SEQ ID NO: 2383 - protein, 146 aa, Arabidopsis thaliana
  G1073 2nd conserved domain
GSKNKPKPPTIITRDSPNVLRSHVLEVTSGSDISEAVSTYATRRGCGVCIISGTGAVTNVTIRQPAAPAGGGVITLHGRFDILSLTGTALPPPAPPGAGGLTVYLAGGQGQVVGGNVAGSLIASGPVVLMAASFANAVYDRLPIEE

SEQ ID NO: 2384 - protein, 57 aa, Arabidopsis thaliana
  G1274,WRKY domain
DDGFKWRKYGKKSVKNNINKRNYYKCSSEGCSVKKRVERDGDDAAYVITTYEGVHNH

SEQ ID NO: 2385 - protein, 56 aa, Arabidopsis thaliana
  G1760,MADS domain
GRGKIVIQRIDDSTSRQVTFSKRRKGLIKKAKELAILCDAEVGLIIFSSTGKLYDF

SEQ ID NO: 2386 - protein, 65 aa, Arabidopsis thaliana
  G1792,AP2 domain
KQARFRGVRRRPWGKFAAEIRDPSRNGARLWLGTFETAEEAARAYDRAAFNLRGHLAILNFPNEY

SEQ ID NO: 2387 - protein, 65 aa, Arabidopsis thaliana
  G1795,AP2 domain
EHGKYRGVRRRPWGKYAAEIRDSRKHGERVWLGTFDTAEEAARAYDQAAYSMRGQAAILNFPHEY

SEQ ID NO: 2388 - protein, 9 aa, Arabidopsis thaliana
  G1945,AT-hook domain
RRPRGRPPG

SEQ ID NO: 2389 - protein, 46 aa, Arabidopsis thaliana
  G1988,Z-CO-like domain
CELCGAEADLHCAADSAFLCRSCDAKFHASNFLFARHFRRVICPNC

SEQ ID NO: 2390 - protein, 67 aa, Arabidopsis thaliana
  G2,1st AP2 domain
SSQYRGVTFYRRTGRWESHIWDCGKQVYLGGFDTAHAAARAYDRAAIKFRGVEADINFNIDDYDDDL

SEQ ID NO: 2391 - protein, 68 aa, Arabidopsis thaliana
  G2,2nd AP2 domain
SSKYRGVTLHKCGRWEARMGQFLGKKYVYLGLFDTEVEAARAYDKAAIKCNGKDAVTNFDPSIYDEEL

SEQ ID NO: 2392 - protein, 68 aa, Arabidopsis thaliana
  G3,AP2 domain
RKPYRGIRRRKWGKWVAEIREPNKRSRLWLGSYTTDIAAARAYDVAVFYLRGPSARLNFPDLLLQEED

SEQ ID NO: 2393 - protein, 63 aa, Arabidopsis thaliana
  G4,AP2 domain
KNQYRGIRQRPWGKWAAEIRDPRKGSREWLGTFDTAEEAARAYDAAARRIRGTKAKVNFPEEK

SEQ ID NO: 2394 - protein, 68 aa, Arabidopsis thaliana
  G5,AP2 domain
TKLYRGVRQRHWGKWVAEIRLPRNRTRLWLGTFDTAEEAALAYDKAAYKLRGDFARLNFPNLRHNGFH

SEQ ID NO: 2395 - protein, 68 aa, Arabidopsis thaliana
  G7,AP2 domain
PKKYRGVRQRPWGKWAAEIRDPHKATRVWLGTFETAEAAARAYDAAALRFRGSKAKLNFPENVGTQTI

SEQ ID NO: 2396 - protein, 67 aa, Arabidopsis thaliana
  G8,1st AP2 domain
SSQYRGVTFYRRTGRWESHIWDCGKQVYLGGFDTAHAAARAYDRAAIKFRGVDADINFTLGDYEEDM

SEQ ID NO: 2397 - protein, 51 aa, Arabidopsis thaliana
  G8,2nd AP2 domain
SSKYRGVTLHKCGRWEARMGQFLGKKAYDKAAINTNGREAVTNFEMSSYQN

SEQ ID NO: 2398 - protein, 66 aa, Arabidopsis thaliana
  G9 AP2 domain
SSKYKGVVPQPNGRWGAQIYEKHQRVWLGTFNEQEEAARSYDIAACRFRGRDAVVNFKNVLEDGDL

SEQ ID NO: 2399 - protein, 94 aa, Arabidopsis thaliana
  G9 B3 domain
REVLFEKAVTPSDVGKLNRLVIPKQHAEKHFPLPSPSPAVTKGVLINFEDVNGKVWRFRYSYWNSSQSYVLTKGWSRFVKEKNLRAGDVVTFER

SEQ ID NO: 2400 - protein, 68 aa, Arabidopsis thaliana
  G12,AP2 domain
DKPYKGIRMRKWGKWVAEIREPNKRSRIWLGSYSTPEAAARAYDTAVFYLRGPSARLNFPELLAGVTV

SEQ ID NO: 2401 - protein, 77 aa, Arabidopsis thaliana
  G15,1st AP2 domain
TSQYRGVTRHRWTGRYEAHLWDNSFKKEGHSRKGRQVYLGGYDMEEKAARAYDLAALKYWGPSTHTNFSAENYQKEI

SEQ ID NO: 2402 - protein, 69 aa, Arabidopsis thaliana
  G15,2nd AP2 domain
ASIYRGVTRHHQHGRWQARIGRVAGNKDLYLGTFGTQEEAAEAYDVAAIKFRGTNAVTNFDITRYDVDR

SEQ ID NO: 2403 - protein, 68 aa, Arabidopsis thaliana
  G19,AP2 domain
KNVYRGIRKRPWGKWAAEIRDPRKGVRVWLGTFNTAEEAAMAYDVAAKQIRGDKAKLNFPDLHHPPPP

SEQ ID NO: 2404 - protein, 77 aa, Arabidopsis thaliana
  G20,AP2 domain
SSIYRGVTRHRWTGRYEAHLWDKSTWNQNQNKKGKQVYLGAYDDEEAAARAYDLAALKYWGPGTLINFPVTDYTRDL

SEQ ID NO: 2405 - protein, 68 aa, Arabidopsis thaliana
  G21,AP2 domain
HPTYRGVRMRSWGKWVSEIREPRKKSRIWLGTYPTAEMAARAHDVAALAIKGTTAYLNFPKLAGELPR

SEQ ID NO: 2406 - protein, 65 aa, Arabidopsis thaliana
  G22 AP2 domain
KGMQYRGVRRRPWGKFAAEIRDPKKNGARVWLGTYETPEDAAVAYDRAAFQLRGSKAKLNFPHLI

SEQ ID NO: 2407 - protein, 68 aa, Arabidopsis thaliana
  G24,AP2 domain
LKPYKGIRMRKWGKWVAEIREPNKRSRIWLGSYATPEAAARAYDTAVFYLRGPSARLNFPELLAGLTV

SEQ ID NO: 2408 - protein, 68 aa, Arabidopsis thaliana
  G25,AP2 domain
KNLYRGIRQRPWGKWAAEIRDPSKGVRVWLGTFKTADEAARAYDVAAIKIRGRKAKLNFPNTQVEEEA

SEQ ID NO: 2409 - protein, 68 aa, Arabidopsis thaliana
  G26,AP2 domain
QRNYRGVRQRPWGKWAAEIRDPNKAARVWLGTFDTAEEAALAYDKAAFEFRGHKAKLNFPEHIRVNPT

SEQ ID NO: 2410 - protein, 68 aa, Arabidopsis thaliana
  G27,AP2 domain
QPNFRGVRMRQWGKWVSEIREPRKKSRIWLGTFSTPEMAARAHDVAALAIKGGSAHLNFPELAYHLPR

SEQ ID NO: 2411 - protein, 65 aa, Arabidopsis thaliana
  G30,AP2 domain
EQGKYRGVRRRPWGKYAAEIRDSRKHGERVWLGTFDTAEDAARAYDRAAYSMRGKAAILNFPHEY

SEQ ID NO: 2412 - protein, 68 aa, Arabidopsis thaliana
  G32,AP2 domain
GTRFLGVRRRPWGRYAAEIRDPTTKERHWLGTFDTAEEAALAYDRAARSMRGTRARTNFVYSDMPPSS

SEQ ID NO: 2413 - protein, 68 aa, Arabidopsis thaliana
  G38,AP2 domain
RCSFRGVRQRIWGKWVAEIREPNRGSRLWLGTFPTAQEAASAYDEAAKAMYGPLARLNFPRSDASEVT

SEQ ID NO: 2414 - protein, 69 aa, Arabidopsis thaliana
  G43,AP2 domain
TRHYRGVRRRPWGKFAAEIRDPAKKGSRIWLGTFESDIDAARAYDYAAFKLRGRKAVLNFPLDAGKYDA

SEQ ID NO: 2415 - protein, 70 aa, Arabidopsis thaliana
  G44,AP2 domain
ERHYRGVRRRPWGKYAAEIRDPNKKGCRIWLGTYDTAVEAGRAYDQAAFQLRGRKAILNFPLDVRVTSET

SEQ ID NO: 2416 - protein, 66 aa, Arabidopsis thaliana
  G45,AP2 domain
KTRKYRGVRKRPWGKFAAEIRDSTRNGVRVWLGTFQTAEEAAMAYDKAAVRIRGTQKAHTNFQLET

SEQ ID NO: 2417 - protein, 69 aa, Arabidopsis thaliana
  G46,AP2 domain
ARHYRGVRRRPWGKFAAEIRDPAKKGSRIWLGTFESDVDAARAYDCAAFKLRGRKAVLNFPLDAGKYEA

SEQ ID NO: 2418 - protein, 56 aa, Arabidopsis thaliana
  G129,MADS domain
GRGKIEIKRIENTTNRQVTFCKRRNGLLKKAYELSVLCDAEVALIVFSSRGRLYEY

SEQ ID NO: 2419 - protein, 57 aa, Arabidopsis thaliana
  G131,MADS domain
MGRGRVQLKRIENKINRQVTFSKRRAGLLKKAHEISVLCDAEVALVVFSHKGKLFEY

SEQ ID NO: 2420 - protein, 57 aa, Arabidopsis thaliana
  G133,MADS domain
MARGKIQIKRIENQTNRQVTYSKRRNGLFKKAHELTVLCDARVSIIMFSSSNKLHEY

SEQ ID NO: 2421 - protein, 57 aa, Arabidopsis thaliana
  G134,MADS domain
MGRGKIEIKRIENANNRVVTFSKRRNGLVKKAKEITVLCDAKVALIIFASNGKMIDY

SEQ ID NO: 2422 - protein, 57 aa, Arabidopsis thaliana
  G135,MADS domain
MGRGRVELKRIENKINRQVTFSKRRTGLLKKAQEISVLCDAEVSLIVFSHKGKLFEY

SEQ ID NO: 2423 - protein, 57 aa, Arabidopsis thaliana
  G136,MADS domain
RGKIEIKRIENTTNRQVTFCKRRNGLLKKAYELSVLCDAEVALVIFSTRGRLYEYAN

SEQ ID NO: 2424 - protein, 57 aa, Arabidopsis thaliana
  G137,MADS domain
MGRGRVELKRIENKINRQVTFAKRRNGLLKKAYELSVLCDAEVALIIFSNRGKLYEF

SEQ ID NO: 2425 - protein, 57 aa, Arabidopsis thaliana
  G138,MADS domain
MGRGKVELKRIENKINRQVTFAKRRNGLLKKAYELSVLCDAEIALLIFSNRGKLYEF

SEQ ID NO: 2426 - protein, 57 aa, Arabidopsis thaliana
  G140,MADS domain
IGRGKIEIKRIENTTNRQVTFCKRRNGLLKKAYELSVLCDAEVALVIFSTRGRLYEY

SEQ ID NO: 2427 - protein, 56 aa, Arabidopsis thaliana
  G142,MADS domain
GRGRVEMKRIENKINRQVTFSKRRNGLLKKAYELSVLCDAEVALIIFSSRGKLYEF

SEQ ID NO: 2428 - protein, 57 aa, Arabidopsis thaliana; identical to SEQ ID NO: 2424
  G145,MADS domain

SEQ ID NO: 2429 - protein, 57 aa, Arabidopsis thaliana
  G146,MADS domain
MGRGKIEIKRIENSTNRQVTFCKRRNGLLKKAYELSVLCDAEVALIVFSTRGRLYEY

SEQ ID NO: 2430 - protein, 56 aa, Arabidopsis thaliana
  G147,MADS domain
ARGKIQLKRIENPVHRQVTFCKRRTGLLKKAKELSVLCDAEIGVVIFSPQGKLFEL

SEQ ID NO: 2431 - protein, 57 aa, Arabidopsis thaliana
  G148,MADS domain
MGRGKVEVKRIENKITRQVTFSKRKSGLLKKAYELSVLCDAEVSLIIFSTGGKLYEF

SEQ ID NO: 2432 - protein, 56 aa, Arabidopsis thaliana
  G151,MADS domain
GRGKIEIKRIENANSRQVTFSKRRSGLLKKARELSVLCDAEVAVIVFSKSGKLFEY

SEQ ID NO: 2433 - protein, 56 aa, Arabidopsis thaliana
  G152,MADS domain
GRGKIVIQKIDDSTSRQVTFSKRRKGLIKKAKELAILCDAEVCLIIFSNTDKLYDF

SEQ ID NO: 2434 - protein, 56 aa, Arabidopsis thaliana
  G153,MADS domain
GRGKIVIRRIDNSTSRQVTFSKRRSGLLKKAKELSILCDAEVGVIIFSSTGKLYDY

SEQ ID NO: 2435 - protein, 56 aa, Arabidopsis thaliana
  G154,MADS domain
VRGKTQMKRIENATSRQVTFSKRRNGLLKKAFELSVLCDAEVSLIIFSPKGKLYEF

SEQ ID NO: 2436 - protein, 57 aa, Arabidopsis thaliana
  G155,MADS domain
MGRGRVQLKRIENKINRQVTFSKRRSGLLKKAHEISVLCDAEVALIVFSSKGKLFEY

SEQ ID NO: 2437 - protein, 56 aa, Arabidopsis thaliana
  G156,MADS domain
GRGKIEIKKIENQTARQVTFSKRRTGLIKKTRELSILCDAHIGLIVFSATGKLSEF

SEQ ID NO: 2438 - protein, 56 aa, Arabidopsis thaliana
  G157,MADS domain
GRRKIEIKRIENKSSRQVTFSKRRNGLIDKARQLSILCESSVAVVVVSASGKLYDS

SEQ ID NO: 2439 - protein, 56 aa, Arabidopsis thaliana
  G158,MADS domain
GRVKLKIKKLENTNGRQSTFAKRKNGILKKANELSILCDIDIVLLMFSPTGKAAIC

SEQ ID NO: 2440 - protein, 55 aa, Arabidopsis thaliana
  G159,MADS domain
GRRKIELVKMTNESNLQVTFSKRRSGLFKKGSELCTLCDAEIAIIVFSPSGKAYS

SEQ ID NO: 2441 - protein, 57 aa, Arabidopsis thaliana
  G161,MADS domain
KGRQKIEMVKMKNESNLQVTFSKRRSGLFKKASELCTLCGAEVAIVVFSPGRKVFSF

SEQ ID NO: 2442 - protein, 56 aa, Arabidopsis thaliana
  G162,MADS domain
GRRKIKMEMVQDMNTRQVTFSKRRTGLFKKASELATLCNAELGIVVFSPGGKPFSY

SEQ ID NO: 2443 - protein, 57 aa, Arabidopsis thaliana
  G168,MADS domain
MGMKKVKLSLIANEISRETSFMKRKNGIMKKLYELSTLCGVQACTLIYSPFIPVPEF

SEQ ID NO: 2444 - protein, 57 aa, Arabidopsis thaliana
  G172,MADS domain
GTKRKIEIKKRETKEQRAVTCSKRRQTVFSKAADLCLISGANIAVFVTSPSDSSDVV

SEQ ID NO: 2445 - protein, 57 aa, Arabidopsis thaliana
  G173,MADS domain
MREDTMFKKALELSTLCDIEVCVILYSRDGELIKTWPEDQSKVRDMAERFSKLHERE

SEQ ID NO: 2446 - protein, 57 aa, Arabidopsis thaliana
  G175,1st WRKY domain
DDGYNWRKYGQKLVKGSEYPRSYYKCTHPNCEAKKKVERSREGHIIEIIYTGDHIHS

SEQ ID NO: 2447 - protein, 57 aa, Arabidopsis thaliana
  G175,2nd WRKY domain
DDGYRWRKYGQKVVKGNPNPRSYYKCTANGCTVTKHVERASDDFKSVLTTYIGKHTH

SEQ ID NO: 2448 - protein, 57 aa, Arabidopsis thaliana
  G179,WRKY domain
DDGYRWRKYGQKAVKNNPFPRSYYKCTEEGCRVKKQVQRQWGDEGVVVTTYQGVHTH

SEQ ID NO: 2449 - protein, 57 aa, Arabidopsis thaliana
  G180,WRKY domain
DDGYKWRKYGQKVVKNSLHPRSYYRCTHNNCRVKKRVERLSEDCRMVITTYEGRHNH

SEQ ID NO: 2450 - protein, 57 aa, Arabidopsis thaliana
  G181,WRKY domain
DDGYRWRKYGQKSVKHNAHPRSYYRCTYHTCNVKKQVQRLAKDPNVVVTTYEGVHNH

SEQ ID NO: 2451 - protein, 62 aa, Arabidopsis thaliana
  G183,WRKY domain
NDGYRWRKYGQKVVKGNPNPRSYFKCTNIECRVKKHVERGADNIKLVVTTYDGIHNHPSPPA

SEQ ID NO: 2452 - protein, 58 aa, Arabidopsis thaliana
  G184,WRKY domain
SDGCQWRKYGQKMAKGNPCPRAYYRCTMAGGCPVRKQVQRCAEDRSILITTYEGNHNH

SEQ ID NO: 2453 - protein, 60 aa, Arabidopsis thaliana
  G185,WRKY domain
DDGFSWRKYGQKDILGAKFPRGYYRCTYRKSQGCEATKQVQRSDENQMLLEISYRGIHSC

SEQ ID NO: 2454 - protein, 58 aa, Arabidopsis thaliana
  G186,WRKY domain
SDGCQWRKYGQKMAKGNPCPRAYYRCTMATGCPVRKQVQRCAEDRSILITTYEGNHNH

SEQ ID NO: 2455 - protein, 57 aa, Arabidopsis thaliana
  G187,WRKY domain
EDGYRWRKYGQKAVKNSPYPRSYYRCTTQKCNVKKRVERSFQDPTVVITTYEGQHNH

SEQ ID NO: 2456 - protein, 48 aa, Arabidopsis thaliana
  G188,WRKY domain
QKPIKGSPYPRNYYRCSSSKGCLARKQVERSNLDPNIFIVTYTGEHTH

SEQ ID NO: 2457 - protein, 58 aa, Arabidopsis thaliana
  G189,WRKY domain
PDDYSWRKYGQKPIKGSPHPRGYYKCSSVRGCPARKHVERAADDSSMLIVTYEGDHNH

SEQ ID NO: 2458 - protein, 60 aa, Arabidopsis thaliana
  G190,WRKY domain
YDGYLWRKYGQKSIKKSNHQRSYYRCSYNKDHNCEARKHEQKIKDNPPVYRTTYFGHHTC

SEQ ID NO: 2459 - protein, 58 aa, Arabidopsis thaliana
  G192,WRKY domain
SDVWAWRKYGQKPIKGSPYPRGYYRCSTSKGCLARKQVERNRSDPKMFIVTYTAEHNH

SEQ ID NO: 2460 - protein, 57 aa, Arabidopsis thaliana
  G194,WRKY domain
EDGYRWRKYGQKAVKNSPFPRSYYRCTTASCNVKKRVERSFRDPSTVVTTYEGQHTH

SEQ ID NO: 2461 - protein, 61 aa, Arabidopsis thaliana
  G196,WRKY domain
PSDLWAWRKYGQKPIKGSPYPRGYYRCSSSKGCSARKQVERSRTDPNMLVITYTSEHNHPW

SEQ ID NO: 2462 - protein, 103 aa, Arabidopsis thaliana
  G197,MYB-(R1)R2R3 domain
KGAWTKEEDDKLISYIKAHGEGCWRSLPRSAGLQRCGKSCRLRWINYLRPDLKRGNFTLEEDDLIIKLHSLLGNKWSLIATRLPGRTDNEIKNYWNTHVKRKL

SEQ ID NO: 2463 - protein, 104 aa, Arabidopsis thaliana
  G198,MYB-(R1)R2R3 domain
KGPWTSEEDQKLVDYIQKHGYGNWRTLPKNAGTCLQRCGKSCRLRWTNYLRPDIKRGRFSFEEEEAIIQLHSFLGNKWSAIAARLPGRTDNEIKNFWNTHIRKK

SEQ ID NO: 2464 - protein, 105 aa, Arabidopsis thaliana
  G200,MYB-(R1)R2R3 domain
IKKGPWTPEEDIILVSYIQEHGPGNWRSVPTNTGLLRCSKSCRLRWTNYLRPGIKRGNFTPHEEGMIIHLQALLGNKWASIASYLPQRTDNDIKNYWNTHLKKKL

SEQ ID NO: 2465 - protein, 101 aa, Arabidopsis thaliana
  G201,MYB-(R1)R2R3 domain
KGAWTAEEDKKLISYIHEHGGGGWRDIPQKAGLKRCGKSCRLRWANYLKPDIKRGEFSYEEEQIIIMLHASRGNKWSVIARHLPKRTDNEIKNYWNTHLKK

SEQ ID NO: 2466 - protein, 104 aa, Arabidopsis thaliana
  G202,MYB-(R1)R2R3 domain
KKGAWTTEEDKKLISYIHDHGEGGWRDIPQKAGLKRCGKSCRLRWTNYLKPEIKRGEFSSEEEQIIIMLHASRGNKWSVIARHLPRRTDNEIKNYWNTHLKKRL

SEQ ID NO: 2467 - protein, 104 aa, Arabidopsis thaliana
  G206,MYB-(R1)R2R3 domain
KKGPWSAEEDRILINYISLHGHPNWRALPKLAGLLRCGKSCRLRWINYLRPDIKRGNFTPHEEDTIISLHQLLGNRWSAIAAKLPGRTDNEIKNVWHTHLKKRL

SEQ ID NO: 2468 - protein, 101 aa, Arabidopsis thaliana
  G207,MYB-(R1)R2R3 domain
KGPWSQEEDEQLRRMVEKYGPRNWSAISKSIPGRSGKSCRLRWCNQLSPEVEHRPFSPEEDETIVTARAQFGNKWATIARLLNGRTDNAVKNHWNSTLKRK

SEQ ID NO: 2469 - protein, 103 aa, Arabidopsis thaliana
  G208,MYB-(R1)R2R3 domain
KGAWTKEEDQRLVDYIRNHGEGCWRSLPKSAGLLRCGKSCRLRWINYLRPDLKRGNFTDDEDQIIIKLHSLLGNKWSLIAGRLPGRTDNEIKNYWNTHIKRKL

SEQ ID NO: 2470 - protein, 114 aa, Arabidopsis thaliana
  G211,MYB-(R1)R2R3 domain
KRGPWTVEEDEILVSFIKKEGEGRWRSLPKRAGLLRCGKSCRLRWMNYLRPSVKRGGITSDEEDLILRLHRLLGNRWSLIAGRIPGRTDNEIKNYWNTHLRKKLLRQGIDPQTH

SEQ ID NO: 2471 - protein, 102 aa, Arabidopsis thaliana
  G212,MYB-(R1)R2R3 domain
KKGLWTVEEDNILMDYVLNHGTGQWNRIVRKTGLKRCGKSCRLRWMNYLSPNVNKGNFTEQEEDLIIRLHKLLGNRWSLIAKRVPGRTDNQVKNYWNTHLSK

SEQ ID NO: 2472 - protein, 47 aa, Arabidopsis thaliana
  G214,MYB-related domain
ERWTEEEHNRFIEALRLYGRAWQKIEEHVATKTAVQIRSHAQKFFSK

SEQ ID NO: 2473 - protein, 48 aa, Arabidopsis thaliana
  G217,MYB-related domain
GVWKNTEDEILKAAVMKYGKNQWARISSLLVRKSAKQCKARWYEWLDP

SEQ ID NO: 2474 - protein, 107 aa, Arabidopsis thaliana
  G222,MYB-(R1)R2R3 domain
RKGLWSPEEDEKLLNYITRHGHGCWSSVPKLAGLQRCGKSCRLRWINYLRPDLKRGAFSQDEESLIIELHAALGNRWSQIATRLPGRTDNEIKNFWNSCLKKKLRRK

SEQ ID NO: 2475 - protein, 108 aa, Arabidopsis thaliana
  G224,PMR domain
DLLEEIFLGLPLKSILRFKTVSKQWRSILESKSFAERRLNVEKKEKILAVGDRTELGFEGEEEIQMVYLHCDIDATRPSLTCEGLVCIPAPGWINVLNPSTRQLRRFP

SEQ ID NO: 2476 - protein, 45 aa, Arabidopsis thaliana
  G225,MYB-related domain
VKMSEEEEDLISRMYKLVGDRWELIAGRIPGRTPEEIERYWLMKH

SEQ ID NO: 2477 - protein, 45 aa, Arabidopsis thaliana
  G226,MYB-related domain
ISMTEQEEDLISRMYRLVGNRWDLIAGRVVGRKANEIERYWIMRN

SEQ ID NO: 2478 - protein, 101 aa, Arabidopsis thaliana
  G227,MYB-(R1)R2R3 domain
KGPWSPEEDDLLQRLVQKHGPRNWSLISKSIPGRSGKSCRLRWCNQLSPEVEHRAFSQEEDETIIRAHARFGNKWATISRLLNGRTDNAIKNHWNSTLKRK

SEQ ID NO: 2479 - protein, 107 aa, Arabidopsis thaliana
  G229,MYB-(R1)R2R3 domain
RGRWTAEEDQILSNYIQSNGEGSWRSLPKNAGLKRCGKSCRLRWINYLRSDLKRGNITPEEEELVVKLHSTLGNRWSLIAGHLPGRTDNEIKNYWNSHLSRKLHNFI

SEQ ID NO: 2480 - protein, 101 aa, Arabidopsis thaliana
  G230,MYB-(R1)R2R3 domain
KGPWSPEEDDLLQSLVQKHGPRNWSLISKSIPGRSGKSCRLRWCNQLSPEVEHRGFTAEEDDTIILAHARFGNKWATIARLLNGRTDNAIKNHWNSTLKRK

SEQ ID NO: 2481 - protein, 105 aa, Arabidopsis thaliana
  G231,MYB-(R1)R2R3 domain
KGPWTVEEDKKLINFILTNGHCCWRALPKLAGLRRCGKSCRLRWTNYLRPGLKRGLLSHDEEQLVIDLHANLGNKWSKIASRLPGRTDNEIKNHWNTHIKKKLLK

SEQ ID NO: 2482 - protein, 103 aa, Arabidopsis thaliana
  G233,MYB-(R1)R2R3 domain
KRGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKKR

SEQ ID NO: 2483 - protein, 102 aa, Arabidopsis thaliana
  G234,MYB-(R1)R2R3 domain
KGPWSPEEDAKLKSYIENSGTGGNWIALPQKIGLKRCGKSCRLRWLNYLRPNIKHGGFSEEEENIICSLYLTIGSRWSIIAAQLPGRTDNDIKNYWNTRLKK

SEQ ID NO: 2484 - protein, 103 aa, Arabidopsis thaliana
  G237,MYB-(R1)R2R3 domain
RKGLWSPEEDEKLRSFILSYGHSCWTTVPIKAGLQRNGKSCRLRWINYLRPGLKRDMISAEEEETILTFHSPLGNKWSQIAKFLPGRTDNEIKNYWHSHLKKK

SEQ ID NO: 2485 - protein, 101 aa, Arabidopsis thaliana
  G241,MYB-(R1)R2R3 domain
RGPWTPEEDQILVSFILNHGHSNWRALPKQAGLLRCGKSCRLRWMNYLKPDIKRGNFTKEEEDAIISLHQILGNRWSAIAAKLPGRTDNEIKNVWHTHLKK

SEQ ID NO: 2486 - protein, 101 aa, Arabidopsis thaliana
  G242,MYB-(R1)R2R3 domain
KGPWSPEEDEQLRRLVVKYGPRNWTVISKSIPGRSGKSCRLRWCNQLSPQVEHRPFSAEEDETIARAHAQFGNKWATIARLLNGRTDNAVKNHWNSTLKRK

SEQ ID NO: 2487 - protein, 103 aa, Arabidopsis thaliana
  G246,MYB-(R1)R2R3 domain
GHWTLSEDLKLKELVAVFGPQNWKFIGEKMEPRTSLSCRQRWFNQLDPKINKRNFTDEEEEKLLRAHILYGNKWSKIAKLFNRRTDHAVKNHWHSLMNRIIRK

SEQ ID NO: 2488 - protein, 102 aa, Arabidopsis thaliana
  G247,MYB-(R1)R2R3 domain
GLWTVEEDKILMDYVRTHGQGHWNRIAKKTGLKRCGKSCRLRWMNYLSPNVNRGNFTDQEEDLIIRLHKLLGNRWSLIAKRVPGRTDNQVKNYWNTHLSKKL

SEQ ID NO: 2489 - protein, 69 aa, Arabidopsis thaliana
  G248,MYB-(R1)R2R3 domain
KQCRERWHNHARPNVKKTTWSEEEDQILIEVHKVIGAKWIQISEQLPGRSYNNVKNHWNTTKRRVQNKS

SEQ ID NO: 2490 - protein, 98 aa, Arabidopsis thaliana
  G249,MYB-(R1)R2R3 domain
KGPWTMEEDLILINYIANHGEGVWNSLAKSAGLKRTGKSCRLRWLNYLRPDARRGNITPEEQLTIMELHAKWGNRWSKIAKHLPGRTDNEIKNFWRTK

SEQ ID NO: 2491 - protein, 101 aa, Arabidopsis thaliana
  G253,MYB-(R1)R2R3 domain
WKRWTLSEDLKLKELVAVYGPQKWPHIGKQMQGRSGKSCRSRWYNHLDPRIRNDVFSDEEEKLLIKAYNEWGCKWSKIARLFPGRTDRQMQRLWRLFVRDK

SEQ ID NO: 2492 - protein, 47 aa, Arabidopsis thaliana
  G254,MYB-related domain
ENWTDQEHDKFLEALHLFDRDWKKIEAFVGSKTVVQIRSHAQKYFLK

SEQ ID NO: 2493 - protein, 103 aa, Arabidopsis thaliana
  G255,MYB-(R1)R2R3 domain
KGAWTKEEDERLVSYIKSHGEGCWRSLPRAAGLLRCGKSCRLRWINYLRPDLKRGNFTHDEDELIIKLHSLLGNKWSLIAARLPGRTDNEIKNYWNTHIKRKL

SEQ ID NO: 2494 - protein, 103 aa, Arabidopsis thaliana
  G256,MYB-(R1)R2R3 domain
KGPWTPEEDIILVSYIQQHGPGNWRSVPANTGLLRCSKSCRLRWTNYLRPGIKRGNFTQPEEKMIIHLQALLGNRWAAIASYLPQRTDNDIKNYWNTHLKKKL

SEQ ID NO: 2495 - protein, 101 aa, Arabidopsis thaliana
  G258,MYB-(R1)R2R3 domain
RGLWSPEEDEKLLRYITTHGHPSWSSVPKLAGLQRCGKSCRLRWINYLRPDLRRGSFNEEEEQIIIDVHRILGNKWAQIAKHLPGRTDNEVKNFWNSCIKK

SEQ ID NO: 2496 - protein, 92 aa, Arabidopsis thaliana
  G259,HS domain
PFLVKTYKVVEDPTTDGVISWNEYGTGFVVWQPAEFARDLLPTLFKHCNFSSFVRQLNTYGFRKVTTIRWEFSNEMFRKGQRELMSNIRRRK

SEQ ID NO: 2497 - protein, 92 aa, Arabidopsis thaliana
  G261,HS domain
PFLTKTYEMVDDSSSDSIVSWSQSNKSFIVWNPPEFSRDLLPRFFKHNNFSSFIRQLNTYGFRKADPEQWEFANDDFVRGQPHLMKNIHRRK

SEQ ID NO: 2498 - protein, 92 aa, Arabidopsis thaliana
  G263,HS domain
PFLSKTYQLVDDHSTDDVVSWNEEGTAFVVWKTAEFAKDLLPQYFKHNNFSSFIRQLNTYGFRKTVPDKWEFANDYFRRGGEDLLTDIRRRK

SEQ ID NO: 2499 - protein, 92 aa, Arabidopsis thaliana
  G264,HS domain
PFLVKTYEMVDDSSTDQIVSWSANNNSFIVWNHAEFSRLLLPTYFKHNNFSSFIRQLNTYGFRKIDPERWEFLNDDFIKDQKHLLKNIHRRK

SEQ ID NO: 2500 - protein, 504 aa, Arabidopsis thaliana
  G268,AKR domain
EYIPCLDNTDVIKKLKSTERGERFERHCPEKGKGLNCLVPPPKGYRQPIPWPKSRDEVWFSNVPHTRLVEDKGGQNWISRDKNKFKFPGGGTQFIHGADQYLDQMSKMVSDITFGKHIRVAMDVGCGVASFGAYLLSRDVMTMSVAPKDVHENQIQFALERGVPAMAAAFATRRLLYPSQAFDLIHCSRCRINWTRDDGILLLEINRMLRAGGYFAWAAQPVYKHEPALEEQWTEMLNLTISLCWKLVKKEGYVAIWQKPFNNDCYLSREAGTKPPLCDESDDPDNVWYTNLKPCISRIPEKGYGGNVPLWPARLHTPPDRLQTIKFDSYIARKELFKAESKYWNEIIGGYVRALKWKKMKLRNVLDMRAGFGGFAAALNDHKLDCWVLSVVPVSGPNTLPVIYDRGLLGVMHDWCEPFDTYPRTYDFLHASGLFSIERKRCEMSTILLEMDRILRPGGRAYIRDSIDVMDEIQEITKAMGWHTSLRDTSEGPHASYRILTCEK

SEQ ID NO: 2501 - protein, 166 aa, Arabidopsis thaliana
  G270,AKR domain
KKWLPLHTLAACGEFYLVDSLLKHNLDINATDVGGLTVLHRAIIGKKQAITNYLLRESANPFVLDDEGATLMHYAVQTASAPTIKLLLLYNADINAQDRDGWTPLHVAVQARRSDIVKLLLIKGADIEVKNKDGLTPLGLCLYLGREIRTYEVMKLLKEFPLSRHK

SEQ ID NO: 2502 - protein, 66 aa, Arabidopsis thaliana
  G271,1st AKR domain
LGRTPLILACTNDDLYDVAKTLLELGSNVNAYRSGCNGGTPLHHAAKRGLVHTVKLLLSHGANPLV

SEQ ID NO: 2503 - protein, 39 aa, Arabidopsis thaliana
  G271,2nd AKR domain
CVICVDAPSEAVCVPCGHVAGCISCLKEIENKKMGCPVC

SEQ ID NO: 2504 - protein, 507 aa, Arabidopsis thaliana
  G274,AKR domain
DYTPCQEQDRAMKFPRENMIYRERHCPPDNEKLRCLVPAPKGYMTPFPWPKSRDYVHYANAPFKSLTVEKAGQNWVQFQGNVFKFPGGGTMFPQGADAYIEELASVIPIKDGSVRTALDTGCGVASWGAYMLKRNVLTMSFAPRDNHEAQVQFALERGVPAIIAVLGSILLPYPARAFDMAQCSRCLIPWTANEGTYLMEVDRVLRPGGYWVLSGPPINWKTWHKTWNRTKAELNAEQKRIEGIAESLCWEKKYEKGDIAIFRKKINDRSCDRSTPVDTCKRKDTDDVWYKEIETCVTPFPKVSNEEEVAGGKLKKFPERLFAVPPSISKGLINGVDEESYQEDINLWKKRVTGYKRINRLIGSTRYRNVMDMNAGLGGFAAALESPKSWVMNVIPTINKNTLSVVYERGLIGIYHDWCEGFSTYPRTYDFIHASGVFSLYQHSCKLEDILLETDRILRPEGIVIFRDEVDVLNDVRKIVDGMRWDTKLMDHEDGPLVPEKILVATK

SEQ ID NO: 2505 - protein, 506 aa, Arabidopsis thaliana
  G275,AKR domain
DYIPCLDNVQAIRSLPSTKHYEHRERHCPDSPPTCLVPLPDGYKRPIEWPKSREKIWYTNVPHTKLAEYKGHQNWVKVTGEYLTFPGGGTQFKHGALHYIDFIQESVPAIAWGKRSRVVLDVGCGVASFGGFLFDRDVITMSLAPKDEHEAQVQFALERGIPAISAVMGTTRLPFPGRVFDIVHCARCRVPWHIEGGKLLLELNRVLRPGGFFVWSATPVYQKKTEDVEIWKAMSELIKKMCWELVSINKDTINGVGVATYRKPTSNECYKNRSEPVPPICADSDDPNASWKVPLQACMHTAPEDKTQRGSQWPEQWPARLEKAPFWLSSSQTGVYGKAAPEDFSADYEHWKRVVTKSYLNGLGINWASVRNVMDMRAVYGGFAAALRDLKVWVMNVVPIDSPDTLAIIYERGLFGIYHDWCESFSTYPRSYDLLHADHLFSKLKQRCNLTAVIAEVDRVLRPEGKLIVLDDAETIQQVEGMVKAMKWEVRMTYSKEKEGLLSVQK

SEQ ID NO: 2506 - protein, 592 aa, Arabidopsis thaliana
  G278,AKR domain
DTTIDGFADSYEISSTSFVATDNTDSSIVYLAAEQVLTGPDVSALQLLSNSFESVFDSPDDFYSDAKLVLSDGREVSFHRCVLSARSSFFKSALAAAKKEKDSNNTAAVKLELKEIAKDYEVGFDSVVTVLAYVYSSRVRPPPKGVSECADENCCHVACRPAVDFMLEVLYLAFIFKIPELITLYQRHLLDVVDKVVIEDTLVILKLANICGKACMKLLDRCKEIIVKSNVDMVSLEKSLPEELVKEIIDRRKELGLEVPKVKKHVSNVHKALDSDDIELVKLLLKEDHTNLDDACALHFAVAYCNVKTATDLLKLDLADVNHRNPRGYTVLHVAAMRKEPQLILSLLEKGASASEATLEGRTALMIAKQATMAVECNNIPEQCKHSLKGRLCVEILEQEDKREQIPRDVPPSFAVAADELKMTLLDLENRVALAQRLFPTEAQAAMEIAEMKGTCEFIVTSLEPDRLTGTKRTSPGVKIAPFRILEEHQSRLKALSKTVELGKRFFPRCSAVLDQIMNCEDLTQLACGEDDTAEKRLQKKQRYMEIQETLKKAFSEDNLELGNSSLTDSTSSTSKSTGGKRSNRKLSHRRR

SEQ ID NO: 2507 - protein, 8 aa, Arabidopsis thaliana
  G280,1st AT-hook domain
KRGRGRPP

SEQ ID NO: 2508 - protein, 8 aa, Arabidopsis thaliana
  G280,2nd AT-hook domain
PRSRGRPP

SEQ ID NO: 2509 - protein, 8 aa, Arabidopsis thaliana
  G280,3rd AT-hook domain
GRPRGRPP

SEQ ID NO: 2510 - protein, 8 aa, Arabidopsis thaliana
  G280,4th AT-hook domain
RRGRGRPP

SEQ ID NO: 2511 - protein, 62 aa, Arabidopsis thaliana
  G287,MISC domain
PVKGHVCKHLQCFDFWNYVNMNTRRPSWRCPHCNQSVCYTDIRVDQKLRKILEEVGRNAADV

SEQ ID NO: 2512 - protein, 29 aa, Arabidopsis thaliana
  G291,MISC domain
GRLENVVGWYHSHPGYGCWLSGIDVSTQM

SEQ ID NO: 2513 - protein, 60 aa, Arabidopsis thaliana
  G303,HLH/MYC domain
DKENQRMNHIAVERNRRKQMNHFLSILKSMMPLSYSQPNDQASIIEGTISYLKKLEQRLQ

SEQ ID NO: 2514 - protein, 66 aa, Arabidopsis thaliana
  G307,1st SCR domain
QMHFYETCPYLKFAHFTANQAILEAFEGKKRVHVIDFSMNQGLQWPALMQALALREGGPPTFRLTG

SEQ ID NO: 2515 - protein, 86 aa, Arabidopsis thaliana
  G307,2nd SCR domain
VNSVFELHKLLGRPGGIEKVLGVVKQIKPVIFTVVEQESNHNGPVFLDRFTESLHYYSTLFDSLEGVPNSQDKVMSEVYLGKQICN

SEQ ID NO: 2516 - protein, 76 aa, Arabidopsis thaliana
  G307,3rd SCR domain
ACEGPDRVERHETLSQWGNRFGSSGLAPAHLGSNAFKQASMLLSVFNSGQGYRVEESNGCLMLGWHTRPLITTSAW

SEQ ID NO: 2517 - protein, 66 aa, Arabidopsis thaliana
  G308,1st SCR domain
QMHFYETCPYLKFAHFTANQAILEAFQGKKRVHVIDFSMSQGLQWPALMQALALRPGGPPVFRLTG

SEQ ID NO: 2518 - protein, 86 aa, Arabidopsis thaliana
  G308,2nd SCR domain
VNSVFELHKLLGRPGAIDKVLGVVNQIKPEIFTVVEQESNHNSPIFLDRFTESLHYYSTLFDSLEGVPSGQDKVMSEVYLGKQICN

SEQ ID NO: 2519 - protein, 76 aa, Arabidopsis thaliana
  G308,3rd SCR domain
ACDGPDRVERHETLSQWRNRFGSAGFAAAHIGSNAFKQASMLLALFNGGEGYRVEESDGCLMLGWHTRPLIATSAW

SEQ ID NO: 2520 - protein, 66 aa, Arabidopsis thaliana
  G309,1st SCR domain
QIHFYESCPYLKFAHFTANQAILEVFATAEKVHVIDLGLNHGLQWPALIQALALRPNGPPDFRLTG

SEQ ID NO: 2521 - protein, 86 aa, Arabidopsis thaliana
  G309,2nd SCR domain
AVNSVFELHRLLAHPGSIDKFLSTIKSIRPDIMTVVEQEANHNGTVFLDRFTESLHYYSSLFDSLEGPPSQDRVMSELFLGRQILN

SEQ ID NO: 2522 - protein, 75 aa, Arabidopsis thaliana
  G309,3rd SCR domain
CEGEDRVERHETLNQWRNRFGLGGFKPVSIGSNAYKQASMLLALYAGADGYNVEENEGCLLLGWQTRPLIATSAW

SEQ ID NO: 2523 - protein, 67 aa, Arabidopsis thaliana
  G312,1st SCR domain
YKTLNDACPYSKFAHLTANQAILEATEKSNKIHIVDFGIVQGIQWPALLQALATRTSGKPTQIRVSG

SEQ ID NO: 2524 - protein, 90 aa, Arabidopsis thaliana
  G312,2nd SCR domain
VNFMLQLYKLLDETPTIVDTALRLAKSLNPRVVTLGEYEVSLNRVGFANRVKNALQFYSAVFESLEPNLGRDSEERVRVERELFGRRISG

SEQ ID NO: 2525 - protein, 81 aa, Arabidopsis thaliana
  G312,3rd SCR domain
GLIGPEKTGIHRERMEEKEQWRVLMENAGFESVKLSNYAVSQAKILLWNYNYSNLYSIVESKPGFISLAWNDLPLLTLSSW

SEQ ID NO: 2526 - protein, 68 aa, Arabidopsis thaliana
  G314,SCR domain
LAEFVDLTPWHRFGFIAANAAILDAVEGYSSVHIVDLSLTHCMQIPTLIDSMANKLHKKPPPLLKLTV

SEQ ID NO: 2527 - protein, 31 aa, Arabidopsis thaliana
  G319,Z-CO-like domain
LCLQCDLKLHSKSSTALVESLEQGLCLCQSC

SEQ ID NO: 2528 - protein, 47 aa, Arabidopsis thaliana
  G324,RING/C3H2C3 domain
CPICLEYPLCPQITSCGHIFCFPCILQYLLTGVDNHKVDCFKRCPLC

SEQ ID NO: 2529 - protein, 24 aa, Arabidopsis thaliana
  G325,1st Z-CO-like domain
CDFCGTEKALIYCKSDSAKLCLNC

SEQ ID NO: 2530 - protein, 24 aa, Arabidopsis thaliana
  G325,2nd Z-CO-like domain
CEKCSLQPTAVHCMNENVSLCQGC

SEQ ID NO: 2531 - protein, 84 aa, Arabidopsis thaliana
  G326,1st Z-CO-like domain
ACEFCGERTAVLFCRADTAKLCLPCDQHVHSANLLSRKHVRSQICDNCSKEPVSVRCFTDNLVLCQECDWDVHGSCSSSATHER

SEQ ID NO: 2532 - protein, 47 aa, Arabidopsis thaliana
  G326,2nd Z-CO-like domain
QNRDNAMQRYKEKKKTRRYDKTIRYETRKARAETRLRVKGRFVKATD

SEQ ID NO: 2533 - protein, 67 aa, Arabidopsis thaliana
  G328,Z-CO-like domain
CDTCRSAACTVYCRADSAYLCSSCDAQVHAANRLASRHERVRVCQSCERAPAAFFCKADAASLCTTC

SEQ ID NO: 2534 - protein, 37 aa, Arabidopsis thaliana
  G343,GATA/Zn domain
MRRCTHCASEKTPQWRTGPLGPKTLCNACGVRFKSGR

SEQ ID NO: 2535 - protein, 27 aa, Arabidopsis thaliana
  G344,GATA/Zn domain
CSHCGVQKTPQWRMGPLGAKTLCNACG

SEQ ID NO: 2536 - protein, 26 aa, Arabidopsis thaliana
  G346,GATA/Zn domain
CQHCGAEKTPQWRAGPAGPKTLCNAC

SEQ ID NO: 2537 - protein, 31 aa, Arabidopsis thaliana
  G347,1st Z-LSDlike domain
QLVCHGCRNLLMYPRGASNVRCALCNTINMV

SEQ ID NO: 2538 - protein, 21 aa, Arabidopsis thaliana
  G347,2nd Z-LSDlike domain
HIICGGCRTMLMYTRGASSVR

SEQ ID NO: 2539 - protein, 48 aa, Arabidopsis thaliana
  G347,3rd Z-LSDlike domain
VPAHSNQVAHAPSSQVAQINCGHCRTTLMYPYGASSVKCAVCQFVTNV

SEQ ID NO: 2540 - protein, 21 aa, Arabidopsis thaliana
  G351,1st Z-C2H2 domain
CGVCYKTFSSYQALGGHKASH

SEQ ID NO: 2541 - protein, 23 aa, Arabidopsis thaliana
  G351,2nd Z-C2H2 domain
HVCSVCGKSFATGQALGGHKRCH

SEQ ID NO: 2542 - protein, 21 aa, Arabidopsis thaliana
  G353,1st Z-C2H2 domain
CKTCLKQFHSFQALGGHRASH

SEQ ID NO: 2543 - protein, 21 aa, Arabidopsis thaliana
  G353,2nd Z-C2H2 domain
CPICGVEFPMGQALGGHMRRH

SEQ ID NO: 2544 - protein, 21 aa, Arabidopsis thaliana
  G354,1st Z-C2H2 domain
CKTCLKEFSSFQALGGHRASH

SEQ ID NO: 2545 - protein, 22 aa, Arabidopsis thaliana
  G354,2nd Z-C2H2 domain
CPICGVKFPMGQALGGHMRRHR

SEQ ID NO: 2546 - protein, 21 aa, Arabidopsis thaliana
  G355,1st Z-C2H2 domain
CKTCNKRFSSFQALGGHRASH

SEQ ID NO: 2547 - protein, 23 aa, Arabidopsis thaliana
  G355,2nd Z-C2H2 domain
HKCSICSQSFGTGQALGGHMRRH

SEQ ID NO: 2548 - protein, 21 aa, Arabidopsis thaliana
  G359,Z-C2H2 domain
CSFCKREFRSAQALGGHMNVH

SEQ ID NO: 2549 - protein, 21 aa, Arabidopsis thaliana
  G361,Z-C2H2 domain
CQYCCREFANSQALGGHQNAH

SEQ ID NO: 2550 - protein, 21 aa, Arabidopsis thaliana
  G362,Z-C2H2 domain
CQYCGKEFANSQALGGHQNAH

SEQ ID NO: 2551 - protein, 22 aa, Arabidopsis thaliana
  G363,Z-C2H2 domain
CNYCQRKFYSSQALGGHQNAHK

SEQ ID NO: 2552 - protein, 21 aa, Arabidopsis thaliana
  G366,Z-C2H2 domain
CQYCPRKFYTSQALGGHQNAH

SEQ ID NO: 2553 - protein, 21 aa, Arabidopsis thaliana
  G370,Z-C2H2 domain
CHYCFRNFPTSQALGGHQNAH

SEQ ID NO: 2554 - protein, 54 aa, Arabidopsis thaliana
  G371,RING/C3HC4 domain
CNICLDQVRDPVVTLCGHLFCWPCIHKWTYASNNSRQRVDQYDHKREPPKCPVC

SEQ ID NO: 2555 - protein, 40 aa, Arabidopsis thaliana
  G372,RING/C3HC4 domain
CYICLDLSKDPVVTNCGHLYCWSCLYQWLQVSEAKECPVC

SEQ ID NO: 2556 - protein, 33 aa, Arabidopsis thaliana
  G374,1st Z-ZPF domain
CMRCQENGTTRFLLTLIPHFRKVLISAFECPHC

SEQ ID NO: 2557 - protein, 33 aa, Arabidopsis thaliana
  G374,2nd Z-ZPF domain
CGACTEPCETRMFVTKIPYFQEVIVMASTCDSC

SEQ ID NO: 2558 - protein, 29 aa, Arabidopsis thaliana
  G375,Z-Dof domain
CPRCESTHTKFCYYNNYSLSQPRYFCKTC

SEQ ID NO: 2559 - protein, 44 aa, Arabidopsis thaliana
  G377,RING/C3H2C3 domain
CCVCLCGFKEEEEVSELVSCKHFFHRACLDNWFGNNHTTCPLCR

SEQ ID NO: 2560 - protein, 42 aa, Arabidopsis thaliana
  G378,RING/C3H2C3 domain
CSVCLQDFQLGETVRSLPHCHHMFHLPCIDNWLLRHGSCPMC

SEQ ID NO: 2561 - protein, 41 aa, Arabidopsis thaliana
  G380,RING/C3H2C3 domain
CCVCQEEYTEGEDMGTLECGHEFHSQCIKEWLKQKNLCPIC

SEQ ID NO: 2562 - protein, 26 aa, Arabidopsis thaliana
  G383,GATA/Zn domain
CANCDTTSTPLWRNGPRGPKSLCNAC

SEQ ID NO: 2563 - protein, 64 aa, Arabidopsis thaliana
  G384,HB domain
QRPNKKKRYHRHTQRQIQELESFFKECPHPDDKQRKELSRELSLEPLQVKFWFQNKRTQMKAQH

SEQ ID NO: 2564 - protein, 64 aa, Arabidopsis thaliana
  G385,HB domain
LHPNKKKRYHRHTQLQIQEMEAFFKECPHPDDKQRKQLSRELNLEPLQVKFWFQNKRTQMKNHH

SEQ ID NO: 2565 - protein, 61 aa, Arabidopsis thaliana
  G386,HB domain
PRKKRYHRHTPQQIQELESMFKECPHPDEKQRLELSKRLCLETRQVKFWFQNRRTQMKTQL

SEQ ID NO: 2566 - protein, 61 aa, Arabidopsis thaliana
  G388,HB domain
RKRKKYHRHTTDQIRHMEALFKETPHPDEKQRQQLSKQLGLAPRQVKFWFQNRRTQIKAIQ

SEQ ID NO: 2567 - protein, 64 aa, Arabidopsis thaliana
  G390,HB domain
DSGKYVRYTPEQVEALERVYAECPKPSSLRRQQLIRECPILCNIEPRQIKVWFQNRRCREKQRK

SEQ ID NO: 2568 - protein, 61 aa, Arabidopsis thaliana
  G391,HB domain
KYVRYTPEQVEALERVYTECPKPSSLRRQQLIRECPILSNIEPKQIKVWFQNRRCREKQRK

SEQ ID NO: 2569 - protein, 62 aa, Arabidopsis thaliana
  G394,HB domain
GVSARKKLRLTKQQSALLEDNFKLHSTLNPKQKQALARQLNLRPRQVEVWFQNRRARTKLKQ

SEQ ID NO: 2570 - protein, 61 aa, Arabidopsis thaliana
  G409,HB domain
QLPEKKRRLTTEQVHLLEKSFETENKLEPERKTQLAKKLGLQPRQVAVWFQNRRARWKTKQ

SEQ ID NO: 2571 - protein, 61 aa, Arabidopsis thaliana
  G416,HB domain
KGGRRRMFRLPRNAVELRQVFAETELPSKAVRDRLAKELSLDPEKVNKWFKNTRYMALRNR

SEQ ID NO: 2572 - protein, 61 aa, Arabidopsis thaliana
  G418,HB domain
RPQRGLPERSVNILRAWLFEHFLHPYPSDADKHLLARQTGLSRNQVSNWFINARVRLWKPM

SEQ ID NO: 2573 - protein, 61 aa, Arabidopsis thaliana
  G419,HB domain
RPQRGLPERAVTTLRAWLFEHFLHPYPSDVDKHILARQTGLSRSQVSNWFINARVRLWKPM

SEQ ID NO: 2574 - protein, 64 aa, Arabidopsis thaliana
  G427,HB domain
LRKRRAGKLPGDTTSVLKSWWQSHSKWPYPTEEDKARLVQETGLQLKQINNWFINQRKRNWHSN

SEQ ID NO: 2575 - protein, 64 aa, Arabidopsis thaliana
  G428,HB domain
SKKKKKGKLPREARQALLDWWNVHNKWPYPTEGDKIALAEETGLDQKQINNWFINQRKRHWKPS

SEQ ID NO: 2576 - protein, 50 aa, Arabidopsis thaliana
  G431,HB domain
RKKGKLPKEARQQLLDWWSRHYKWPYPSEQQKLALAESTGLDQKQINNWF

SEQ ID NO: 2577 - protein, 61 aa, Arabidopsis thaliana
  G434,HB domain
GRMRRTHRRTAYQTQELENFYMENPHPTEEQRYELGQRLNMGVNQVKNWFQNKRNLEKINN

SEQ ID NO: 2578 - protein, 64 aa, Arabidopsis thaliana
  G435,HB domain
SQSQGKNKKKRLTQDQVRQLEKCFTMNKKLEPDLKLQLSNQLGLPQRQVAVWFQNKRARFKTQS

SEQ ID NO: 2579 - protein, 64 aa, Arabidopsis thaliana
  G438,HB domain
SSGKYVRYTAEQVEALERVYAECPKPSSLRRQQLIRECSILANIEPKQIKVWFQNRRCRDKQRK

SEQ ID NO: 2580 - protein, 63 aa, Arabidopsis thaliana
  G440,AP2 domain
IKKFRGVRQRPWGKWAAEIRDPEQRRRIWLGTFETAEEAAVVYDNAAIRLRGPDALTNFSIPP

SEQ ID NO: 2581 - protein, 73 aa, Arabidopsis thaliana
  G442,AP2 domain
PVCRFRGVRQRVWGKWVAEIREPVSHRGANSSRSKRLWLGTFATAAEAALAYDRAASVMYGPYARLNFPEDLG

SEQ ID NO: 2582 - protein, 337 aa, Arabidopsis thaliana
  G446,ARF domain
SELWHACAGPLVCLPQVGSLVYYFSQGHSEQVAVSTRRSATTQVPNYPNLPSQLMCQVHNVTLHADKDSDEIYAQMSLQPVHSERDVFPVPDFGMLRGSKHPTEFFCKTLTASDTSTHGGFSVPRRAAEKLFPPLDYSAQPPTQELVVRDLHENTWTFRHIYRGQPKRHLLTTGWSLFVGSKRLRAGDSVLFIRDEKSQLMVGVRRANRQQTALPSSVLSADSMHIGVLAAAAHATANRTPFLIFYNPRACPAEFVIPLAKYRKAICGSQLSVGMRFGMMFETEDSGKRRYMGTIVGISDLDPLRWPGSKWRNLQVEWDEPGCNDKPTRVSPWDIET

SEQ ID NO: 2583 - protein, 335 aa, Arabidopsis thaliana
  G447,ARF domain
SQLWHACAGPLVSLPPVGSLVVYFPQGHSEQVAASMQKQTDFIPNYPNLPSKLICLLHSVTLHADTETDEVYAQMTLQPVNKYDREALLASDMGLKLNRQPTEFFCKTLTASDTSTHGGFSVPRRAAEKIFPPLDFSMQPPAQEIVAKDLHDTTWTFRHIYRGQPKRHLLTTGWSVFVSTKRLFAGDSVLFVRDEKSQLMLGIRRANRQTPTLSSSVISSDSMHIGILAAAAHANANSSPFTIFFNPRASPSEFVVPLAKYNKALYAQVSLGMRFRMMFETEDCGVRRYMGTVTGISDLDPVRWKGSQWRNLQVGWDESTAGDRPSRVSIWEIEP

SEQ ID NO: 2584 - protein, 9 aa, Arabidopsis thaliana
  G450,1st IAA domain
TELCLGLPG

SEQ ID NO: 2585 - protein, 12 aa, Arabidopsis thaliana
  G450,2nd IAA domain
VGWPPVRNYRKN

SEQ ID NO: 2586 - protein, 17 aa, Arabidopsis thaliana
  G450,3rd IAA domain
FVKVSMDGAPYLRKVDL

SEQ ID NO: 2587 - protein, 38 aa, Arabidopsis thaliana
  G450,4th IAA domain
YEDKDGDWMLVGDVPWPMFVESCKRLRIMKGSEAIGLA

SEQ ID NO: 2588 - protein, 9 aa, Arabidopsis thaliana
  G451,1st IAA domain
TELRLGLPG

SEQ ID NO: 2589 - protein, 12 aa, Arabidopsis thaliana
  G451,2nd IAA domain
VGWPPVRSNRKN

SEQ ID NO: 2590 - protein, 17 aa, Arabidopsis thaliana
  G451,3rd IAA domain
YVKVSMDGAPYLRKIDL

SEQ ID NO: 2591 - protein, 34 aa, Arabidopsis thaliana
  G451,4th IAA domain
YEDKDGDWMLVGDVPWDMFSSSCQKLRIMKGSEA

SEQ ID NO: 2592 - protein, 8 aa, Arabidopsis thaliana
  G456,1st IAA domain
TELRLGLP

SEQ ID NO: 2593 - protein, 11 aa, Arabidopsis thaliana
  G456,2nd IAA domain
VVGWPPVRSFR

SEQ ID NO: 2594 - protein, 34 aa, Arabidopsis thaliana
  G456,3rd IAA domain
YVKVSMDGAPYLRKIDLKLYKTYQDLSNALSKMF

SEQ ID NO: 2595 - protein, 37 aa, Arabidopsis thaliana
  G456,4th IAA domain
VPTYEDKDGDWMLVGDVPWEMFVDSCKRIRIMKGSEA

SEQ ID NO: 2596 - protein, 9 aa, Arabidopsis thaliana
  G461,1st IAA domain
TELRLGLPG

SEQ ID NO: 2597 - protein, 13 aa, Arabidopsis thaliana
  G461,2nd IAA domain
QAVGWPPVCSYRR

SEQ ID NO: 2598 - protein, 17 aa, Arabidopsis thaliana
  G461,3rd IAA domain
YVKVSMDGVPYMRKIDL

SEQ ID NO: 2599 - protein, 34 aa, Arabidopsis thaliana
  G461,4th IAA domain
YEDKDRDWMLVGDVPWQMFKESCKRLRIVKRSDA

SEQ ID NO: 2600 - protein, 9 aa, Arabidopsis thaliana
  G462,1st IAA domain
TELRLGLPG

SEQ ID NO: 2601 - protein, 13 aa, Arabidopsis thaliana
  G462,2nd IAA domain
QVVGWPPVCSYRK

SEQ ID NO: 2602 - protein, 17 aa, Arabidopsis thaliana
  G462,3rd IAA domain
YVKVSMDGVPYLRKMDL

SEQ ID NO: 2603 - protein, 34 aa, Arabidopsis thaliana
  G462,4th IAA domain
YEDKDGDWMLAGDVPWGMFLESCKRLRIMKRSDA

SEQ ID NO: 2604 - protein, 9 aa, Arabidopsis thaliana
  G464,1st IAA domain
LELGLGLSL

SEQ ID NO: 2605 - protein, 12 aa, Arabidopsis thaliana
  G464,2nd IAA domain
VGWPPIGLHRMN

SEQ ID NO: 2606 - protein, 17 aa, Arabidopsis thaliana
  G464,3rd IAA domain
FVKVNMDGVGIGRKVDM

SEQ ID NO: 2607 - protein, 38 aa, Arabidopsis thaliana
  G464,4th IAA domain
YEDKEGDWMLVGDVPWRMFINSVKRLRIMGTSEASGLA

SEQ ID NO: 2608 - protein, 17 aa, Arabidopsis thaliana
  G468,1st IAA domain
YVKVNMEGVPIGRKIDL

SEQ ID NO: 2609 - protein, 31 aa, Arabidopsis thaliana
  G468,2nd IAA domain
YADKEGDWMMVGDVPWEMFLSTVRRLKISRA

SEQ ID NO: 2610 - protein, 333 aa, Arabidopsis thaliana
  G470,ARF domain
ELWHACAGPLVTVPRQDDRVFYFPQGHIEQVEASTNQAAEQQMPLYDLPSKLLCRVINVDLKAEADTDEVYAQITLLPEANQDENAIEKEAPLPPPPRFQVHSFCKTLTASDTSTHGGFSVLRRHADECLPPLDMSRQPPTQELVAKDLHANEWRFRHIFRGQPRRHLLQSGWSVFVSSKRLVAGDAFIFLRGENGELRVGVRRAMRQQGNVPSSVISSHSMHLGVLATAWHAISTGTMFTVYYKPRTSPSEFIVPFDQYMESVKNNYSIGMRFKMRFEGEEAPEQRFTGTIVGIEESDPTRWPKSKWRSLKVRWDETSSIPRPDRVSPWKVE

SEQ ID NO: 2611 - protein, 75 aa, Arabidopsis thaliana
  G475,SBP domain
VCQVESCTADMSKAKQYHKRHKVCQFHAKAPHVRISGLHQRFCQQCSRFHALSEFDEAKRSCRRRLAGHNERRRK

SEQ ID NO: 2612 - protein, 126 aa, Arabidopsis thaliana
  G477,SBP domain
PSKKSRASNLCSQNPLCQVYGCSKDLSSSKDYHKRHRVCEAHSKTSVVIVNGLEQRFCQQCSRFHFLSEFDDGKRSCRRRLAGHNERRRKPAFYFLPGKRHKLLRTSQDVVGNKFLENSSLVLPES

SEQ ID NO: 2613 - protein, 96 aa, Arabidopsis thaliana
  G478,SBP domain
PRCQAEGCNADLSHAKHYHRRHKVCEFHSKASTVVAAGLSQRFCQQCSRFHLLSEFDNGKRSCRKRLADHNRRRRKCHQSASATQDTGTGKTTPKS

SEQ ID NO: 2614 - protein, 97 aa, Arabidopsis thaliana
  G483,CAAT domain
QEIEHTTDFKNHTLPLARIKKIMKADEDVRMISAEAPVIFAKACEMFILELTLRAWIHTEENKRRTLQKNDIAAAISRTDVFDFLVDIIPRDELKEE

SEQ ID NO: 2615 - protein, 89 aa, Arabidopsis thaliana
  G484,CAAT domain
KEDASLPKATMTKIIKEMLPPDVRVARDAQDLLIECCVEFINLVSSESNDVCNKEDKRTIAPEHVLKALQVLGFGEYIEEVYAAYEQHK

SEQ ID NO: 2616 - protein, 90 aa, Arabidopsis thaliana
  G485,CAAT domain
REQDRFLPIANVSRIMKKALPANAKISKDAKETVQECVSEFISFITGEASDKCQREKRKTINGDDLLWAMTTLGFEDYVEPLKVYLQKYR

SEQ ID NO: 2617 - protein, 64 aa, Arabidopsis thaliana
  G486,CAAT domain
DEDRLLPIANVGRLMKQILPSNAKISKEAKQTVQECATEFISFVTCEASEKCHRENRKTVNGDD

SEQ ID NO: 2618 - protein, 97 aa, Arabidopsis thaliana
  G489,CAAT domain
KEIEKTTDFKKHSLPLARIKKIMKADEDVRMISAEAPVVFARACEMFILELTLRSWNHTEENKRRTLQKNDIAAAVTRTDIFDFLVDIVPREDLRDE

SEQ ID NO: 2619 - protein, 90 aa, Arabidopsis thaliana
  G490,CAAT domain
REQLGNFAGQTHLPLSRVRKILKSDPEVKKISCDVPALFSKACEYFILEVTLRAWMHTQSCTRETIRRCDIFQAVKNSGTYDFLIDRVPF

SEQ ID NO: 2620 - protein, 146 aa, Arabidopsis thaliana
  G502,NAC domain
GFRFHPTDEELVMHYLCRKCASQSIAVPIIAEIDLYKYDPWELPGLALYGEKEWYFFSPRDRKYPNGSRPNRSAGSGYWKATGADKPIGLPKPVGIKKALVFYAGKAPKGEKTNWIMHEYRLADVDRSVRKKKNSLRLDDWVLCRI

SEQ ID NO: 2621 - protein, 163 aa, Arabidopsis thaliana
  G504,NAC domain
LPPGFRFHPTDEELVVHYLKKKADSVPLPVSIIAEIDLYKFDPWELPSKASFGEHEWYFFSPRDRKYPNGVRPNRAATSGYWKATGTDKPIFTCNSHKVGVKKALVFYGGKPPKGIKTDWIMHEYRLTDGNLSTAAKPPDLTTTRKNSLRLDDWVLCRIYKKN

SEQ ID NO: 2622 - protein, 151 aa, Arabidopsis thaliana
  G505,NAC domain
GFRFHPTDEELITHYLLRKVLDGCFSSRAIAEVDLNKCEPWQLPGRAKMGEKEWYFFSLRDRKYPTGLRTNRATEAGYWKATGKDREIFSSKTCALVGMKKTLVFYKGRAPKGEKSNWVMHEYRLEGKFSYHFISRSSKDEWVISRVFQKT

SEQ ID NO: 2623 - protein, 157 aa, Arabidopsis thaliana
  G509,NAC domain
GFRFHPSDEELVCHYLCNKIRAKSDHGDVDDDDDDVDEALKGSTDLVEIDLHICEPWELPDVAKLNAKEWYFFSFRDRKYATGYRTNRATVSGYWKATGKDRTVMDPRTRQLVGMRKTLVFYRNRAPNGIKTTWIMHEFRLECPNIPHKEDWVLCRV

SEQ ID NO: 2624 - protein, 144 aa, Arabidopsis thaliana
  G515,NAC domain
GLRFCPTDEEIVVDYLWPKNSDRDTSHVDRFINTVPVCRLDPWELPCQSRIKLKDVAWCFFRPKENKYGRGDQQMRKTKSGFWKSTGRPKPIMRNRQQIGEKKILMFYTSKESKSDWVIHEYHGFSHNQMMMTYTLCKVMFNGG

SEQ ID NO: 2625 - protein, 136 aa, Arabidopsis thaliana
  G516,NAC domain
GFRFRPTDGEIVDIYLRPKNLESNTSHVDEVISTVDICSFDPWDLPSHSRMKTRDQVWYFFGRKENKYGKGDRQIRKTKSGFWKKTGVTMDIMRKTGDREKIGEKRVLVFKNHGGSKSDWAMHEYHATFSSPNQGE

SEQ ID NO: 2626 - protein, 148 aa, Arabidopsis thaliana
  G517,NAC domain
GFRFRPNDEEIVDHYLRPKNLDSDTSHVDEVISTVDICSFEPWDLPSKSMIKSRDGVWYFFSVKEMKYNRGDQQRRRTNSGFWKKTGKTMTVMRKRGNREKIGEKRVLVFKNRDGSKTDWVMHEYHATSLFPNQMMTYTVCKVEFKGE

SEQ ID NO: 2627 - protein, 122 aa, Arabidopsis thaliana
  G519,NAC domain
GFRFHPTDEELVKFYLCRRCASEPINVPVIAEIDLYKFNPWELPEMALYGEKEWYFFSHRDRKYPNGSRPNRAAGTGYWKATGADKPIGKPKTLGIKKALVFYAGKAPKGIKTNWIMHEYRL

SEQ ID NO: 2628 - protein, 150 aa, Arabidopsis thaliana
  G521,NAC domain
APGFRFHPTDVELVRYYLKRKVMGKKFQVDAIAEVDIYKFEPPDLPDKSCLGTGDLKWYFFCPREKKYPKGGKANRSTECGYWKTTGRDRDVSYNDEVTGKIRTLIYHYGKIPRGDRTDWVIHEYRLEDKVLAQKNVPQDTYVLCVLFKK

SEQ ID NO: 2629 - protein, 156 aa, Arabidopsis thaliana
  G522,NAC domain
VPPGFRFHPTDEELVGYYLRKKVASQKIDLDVIRDIDLYRIEPWDLQESCRIGYEERNEWYFFSHKDKKYPTGTRTNRATMAGFWKATGRDKAVYDKSKLIGMRKTLVFYKGRAPNGQKTDWIMHEYRLESDENAPPQEEGWVVCRAFKKKPMTGQ

SEQ ID NO: 2630 - protein, 145 aa, Arabidopsis thaliana
  G525,NAC domain
GFRFHPTDEELITHYLKPKVFNTFFSATAIGEVDLNKIEPWDLPWKAKMGEKEWYFFCVRDRKYPTGLRTNRATEAGYWKATGKDKEIFKGKSLVGMKKTLVFYKGRAPKGVKTNWVMHEYRLEGKYCIENLPQTAKNEWVICRV

SEQ ID NO: 2631 - protein, 129 aa, Arabidopsis thaliana
  G526,NAC domain
LPPGFRFHPTDEEIITCYLKEKVLNSRFTAVAMGEADLNKCEPWDLPKRAKMGEKEFYFFCQRDRKYPTGMRTNRATESGYWKATGKDKEIFKGKGCLVGMKKTLVFYRGRAPKGEKTNWVMHEYRLEG

SEQ ID NO: 2632 - protein, 8 aa, Arabidopsis thaliana
  G536,GF14 domain
LRDNLTLW

SEQ ID NO: 2633 - protein, 21 aa, Arabidopsis thaliana
  G545,1st Z-C2H2 domain
CSVCDKTFSSYQALGGHKASH

SEQ ID NO: 2634 - protein, 19 aa, Arabidopsis thaliana
  G545,2nd Z-C2H2 domain
HVCTICNKSFPSGQALGGH

SEQ ID NO: 2635 - protein, 42 aa, Arabidopsis thaliana
  G546,RING/C3H2C3 domain
EIRVLPLCGHSFHVECIDKWLVSRSSCPSCRRILTPVRCDRC

SEQ ID NO: 2636 - protein, 395 aa, Arabidopsis thaliana
  G549,MISC domain
MDPEGFTSGLFRWNPTRALVQAPPPVPPPLQQQPVTPQTAAFGMRLGGLEGLFGPYGIRFYTAAKIAELGFTASTLVGMKDEELEEMMNSLSHIFRWELLVGERYGIKAAVRAERRRLQEEEEEESSRRRHLLLSAAGDSGTHHALDALSQEDDWTGLSEEPVQQQDQTDAAGNNGGGGSGYWDAGQGKMKKQQQQRRRKKPMLTSVETDEDVNEGEDDDGMDNGNGGSGLGTERQREHPFIVTEPGEVARGKKNGLDYLFHLYEQCREFLLQVQTIAKDRGEKCPTKVTNQVFRYAKKSGASYINKPKMRHYVHCYALHCLDEEASNALRRAFKERGENVGSWRQACYKPLVNIACRHGWDIDAVFNAHPRLSIWYVPTKLRQLCHLERNNAVA

SEQ ID NO: 2637 - protein, 47 aa, Arabidopsis thaliana
  G550,Z-Dof domain
PDKILPCPRCNSMETKFCYYNNYNVNQPRHFCKKCQRYWTAGGTMRN

SEQ ID NO: 2638 - protein, 61 aa, Arabidopsis thaliana
  G551,HB domain
NEMIKKKRLTSGQLASLERSFQEEIKLDSDRKVKLSRELGLQPRQIAVWFQNRRARWKAKQ

SEQ ID NO: 2639 - protein, 61 aa, Arabidopsis thaliana
  G557,bZIP domain
KRLKRLLRNRVSAQQARERKKAYLSELENRVKDLENKNSELEERLSTLQNENQMLRHILKN

SEQ ID NO: 2640 - protein, 61 aa, Arabidopsis thaliana
  G558,bZIP domain
QKTLRRLAQNREAARKSRLRKKAYVQQLENSRLKLTQLEQELQRARQQGVFISGTGDQAHS

SEQ ID NO: 2641 - protein, 62 aa, Arabidopsis thaliana
  G559,bZIP domain
KRAKRIWANRQSAARSKERKTRYIFELERKVQTLQTEATTLSAQLTLLQRDTNGLTVENNEL

SEQ ID NO: 2642 - protein, 61 aa, Arabidopsis thaliana
  G561,bZIP domain
KEVKREKRKQSNRESARRSRLRKQAETEQLSVKVDALVAENMSLRSKLGQLNNESEKLRLE

SEQ ID NO: 2643 - protein, 63 aa, Arabidopsis thaliana
  G562,bZIP domain
WLQNERELKRERRKQSNRESARRSRLRKQAETEELARKVEALTAENMALRSELNQLNEKSDKL

SEQ ID NO: 2644 - protein, 61 aa, Arabidopsis thaliana
  G567,bZIP domain
SLKPEDVKKSRRMLSNRESARRSRRRKQEQTSDLETQVNDLKGEHSSLLKQLSNMNHKYDE

SEQ ID NO: 2645 - protein, 51 aa, Arabidopsis thaliana
  G568,bZIP domain
NRRHKRMIKNRESAARSRARKQAYTNELELEVAHLQAENARLKRQQDQKMA

SEQ ID NO: 2646 - protein, 61 aa, Arabidopsis thaliana
  G571,1st bZIP domain
PKTLRRLAQNREAARKSRLRKKAYVQQLESCRIKLTQLEQEIQRARSQGVFFGGSLIGGDQ

SEQ ID NO: 2647 - protein, 12 aa, Arabidopsis thaliana
  G571,2nd bZIP domain
YFHRLQALSSLW

SEQ ID NO: 2648 - protein, 61 aa, Arabidopsis thaliana
  G578,bZIP domain
KLDQKTLRRLAQNREAARKSRLRKKAYVQQLEDSRLKLTQVEQELQRARQQGVFISSSGDQ

SEQ ID NO: 2649 - protein, 57 aa, Arabidopsis thaliana
  G580,bZIP domain
RGDRRYKRMIKNRESAARSRARKQAYTNELELEIAHLQTENARLKIQQEQLKIAEAT

SEQ ID NO: 2650 - protein, 58 aa, Arabidopsis thaliana
  G581,HLH/MYC domain
MFPSQNSGLNQDDPSDRRKENEKFSVLRTMVPTVNEVDKESILNNTIKYLQELEARVE

SEQ ID NO: 2651 - protein, 58 aa, Arabidopsis thaliana
  G583,HLH/MYC domain
NGREEPLNHVEAERQRREKLNQRFYALRAVVPNVSKMDKASLLGDAIAYINELKSKVV

SEQ ID NO: 2652 - protein, 58 aa, Arabidopsis thaliana
  G584,HLH/MYC domain
NGREEPLNHVEAERQRREKLNQRFYSLRAVVPNVSKMDKASLLGDAISYISELKSKLQ

SEQ ID NO: 2653 - protein, 58 aa, Arabidopsis thaliana
  G585,HLH/MYC domain
EARDETGNHAVLEKKRREKLNERFMTLRKIIPSINKIDKVSILDDTIEYLQELERRVQ

SEQ ID NO: 2654 - protein, 58 aa, Arabidopsis thaliana
  G590,HLH/MYC domain
KRCRAAEVHNLSEKRRRSRINEKMKALQSLIPNSNKTDKASMLDEAIEYLKQLQLQVQ

SEQ ID NO: 2655 - protein, 58 aa, Arabidopsis thaliana
  G591,HLH/MYC domain
RRGQATDPHSIAERLRRERIAERIRALQELVPTVNKTDRAAMIDEIVDYVKFLRLQVK

SEQ ID NO: 2656 - protein, 59 aa, Arabidopsis thaliana
  G592,HLH/MYC domain
KRGCATHPRSIAERVRRTRISERMRKLQELVPNMDKQTNTSDMLDLAVDYIKDLQRQYK

SEQ ID NO: 2657 - protein, 59 aa, Arabidopsis thaliana
  G594,HLH/MYC domain
RRGEATDRHSLAERARREKISKKMKCLQDIVPGCNKVTGKAGMLDEIINYVQSLQQQVE

SEQ ID NO: 2658 - protein, 9 aa, Arabidopsis thaliana
  G597,1st AT-hook domain, domain in aa coordinates: 97-105
KKRRGRPRK

SEQ ID NO: 2659 - protein, 8 aa, Arabidopsis thaliana
  G597,2nd AT-hook domain
EKKRGRPP

SEQ ID NO: 2660 - protein, 59 aa, Arabidopsis thaliana
  G598,DBP domain
KKIEYNVGSFNNRLNEEARGEKSKSDGENAKQCGESAEESGGEKSDGRGKERDRGCKSS

SEQ ID NO: 2661 - protein, 176 aa, Arabidopsis thaliana
  G600,DBP domain
DLAGPDYMMPMGPGPGNQYFNGFQPGFNGVQHGFNGVQPGFNGFHHGFNGFPGPFPGAMPPFVGYGFGGVIHPDPFAAQGFGFPNIPPPYRDLAEMGNRMNLQHPIMGREEFEAKKTEMKRKRENEIRRSEGGNVVRDSEKSRIMNNSAVTSSPVKPKSRQGPPPPISSDYDRRRR

SEQ ID NO: 2662 - protein, 53 aa, Arabidopsis thaliana
  G602,DBP domain
WENSKKAAVEAQLRKIEEKLEKKKAQYGEKMKNKVAAIHKLAEEKRAMVEAKK

SEQ ID NO: 2663 - protein, 9 aa, Arabidopsis thaliana
  G605,AT-hook domain
KKRRGRPRK

SEQ ID NO: 2664 - protein, 220 aa, Arabidopsis thaliana
  G611,PCOMB domain
CNCKIACGKECPCLLNGTCCEKYCGCPKSCKNRFRGCHCAKSQCRSRQCPCFAADRECDPDVCRNCWVIGGDGSLGVPSQRGDNYECRNMKLLLKQQQRVLLGISDVSGWGAFLKNSVSKHEYLGEYTGELISHKEADKRGKIYDRENCSFLFNLNDQFVLDAYRKGDKLKFANHSPEPNCYAKVIMVAGDHRVGIFAKERILAGEELFYDYRYEPDRAP

SEQ ID NO: 2665 - protein, 60 aa, Arabidopsis thaliana
  G615,TEO domain
KDRHSKIQTAQGIRDRRVRLFIGIARQFFDLQDMLGFDKASKTLDWLLKKSRKAIKEVVQ

SEQ ID NO: 2666 - protein, 57 aa, Arabidopsis thaliana
  G616,TEO domain
DRHSKVLTSKGPRDRRVRLSVSTALQFYDLQDRLGYDQPSKAVEWLIKAAEDSISEL

SEQ ID NO: 2667 - protein, 58 aa, Arabidopsis thaliana
  G618,TEO domain
KDRHSKVCTAKGPRDRRVRLSAPTAIQFYDVQDRLGFDRPSKAVDWLITKAKSAIDDL

SEQ ID NO: 2668 - protein, 90 aa, Arabidopsis thaliana
  G620,CAAT domain
REQDQYMPIANVIRIMRKTLPSHAKISDDAKETIQECVSEYISFVTGEANERCQREQRKTITAEDILWAMSKLGFDNYVDPLTVFINRYR

SEQ ID NO: 2669 - protein, 82 aa, Arabidopsis thaliana
  G622,ABI3/VP-1 domain
LFEKTLSASDAGRIGRLVLPKACAEAYFPPISQSEGIPLKIQDVRGREWTFQFRYWPNNNSRMYVLEGVTPCIQSMMLQAGD

SEQ ID NO: 2670 - protein, 80 aa, Arabidopsis thaliana
  G624,ABI3/VP-1 domain
LFEKILSATDTGKRLVLPKKYAEAFLPQLSHTKGVPLTVQDPMGKEWRFQFRFWPSSKGRIYVLEGVTPFIQTLQLQAGD

SEQ ID NO: 2671 - protein, 57 aa, Arabidopsis thaliana
  G627,MADS domain
MVRGKTEMKRIENATSRQVTFSKRRNGLLKKAFELSVLCDAEVALVIFSPRSKLYEF

SEQ ID NO: 2672 - protein, 61 aa, Arabidopsis thaliana
  G629,bZIP domain
DKMKRRLAQNREAARKSRLRKKAYVQQLEESRLKLSQLEQELEKVKQQGHLGPSGSINTGI

SEQ ID NO: 2673 - protein, 73 aa, Arabidopsis thaliana
  G630,bZIP domain
RKQRRMVSNRESARRSRMRKQRHLDELLSQVAWLRSENHQLLDKLNQVSDNNDLVIQENSSLKEENLELRQVI

SEQ ID NO: 2674 - protein, 86 aa, Arabidopsis thaliana
  G634,1st TH domain
RWPREETLALLRIRSDMDSTFRDATLKAPLWEHVSRKLLELGYKRSSKKCKEKFENVQKYYKRTKETRGGRHDGKAYKFFSQLEAL

SEQ ID NO: 2675 - protein, 57 aa, Arabidopsis thaliana
  G634,2nd TH domain
RWPKAEILALINLRSGMEPRYQDNVPKGLLWEEISTSMKRMGYNRNAKRCKEKWENI

SEQ ID NO: 2676 - protein, 85 aa, Arabidopsis thaliana
  G635,TH domain
KWKPEEIKKVIRMRGELHSRFQVVKGRMALWEEISSNLSAEGINRSPGQCKSLWASLIQKYEESKADERSKTSWPHFEDMNNILS

SEQ ID NO: 2677 - protein, 91 aa, Arabidopsis thaliana
  G636,1st TH domain
GFGGNRWPRQETLALLKIRSDMGIAFRDASVKGPLWEEVSRKMAEHGYIRNAKKCKEKFENVYKYHKRTKEGRTGKSEGKTYRFFDQLEAL

SEQ ID NO: 2678 - protein, 94 aa, Arabidopsis thaliana
  G636,2nd TH domain
SSRWPKVEIEALIKLRTNLDSKYQENGPKGPLWEEISAGMRRLGFNRNSKRCKEKWENINKYFKKVKESNKKRPEDSKTCPYFHQLDALYRERN

SEQ ID NO: 2679 - protein, 88 aa, Arabidopsis thaliana
  G638,TH domain
RWPRQETLTLLEIRSRLDHKFKEANHKGPLWDEVSRIMSEEHGYQRSGKKCREKFENLYKYYSKTKEGEAGRQDGKHHRFFRQLQALY

SEQ ID NO: 2680 - protein, 39 aa, Arabidopsis thaliana
  G643,TH domain
KWTMITENCNALDVSRNLNQCRRKWDSLMSDYNQIKKWE

SEQ ID NO: 2681 - protein, 43 aa, Arabidopsis thaliana
  G646,Z-Dof domain
CPRCNSTNTKFCYYNNYSLTQPRYFCKGCRRYWTEGGSLRNIP

SEQ ID NO: 2682 - protein, 27 aa, Arabidopsis thaliana
  G651,1st Z-C2H2 domain
HKCKLCWKSFANGRALGGHMRSHMLIH

SEQ ID NO: 2683 - protein, 21 aa, Arabidopsis thaliana
  G651,2nd Z-C2H2 domain
CETCEKVFKSYQALGGHRASH

SEQ ID NO: 2684 - protein, 24 aa, Arabidopsis thaliana
  G651,3rd Z-C2H2 domain
HHECPICAKVFTSGQALGGHKRSH

SEQ ID NO: 2685 - protein, 22 aa, Arabidopsis thaliana
  G652,1st Z-CLDSH domain
FGFITPSDGGDDLFVHQSSIRS

SEQ ID NO: 2686 - protein, 15 aa, Arabidopsis thaliana
  G652,2nd Z-CLDSH domain
SCFKCGEPGHMAREC

SEQ ID NO: 2687 - protein, 15 aa, Arabidopsis thaliana
  G652,3rd Z-CLDSH domain
CYSCGESGHFARDCT

SEQ ID NO: 2688 - protein, 52 aa, Arabidopsis thaliana
  G653,1st Z-LIM domain
CRACEKTVYPVELLSADGISYHKACFKCSHCKSRLQLSNYSSMEGVVYCRPH

SEQ ID NO: 2689 - protein, 52 aa, Arabidopsis thaliana
  G653,2nd Z-LIM domain
CATCTKTVYPIEKVTVESQCYHKSCFKCSHGGCPISPSNYAALEGILYCKHH

SEQ ID NO: 2690 - protein, 153 aa, Arabidopsis thaliana
  G657,MYB-(R1)R2R3 domain
KGQWTPEEDEVLCKAVERFQGKNWKKIAECFKDRTDVQCLHRWQKVLNPELVKGPWSKEEDNTIIDLVEKYGPKKWSTISQHLPGRIGKQCRERWHNHLNPGINKNAWTQEEELTLIRAHQIYGNKWAELMKFLPGRSDNSIKNHWNSSVKKK

SEQ ID NO: 2691 - protein, 103 aa, Arabidopsis thaliana
  G663,MYB-(R1)R2R3 domain
RKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHLSKK

SEQ ID NO: 2692 - protein, 103 aa, Arabidopsis thaliana
  G664,MYB-(R1)R2R3 domain
KGAWTKEEDERLVAYIKAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 2693 - protein, 103 aa, Arabidopsis thaliana
  G666,MYB-(R1)R2R3 domain
KGPWTPEEDIILVTYIQEHGPGNWRAVPTNTGLLRCSKSCRLRWTNYLRPGIKRGNFTEHEEKMIVHLQALLGNRWAAIASYLPQRTDNDIKNYWNTHLKKKL

SEQ ID NO: 2694 - protein, 102 aa, Arabidopsis thaliana
  G668,MYB-(R1)R2R3 domain
KGPWTPEEDIILVSYIQEHGPGNWRSVPTHTGLRCSKSCRLRWTNYLRPGIKRGNFTEHEEKTIVHLQALLGNRWAAIASYLPERTDNDIKNYWNTHLKKKL

SEQ ID NO: 2695 - protein, 104 aa, Arabidopsis thaliana
  G669,MYB-(R1)R2R3 domain
NRGAWTDHEDKILRDYITTHGEGKWSTLPNQAGLKRCGKSCRLRWKNYLRPGIKRGNISSDEEELIIRLHNLLGNRWSLIAGRLPGRTDNEIKNHWNSNLRKRL

SEQ ID NO: 2696 - protein, 109 aa, Arabidopsis thaliana
  G670,MYB-(R1)R2R3 domain
KGLWSPEEDEKLLTHITNHGHGCWSSVPKLAGLQRCGKSCRLEQIWYRRLRWINYLRPDLKRGAFSPEEENLIVELHAVLGNRWSQIASRLPGRTDNEIKNLWNSSIKK

SEQ ID NO: 2697 - protein, 101 aa, Arabidopsis thaliana
  G671,MYB-(R1)R2R3 domain
KGAWTPEEDQKLLSYLNRHGEGGWRTLPEKAGLKRCGKSCRLRWANYLRPDIKRGEFTEDEERSIISLHALHGNKWSAIARGLPGRTDNEIKNYWNTHIKK

SEQ ID NO: 2698 - protein, 101 aa, Arabidopsis thaliana
  G674,MYB-(R1)R2R3 domain
KGLWSPEEDEKLRSHVLKYGHGCWSTIPLQAGLQRNGKSCRLRWVNYLRPGLKKSLFTKQEETILLSLHSMLGNKWSQISKFLPGRTDNEIKNYWHSNLKK

SEQ ID NO: 2699 - protein, 104 aa, Arabidopsis thaliana
  G675,MYB-(R1)R2R3 domain
KKGPWTPEEDQKLIDYIHKHGHGSWRALPKLADLNRCGKSCRLRWTNYLRPDIKRGKFSAEEEQTILHLHSILGNKWSAIATHLQGRTDNEIKNFWNTHLKKKL

SEQ ID NO: 2700 - protein, 103 aa, Arabidopsis thaliana
  G676,MYB-(R1)R2R3 domain
KKGLWTVEEDKILMDYVKAHGKGHWNRIAKKTGLKRCGKSCRLRWMNYLSPNVKRGNFTEQEEDLIIRLHKLLGNRWSLIAKRVPGRTDNQVKNYWNTHLSKK

SEQ ID NO: 2701 - protein, 47 aa, Arabidopsis thaliana
  G680,MYB-related domain
ERWTEDEHERFLEALRLYGRAWQRIEEHIGTKTAVQIRSHAQKFFTK

SEQ ID NO: 2702 - protein, 107 aa, Arabidopsis thaliana
  G681,MYB-(R1)R2R3 domain
KGEWTAEEDQKLGAYINEHGVCDWRSLPKRAGLQRCGKSCRLRWLNYLKPGIRRGKFTPQEEEEIIQLHAVLGNRWAAMAKKMQNRTDNDIKNHWNSCLKKRLSRKG

SEQ ID NO: 2703 - protein, 45 aa, Arabidopsis thaliana
  G682,MYB-related domain
VNMSQEEEDLVSRMHKLVGDRWELIAGRIPGRTAGEIERFWVMKN

SEQ ID NO: 2704 - protein, 61 aa, Arabidopsis thaliana
  G707,HB domain
KKKKRYHRHTPKQIQDLESVFKECAHPDEKQRLDLSRRLNLDPRQVKFWFQNRRTQMKTQI

SEQ ID NO: 2705 - protein, 93 aa, Arabidopsis thaliana
  G714,CAAT domain
KEIEKTTDFKNHSLPLARIKKIMKADEDVRMISAEAPVVFARACEMFILELTLRSWNHTEENKRRTLQKNDIAAAVTRTDIFDFLVDIVPRED

SEQ ID NO: 2706 - protein, 97 aa, Arabidopsis thaliana
  G715,CAAT domain
QEIEQVNDFKNHQLPLARIKKIMKADEDVRMISAEAPILFAKACELFILELTIRSWLHAEENKRRTLQKNDIAAAITRTDIFDFLVDIVPRDEIKDE

SEQ ID NO: 2707 - protein, 74 aa, Arabidopsis thaliana
  G718,SBP domain
CQVEGCNLDLSSAKDYHRKHRICENHSKFPKVVVSGVERRFCQQCSRFHCLSEFDEKKRSCRRPLSDHNARRRK

SEQ ID NO: 2708 - protein, 49 aa, Arabidopsis thaliana
  G720,GARP domain
WTPELHKKFVQAVEQLGVDQAIPSRILELMKVGTLTRHNVASHLQKFRQ

SEQ ID NO: 2709 - protein, 50 aa, Arabidopsis thaliana
  G728,GARP domain
WSQELHRKFVDALHRLGGPQVATPKQIRDLMKVDGLTNDEVKSHLQKYRM

SEQ ID NO: 2710 - protein, 49 aa, Arabidopsis thaliana
  G729,GARP domain
WTSSLHARFVHAVELLGGHERATPKSVLELMDVKDLTLAHVKSHLQMYR

SEQ ID NO: 2711 - protein, 49 aa, Arabidopsis thaliana
  G730,GARP domain
WTTTLHAHFVHAVQLLGGHERATPKSVLELMDVQDLTLAHVKSHLQMYR

SEQ ID NO: 2712 - protein, 61 aa, Arabidopsis thaliana
  G732,bZIP domain
RKRKRMLSNRESARRSRMRKQKHVDDLTAQINQLSNDNRQILNSLTVTSQLYMKIQAENSV

SEQ ID NO: 2713 - protein, 85 aa, Arabidopsis thaliana
  G735,bZIP domain
KRVKRMLSNRESARRSRRRKQAHLSELETQVSQLRVENSKLMKGLTDVTQTFNDASVENRVLKANIETLRAKVKMAEETVKRLTG

SEQ ID NO: 2714 - protein, 58 aa, Arabidopsis thaliana
  G736,Z-Dof domain
PDKIIACPRCKSMETKFCYFNNYNGNQPRHFCKGCHRYWTAGGALRNVPVGAGRRKSK

SEQ ID NO: 2715 - protein, 43 aa, Arabidopsis thaliana
  G738,Z-Dof domain
CPRCNSSNTKFCYYNNYSLAQPRYLCKSCRRYWTEGGSLRNVP

SEQ ID NO: 2716 - protein, 19 aa, Arabidopsis thaliana
  G740,1st Z-CLDSH domain
YGFITPDDGSVELFVHQSS

SEQ ID NO: 2717 - protein, 37 aa, Arabidopsis thaliana
  G740,2nd Z-CLDSH domain
CYSCGGVGHIARDCATKRQPSRGCYQCGGSGHLARDC

SEQ ID NO: 2718 - protein, 42 aa, Arabidopsis thaliana
  G744,RING/C3H2C3 domain
CTICLQDIKTGEITRSLPKCDHTFHLVCVDKWLIRHGSCPIC

SEQ ID NO: 2719 - protein, 29 aa, Arabidopsis thaliana
  G748,Z-Dof domain
CPRCKSMETKFCYYNNYNINQPRHFCKAC

SEQ ID NO: 2720 - protein, 41 aa, Arabidopsis thaliana
  G752,RING/C3H2C3 domain
PSDNKEDAKCSICQEEYTIGDEVGRLHCEHTYHVKCVQEWL

SEQ ID NO: 2721 - protein, 145 aa, Arabidopsis thaliana
  G760,NAC domain
GFRFHPTDEELVRYYLKRKVCNKPFKFDAISVTDIYKSEPWDLPDKSKLKSRDLEWYFFSMLDKKYSNGSKTNRATEKGYWKTTGKDREIRNGSRVVGMKKTLVYHKGRAPRGERTNWVMHEYRLSDEDLKKAGVPQEAYVLCRI

SEQ ID NO: 2722 - protein, 150 aa, Arabidopsis thaliana
  G772,NAC domain
LAPGFRFHPTDEELVSYYLKRKVLGKPVRFDAIGEVDIYKHEPWDLAVFSKLKTRDQEWYFFSALDKKYGNGARMNRATNKGYWKATGKDREIRRDIQLLGMKKTLVFHSGRAPDGLRTNWVMHEYRLVEYETETNGSLLQDAYVLCRVF

SEQ ID NO: 2723 - protein, 143 aa, Arabidopsis thaliana
  G773,NAC domain
GFRFYPTDEELMVEYLCRKAAGHDFSLQLIAEIDLYKFDPWVLPSKALFGEKEWYFFSPRDRKYPNGSRPNRVAGSGYWKATGTDKVISTEGRRVGIKKALVFYIGKAPKGTKTNWIMHEYRLIEPSRRNGSTKLDDWVLCRI

SEQ ID NO: 2724 - protein, 149 aa, Arabidopsis thaliana
  G776,NAC domain
LAPGFRFHPTDEELVSYYLKRKVLGQPVRFDAIGEVDIYKHEPWDLAVFSRLKTRDQEWYFYSALDKKYGNGARMNRATNRGYWKATGKDREIRRDILLLGMKKTLVFHSGRAPDGLRTNWVMHEYRLVEYETEKNGNLVQDAYVLCRV

SEQ ID NO: 2725 - protein, 59 aa, Arabidopsis thaliana
  G777,HLH/MYC domain
KKEAVCSQKAEREKLRRDKLKEQFLELGNALDPNRPKSDKASVLTDTIQMLKDVMNQVD

SEQ ID NO: 2726 - protein, 58 aa, Arabidopsis thaliana
  G778,HLH/MYC domain
KRSRAAAIHNQSERKRRDKINQRMKTLQKLVPNSSKTDKASMLDEVIEYLKQLQAQVS

SEQ ID NO: 2727 - protein, 58 aa, Arabidopsis thaliana
  G779,HLH/MYC domain
NVRISDDPQTVVARRRRERISEKIRILKRIVPGGAKMDTASMLDEAIRYTKFLKRQVR

SEQ ID NO: 2728 - protein, 59 aa, Arabidopsis thaliana
  G782,HLH/MYC domain
DVSARKSQKAGREKLRREKLNEHFVELGNVLDPERPKNDKATILTDTVQLLKELTSEVN

SEQ ID NO: 2729 - protein, 59 aa, Arabidopsis thaliana
  G783,HLH/MYC domain
GKVPKRINKAVRERLKREHLNELFIELADTLELNQQNSGKASILCEATRFLKDVFGQIE

SEQ ID NO: 2730 - protein, 58 aa, Arabidopsis thaliana
  G789,HLH/MYC domain
RRSRAAEVHNLSERRRRDRINERMKALQELIPHCSRTDKASILDEAIDYLKSLQMQLQ

SEQ ID NO: 2731 - protein, 60 aa, Arabidopsis thaliana
  G791,HLH/MYC domain
ESSSATSSKACREKQRRDRLNDKFMELGAILEPGNPPKTDKAAILVDAVRMVTQLRGEAQ

SEQ ID NO: 2732 - protein, 58 aa, Arabidopsis thaliana
  G793,HLH/MYC domain
RRGQATDPHSIAERLRRERIAERIRSLQELVPTVNKTDRAAMIDEIVDYVKFLRLQVK

SEQ ID NO: 2733 - protein, 29 aa, Arabidopsis thaliana
  G798,Z-Dof domain
CPRCDSSNTKFCYYNNYNFSQPRHFCKAC

SEQ ID NO: 2734 - protein, 62 aa, Arabidopsis thaliana
  G801,PCF domain
KDRHSKVDGRGRRIRMPIICAARVFQLTRELGHKSDGQTIEWLLRQAEPSIIAATGTGTTPA

SEQ ID NO: 2735 - protein, 81 aa, Arabidopsis thaliana
  G802,PCF domain
TKDRHTKVDGRGRRIRMPALCAARVFQLTRELGHKSDGETIEWLLQQAEPAIVAATGTGTIPANFSTLSVSLRSSGSTLSA

SEQ ID NO: 2736 - protein, 64 aa, Arabidopsis thaliana
  G805,PCF domain
STKDRHTKVEGRGRRIRMPAMCAARVFQLTRELGHKSDGETIEWLLQQAEPAVIAATGTGTIPA

SEQ ID NO: 2737 - protein, 92 aa, Arabidopsis thaliana
  G807,HS domain
PFLSKTYDMVDDPLTNEVVSWSSGNNSFVVWSAPEFSKVLLPKYFKHNNFSSFVRQLNTYGFRKVDPDRWEFANEGFLRGRKQLLKSIVRRK

SEQ ID NO: 2738 - protein, 92 aa, Arabidopsis thaliana
  G811,HS domain
PFIVKTYQMVNDPSTDWLITWGPAHNSFIVVDPLDFSQRILPAYFKHNNFSSFVRQLNTYGFRKVDPDRWEFANEHFLRGQKHLLNNIARRK

SEQ ID NO: 2739 - protein, 92 aa, Arabidopsis thaliana
  G812,HS domain
PFLTKTFEMVDDPNTDHIVSWNRGGTSFVVWDLHSFSTILLPRHFKHSNFSSFIRQLNTYGFRKIEAERWEFANEEFLLGQRQLLKNIKRRN

SEQ ID NO: 2740 - protein, 92 aa, Arabidopsis thaliana
  G818,HS domain
PFLRKTFEIVDDKVTDPVVSWSPTRKSFIIWDSYEFSENLLPKYFKHKNFSSFIRQLNSYGFKKVDSDRWEFANEGFQGGKKHLLKNIKRRS

SEQ ID NO: 2741 - protein, 517 aa, Arabidopsis thaliana
  G831,AKR domain
EHTPCEDAKRSLKFSRERLEYRQRHCPEREEILKCRIPAPYGYKTPFRWPASRDVAWFANVPHTELTVEKKNQNWVRYENDRFWFPGGGTMFPRGADAYIDDIGRLIDLSDGSIRTAIDTGCGVASFGAYLLSRNITTMSFAPRDTHEAQVQFALERGVPAMIGIMATIRLPYPSRAFDLAHCSRCLIPWGQNDGAYLMEVDRVLRPGGYWILSGPPINWQKRWKGWERTMDDLNAEQTQIEQVARSLCWKKVVQRDDLAIWQKPFNHIDCKKTREVLKNPEFCRHDQDPDMAWYTKMDSCLTPLPEVDDAEDLKTVAGGKVEKWPARLNAIPPRVNKGALEEITPEAFLENTKLWKQRVSYYKKLDYQLGETGRYRNLVDMNAYLGGFAAALADDPVWVMNVVPVEAKLNTLGVIYERGLIGTYQNWCEAMSTYPRTYDFIHADSVFTLYQGQCEPEEILLEMDRILRPGGGVIIRDDVDVLIKVKELTKGLEWEGRIADHEKGPHEREKIYYAVK

SEQ ID NO: 2742 - protein, 505 aa, Arabidopsis thaliana
  G837,AKR domain
DYIPCLDNWQAIRKLHSTKHYEHRERHCPEESPRCLVSLPEGYKRSIKWPKSREKIWYTNIPHTKLAEVKGHQNWVKMSGEYLTFPGGGTQFKNGALHYIDFLQESYPDIAWGNRTRVILDVGCGVASFGGYLFDRDVLALSFAPKDEHEAQVQFALERGIPAMSNVMGTKRLPFPGSVFDLIHCARCRVPWHIEGGKLLLELNRALRPGGFFVWSATPVYRKTEEDVGIWKAMSKLTKAMCWELMTIKKDELNEVGAAIYQKPMSNKCYNERSQNEPPLCKDSDDQNAAWNVPLEACIHKVTEDSSKRGAVWPESWPERVETVPQWLDSQEGVYGKPAQEDFTADHERWKTIVSKSYLNGMGIDWSYVRNVMDMRAVYGGFAAALKDLKLWVMNVVPIDSPDTLPIIYERGLFGIYHDWCESFSTYPRTYDLLHADHLFSSLKKRCNLVGVMAEVDRILRPQGTFIVRDDMETIGEIEKMVKSMKWNVRMTHSKDGEGLLSVQK

SEQ ID NO: 2743 - protein, 126 aa, Arabidopsis thaliana
  G839,1st AKR domain
SDAEIIVDGVPVGVHRCILAARSKFFQDLFKKEKKISKTEKPKYQLREMLPYGAVAHEAFLYFLSYIYTGRLKPFPLEVSTCVDPVCSHDCCRPAIDFVVQLMYASSVLQVPELVSSFQRRLCNFV

SEQ ID NO: 2744 - protein, 64 aa, Arabidopsis thaliana
  G839,2nd AKR domain
DQANGLHYSVVYSDPKVVAEILALDMGDVNYRNSRGYTVLHFAAMRREPSIIISLIDKGANASE

SEQ ID NO: 2745 - protein, 60 aa, Arabidopsis thaliana
  G843,1st MISC domain
LSGLVRFKCAVCMDFDLCVECFSVGVELNRHKNSHPYRVMDNLSFSLVTSDWNADEEILL

SEQ ID NO: 2746 - protein, 81 aa, Arabidopsis thaliana
  G843,2nd MISC domain
TELYGYNLKREEFEIEHDNDAEQLLADMEFKDSDTDAEREQKLQVLRIYSKRLDERKRRKEFVLERNLLYPDQYEMSLSAE

SEQ ID NO: 2747 - protein, 310 aa, Arabidopsis thaliana
  G846,1st SWI/SNF domain
LSVPLMKHQKIALAWMFQKETNSLHCMGGILADDQGLGKTVSTIALILKQMHEAKLKSKNSGNQEAEALDLDADDESENAFEKPESKASNGSGVNGDSGIKKAKGEEASTSTRKFNRKRPAAGTLIVCPASVVRQWARELDEKVTDEAKLSVLIYHGGNRTKDPIELAKYDVVMTTYAIVSNEVPKQPLVDDDENDEKNSEKYGLASGFSINKKRKNVVGTTKKSKKKKGNNNAGDSSDPDSGTLAKVGWFRVVLDEAQTIKNHRTQVARACCGLRAKRRWCLSGTPIQNTIDDLYSYFRFLKYDPYAVY

SEQ ID NO: 2748 - protein, 41 aa, Arabidopsis thaliana
  G846,2nd SWI/SNF domain
CCVCHDPPEDPVVTLCGHIFCYQCVSDYITGDEDTCPAPRC

SEQ ID NO: 2749 - protein, 84 aa, Arabidopsis thaliana
  G846,3rd SWI/SNF domain
DLVELSLIENSIEFRRLDGTMSLIARDRAVKEFSNDPDVKVMIMSLKAGNLGLNMIAACHVILLDLWWNPTTEDQAIDRAHRIG

SEQ ID NO: 2750 - protein, 80 aa, Arabidopsis thaliana
  G849,1st BPF-1 domain
VKLSIKSFRIPELFIEVPETATVGSLKRTVMEAVSVLLSGGIRVGVLMHGKKVRDERKTLSQTGISCDENLDNLGFTLEP

SEQ ID NO: 2751 - protein, 87 aa, Arabidopsis thaliana
  G849,2nd BPF-1 domain
QRRTRRPFSVTEVEALVQAVEELGTGRWRDVKLRAFEDADHRTYVDLKDKWKTLVHTASISPQQRRGEPVPQELLDRVLRAYGYWSQ

SEQ ID NO: 2752 - protein, 66 aa, Arabidopsis thaliana
  G852,1st SCR domain
MQVLFEVCPCFKFGFLAANGAILEAIKGEEEVHIIDFDINQGNQYMTLIRSIAELPGKRPRLRLTG

SEQ ID NO: 2753 - protein, 89 aa, Arabidopsis thaliana
  G852,2nd SCR domain
FQLHHMPDESVTTVNQRDELLHMVKSLNPKLVTVVEQDVNTNTSPFFPRFIEAYEYYSAVFESLDMTLPRESQERMNVERQCLARDIVN

SEQ ID NO: 2754 - protein, 74 aa, Arabidopsis thaliana
  G852,3rd SCR domain
CEGEERIERYEAAGKWRARMMMAGFNPKPMSAKVTNNIQNLIKQQYCNKYKLKEEMGELHFCWEEKSLIVASAW

SEQ ID NO: 2755 - protein, 57 aa, Arabidopsis thaliana
  G859,MADS domain
MGRKKVEIKRIENKSSRQVTFSKRRNGLIEKARQLSILCESSIAVLVVSGSGKLYKS

SEQ ID NO: 2756 - protein, 56 aa, Arabidopsis thaliana
  G860,MADS domain
GRGKIAIKRINNSTSRQVTFSKRRNGLLKKAKELAILCDAEVGVIIFSSTGRLYDF

SEQ ID NO: 2757 - protein, 56 aa, Arabidopsis thaliana
  G861,MADS domain
AREKIQIRKIDNATARQVTFSKRRRGLFKKAEELSVLCDADVALIIFSSTGKLFEF

SEQ ID NO: 2758 - protein, 63 aa, Arabidopsis thaliana
  G864,AP2 domain
EKKFRGVRQRPWGKWAAEIRDPLKRVRLWLGTYNTAEEAAMVYDNAAIQLRGPDALTNFSVTP

SEQ ID NO: 2759 - protein, 68 aa, Arabidopsis thaliana
  G865,AP2 domain
RRHYRGVRQRPWGKWAAEIRDPKKAARVWLGTFETAEEAALAYDRAALKFKGTKAKLNFPERVQGPTT

SEQ ID NO: 2760 - protein, 258 aa, Arabidopsis thaliana
  G866,WRKY domain
NVDCSEITDFTVSKFKKVISLLNRSGHARFRRGPVHSPPSSSVPPPVKVTTPAPTQISAPAPVSFVQANQQSVTLDFTRPSVFGAKTKSSEVVEFAKESFSVSSNSSFMSSAITGDGSVSKGSSIFLAPAPAVPVTSSGKPPLSGLPYRKRCFEHDHSEGFSGKISGSGNGKCHCKKSRKNRMKRTVRVPAVSAKIADIPPDEYSWRKYGQKPIKGSPHPRGYYKCSTFRGCPARKHVERALDDSTMLIVTYEGEHRH

SEQ ID NO: 2761 - protein, 56 aa, Arabidopsis thaliana
  G869,AP2 domain
RKKPVGVRQRKWGKWAAEIRDPIKKTRTWLGTFDTLEEAAKAYDAKKLEFDAIVAG

SEQ ID NO: 2762 - protein, 67 aa, Arabidopsis thaliana
  G872,AP2 domain
QSKYKGVRKRKWGKWVSEIRLPHSRERIWLGSYDTPEKAARAFDAAQFCLRGGDANFNFPNNPPSIS

SEQ ID NO: 2763 - protein, 57 aa, Arabidopsis thaliana
  G877,1st WRKY domain
AEDGYNWRKYGQKLVKGSEYPRSYYKCTNPNCQVKKKVERSREGHITEIIYKGAHNH

SEQ ID NO: 2764 - protein, 117 aa, Arabidopsis thaliana
  G877,2nd WRKY domain
DDGYRWRKYGQKVVKGNPNPRSYYKCTAPGCTVRKHVERASHDLKSVITTYEGKHNHDVPAARNSSHGGGGDSGNGNSGGSAAVSHHYHNGHHSEPPRGRFDRQVTTNNQSPFSRPF

SEQ ID NO: 2765 - protein, 56 aa, Arabidopsis thaliana
  G878,1st WRKY domain
DDGYNWRKYGQKQVKGSDFPRSYYKCTHPACPVKKKVERSLDGQVTEIIYKGQHNH

SEQ ID NO: 2766 - protein, 61 aa, Arabidopsis thaliana
  G878,2nd WRKY domain
DDGYRWRKYGQKVVKGNPYPRSYYKCTTPDCGVRKHVERAATDPKAVVTTYEGKHNHDVPA

SEQ ID NO: 2767 - protein, 58 aa, Arabidopsis thaliana
  G881,WRKY domain
KDGFQWRKYGQKVTRDNPSPRAYFRCSFAPSCPVKKKVQRSAEDPSLLVATYEGTHNH

SEQ ID NO: 2768 - protein, 58 aa, Arabidopsis thaliana
  G883,WRKY domain
PDEYSWRKYGQKPIKGSPHPRGYYKCSTFRGCPARKHVERALDDPAMLIVTYEGEHRH

SEQ ID NO: 2769 - protein, 59 aa, Arabidopsis thaliana
  G884,1st WRKY domain
PADDGYNWRKYGQKQVKGSEFPRSYYKCTNPGCPVKKKVERSLDGQVTEIIYKGQHNHE

SEQ ID NO: 2770 - protein, 59 aa, Arabidopsis thaliana
  G884,2nd WRKY domain
LLDDGYRWRKYGQKVVKGNPYPRSYYKCTTPGCGVRKHVERAATDPKAVVTTYEGKHNH

SEQ ID NO: 2771 - protein, 94 aa, Arabidopsis thaliana
  G892,RING/C3H2C3 domain
GASSLEQLIEQLTQDDRPGPPPASEPTINSLPSVKITPQHLTNDMSQCTVCMEEFIVGGDATELPCKHIYHKDCIVPWLRLNNSCPICRRDLPL

SEQ ID NO: 2772 - protein, 22 aa, Arabidopsis thaliana
  G896,Z-LSDlike domain
CSGCRTPLQLPSGARSIRCALC

SEQ ID NO: 2773 - protein, 38 aa, Arabidopsis thaliana
  G898,RING/C3HC4 domain
CPICMCPFTEEMSTKCGHIFCKGCIKMAISRQGKCPTC

SEQ ID NO: 2774 - protein, 25 aa, Arabidopsis thaliana
  G903,Z-C2H2 domain
CEVCGKGFQRDQNLQLHRRGHNLPW

SEQ ID NO: 2775 - protein, 42 aa, Arabidopsis thaliana
  G904,RING/C3H2C3 domain
CAVCLSKFEPEDQLRLLPLCCHAFHADCIDIWLVSNQTCPLC

SEQ ID NO: 2776 - protein, 42 aa, Arabidopsis thaliana
  G905,RING/C3H2C3 domain
CPVCLNEFEDDETLRLIPQCCHVFHPGCIDAWLRSQTTCPLC

SEQ ID NO: 2777 - protein, 24 aa, Arabidopsis thaliana
  G910,1st Z-CO-like domain
CEFCKAYRAVVYCIADTANLCLTC

SEQ ID NO: 2778 - protein, 27 aa, Arabidopsis thaliana
  G910,2nd Z-CO-like domain
CHGCNDKFHGGGSSEHRRRDLRCYTGC

SEQ ID NO: 2779 - protein, 44 aa, Arabidopsis thaliana
  G911,RING/C3H2C3 domain
CTVCLSDFESDDKVRQLPKCGHVFHHHCLDRWIVDYNKMKCPVC

SEQ ID NO: 2780 - protein, 68 aa, Arabidopsis thaliana
  G912,AP2 domain
HPIYRGVRQRNSGKWVCEVREPNKKSRIWLGTFPTVEMAARAHDVAALALRGRSACLNFADSAWRLRI

SEQ ID NO: 2781 - protein, 67 aa, Arabidopsis thaliana
  G913,AP2 domain
HSIFRGIRLRNGKWVSEIREPRKTTRIWLGTYPVPEMAAAAYDVAALALKGPDAVLNFPGLALTYVA

SEQ ID NO: 2782 - protein, 57 aa, Arabidopsis thaliana
  G916,WRKY domain
DGCQWRKYGQKMAKGNPCPRAYYRCTMAVGCPVRKQVQRCAEDRTILITTYEGNHNH

SEQ ID NO: 2783 - protein, 56 aa, Arabidopsis thaliana
  G917,MADS domain
RKGKRVIKKIEEKIKRQVTFAKRKKSLIKKAYELSVLCDVHLGLIIFSHSNRLYDF

SEQ ID NO: 2784 - protein, 58 aa, Arabidopsis thaliana
  G921,WRKY domain
KDGYQWRKYGQKVTRDNPSPRAYFKCACAPSCSVKKKVQRSVEDQSVLVATYEGEHNH

SEQ ID NO: 2785 - protein, 66 aa, Arabidopsis thaliana
  G922,1st SCR domain
RRLFFEMFPILKVSYLLTNRAILEAMEGEKMVHVIDLDASEPAQWLALLQAFNSRPEGPPHLRITG

SEQ ID NO: 2786 - protein, 70 aa, Arabidopsis thaliana
  G922,2nd SCR domain
FLNAIWGLSPKVMVVTEQDSDHNGSTLMERLLESLYTYAALFDCLETKVPRTSQDRIKVEKMLFGEEIKN

SEQ ID NO: 2787 - protein, 74 aa, Arabidopsis thaliana
  G922,3rd SCR domain
CEGFERRERHEKLEKWSQRIDLAGFGNVPLSYYAMLQARRLLQGCGFDGYRIKEESGCAVICWQDRPLYSVSAW

SEQ ID NO: 2788 - protein, 58 aa, Arabidopsis thaliana
  G926,CAAT domain
EPVYVNAKQYEGILRRRKARAKAELERKVIRDRKPYLHESRHKHAMRRARASGGRFAK

SEQ ID NO: 2789 - protein, 64 aa, Arabidopsis thaliana
  G927,CAAT domain
STIYVNSKQYHGIIRRRQSRAKAAAVLDQKKLSSRCRKPYMHHSRHLHALRRPRGSGGRFLNTK

SEQ ID NO: 2790 - protein, 60 aa, Arabidopsis thaliana
  G928,CAAT domain
DPVFVNAKQYHAIMRRRQQRAKLEAQNKLIRARKPYLHESRHVHALKRPRGSGGRFLNTK

SEQ ID NO: 2791 - protein, 60 aa, Arabidopsis thaliana
  G929,CAAT domain
EPVFVNAKQYHGILRRRQSRAKLEARNRAIKAKKPYMHESRHLHAIRRPRGCGGRFLNAK

SEQ ID NO: 2792 - protein, 60 aa, Arabidopsis thaliana
  G931,CAAT domain
EPVFVNAKQFHAIMRRRQQRAKLEAQNKLIKARKPYLHESRHVHALKRPRGSGGRFLNTK

SEQ ID NO: 2793 - protein, 105 aa, Arabidopsis thaliana
  G932,MYB-(R1)R2R3 domain
KGPWTPEEDIILVSYIQEHGPGNWRSVPTHTGLRRCSKSCRLRWTNYLRPGIKRGNFTEHEEKMILHLQALLGNRWAAIASYLPERTDNDIKNYWNTHLKKKLKK

SEQ ID NO: 2794 - protein, 50 aa, Arabidopsis thaliana
  G937,GARP domain
WNPELHRRFVDALQQLGGPGVATPKQIREHMQEEGLTNDEVKSHLQKYRL

SEQ ID NO: 2795 - protein, 9 aa, Arabidopsis thaliana
  G938,EIL domain
AQDGILKYM

SEQ ID NO: 2796 - protein, 10 aa, Arabidopsis thaliana
  G939,EIL domain
AQDGILKYMS

SEQ ID NO: 2797 - protein, 171 aa, Arabidopsis thaliana
  G957,NAC domain
GQSKVPPGFRFHPTEEELLHYYLRKKVNSQKIDLDVIREVDLNKLEPWDIQEECRIGSTPQNDWYFFSHKDKKYPTGTRTNRATVAGFWKATGRDKIICSCVRRIGLRKTLVFYKGRAPHGQKSDWIMHEYRLDDTPMSNGYADVVTEDPMSYNEEGWVVCRVFRKKNYQK

SEQ ID NO: 2798 - protein, 150 aa, Arabidopsis thaliana
  G958,NAC domain
PPGFRFHPTDEELVIYYLKRKINGRTIELEIIPEIDLYKCEPWDLPGKSLLPSKDLEWFFFSPRDRKYPNGSRTNRATKAGYWKATGKDRKVTSHSRMVGTKKTLVYYRGRAPHGSRTDWVMHEYRLEEQECDSKSGIQDAYALCRVFKK

SEQ ID NO: 2799 - protein, 169 aa, Arabidopsis thaliana
  G961,NAC domain
QSQVPPGFRFHPTEEELLQYYLRKKVNSIEIDLDVIRDVDLNKLEPWDIQEMCKIGTTPQNDWYFFSHKDKKYPTGTRTNRATAAGFWKATGRDKIIYSNGRRIGMRKTLVFYKGRAPHGQKSDWIMHEYRLDDNIISPEDVTVHEVVSIIGEASQDEGWVVCRIFKKK

SEQ ID NO: 2800 - protein, 123 aa, Arabidopsis thaliana
  G962,NAC domain
PGFRFHPTEEELIEFYLRRKVEGKRFNVELITFLDLYRYDPWELPAMAAIGEKEWYFYVPRDRKYRNGDRPNRVTTSGYWKATGADRMIRSETSRPIGLKKTLVFYSGKAPKGTRTSWIMNEY

SEQ ID NO: 2801 - protein, 61 aa, Arabidopsis thaliana
  G964,HB domain
ETSRKKLRLSKDQSAFLEETFKEHNTLNPKQKLALAKKLNLTARQVEVWFQNRRARTKLKQ

SEQ ID NO: 2802 - protein, 64 aa, Arabidopsis thaliana
  G965,HB domain
EAWRPQRGLPERSVNILRAWLFEHFLNPYPSDADKHLLARQTGLSRNQVSNWFINARVRLWKPM

SEQ ID NO: 2803 - protein, 67 aa, Arabidopsis thaliana
  G971,AP2 domain
SSQYRGVTFYRRTGRWESHIWDCGKQVYLGGFDTAYAAARAYDRAAIKFRGLDADINFVVDDYRHDI

SEQ ID NO: 2804 - protein, 68 aa, Arabidopsis thaliana
  G974,AP2 domain
TKLYRGVRQRHWGKWVAEIRLPRNRTRLWLGTFDTAEEAALAYDKAAYKLRGDFARLNFPDLRHNDEY

SEQ ID NO: 2805 - protein, 68 aa, Arabidopsis thaliana
  G975,AP2 domain
TKKFRGVRQRHWGSWVAEIRHPLLKRRIWLGTFETAEEAARAYDEAAVLMSGRNAKTNFPLNNNNTGE

SEQ ID NO: 2806 - protein, 67 aa, Arabidopsis thaliana
  G976,AP2 domain
NPVYRGIRCRSGKWVSEIREPKKTTRVWLGTYPTPEMAAAAYDVAALALKGGDTLLNFPDSLGSYPI

SEQ ID NO: 2807 - protein, 68 aa, Arabidopsis thaliana
  G977,AP2 domain
QQRFRGVRQRHWGSWVSEIRHPLLKTRIWLGTFETAEDAARAYDEAARLMCGPRARTNFPYNPNAIPT

SEQ ID NO: 2808 - protein, 77 aa, Arabidopsis thaliana
  G979,1st AP2 domain
SSIYRGVTRHRWTGRFEAHLWDKSSWNSIQNKKGKQVYLGAYDSEEAAAHTYDLAALKYWGPDTILNFPAETYTKEL

SEQ ID NO: 2809 - protein, 69 aa, Arabidopsis thaliana
  G979,2nd AP2 domain
VSKYRGVARHHHNGRWEARIGRVFGNKYLYLGTYNTQEEAAAAYDMAAIEYRGANAVTNFDISNYIDRL

SEQ ID NO: 2810 - protein, 68 aa, Arabidopsis thaliana
  G987,1st SCR domain
YQTYISVCPFKKIAIIFANHSIMRLASSANAKTIHIIDFGISDGFQWPSLIHRLAWRRGSSCKLRITG

SEQ ID NO: 2811 - protein, 89 aa, Arabidopsis thaliana
  G987,2nd SCR domain
FRFRNLLDETVAVHSPRDTVLKLIRKIKPDVFIPGILSGSYNAPFFVTRFREVLFHYSSLFDMCDTNLTREDPMRVMFEKEFYGREIMN

SEQ ID NO: 2812 - protein, 76 aa, Arabidopsis thaliana
  G987,3rd SCR domain
KDTAADTIRAYRVYLSSSPFVTLMYFFSIWMILDVAKDAPVLHIVDFGILYGFQWPMFIQSISDRKDVPRKLRITG

SEQ ID NO: 2813 - protein, 94 aa, Arabidopsis thaliana
  G987,4th SCR domain
VNAGLRLKNLQDETGSEENCPRDAVLKLIRNMNPDVFIHAIVNGSFNAPFFISRFKEAVYHYSALFDMFDSTLPRDNKERIRFEREFYGREAMN

SEQ ID NO: 2814 - protein, 68 aa, Arabidopsis thaliana
  G988,1st SCR domain
NQLTPFIRFGHLTANQAILDATETNDNGALHILDLDISQGLQWPPLMQALAERSSNPSSPPPSLRITG

SEQ ID NO: 2815 - protein, 90 aa, Arabidopsis thaliana
  G988,2nd SCR domain
VNCVHFLHKIFNDDGDMIGHFLSAIKSLNSRIVTMAEREANHGDHSFLNRFSEAVDHYMAIFDSLEATLPPNSRERLTLEQRWFGKEILD

SEQ ID NO: 2816 - protein, 74 aa, Arabidopsis thaliana
  G988,3rd SCR domain
EETERKQRHRRFEIWEEMMKRFGFVNVPIGSFALSQAKLLLRLHYPSEGYNLQFLNNSLFLGWQNRPLFSVSSW

SEQ ID NO: 2817 - protein, 66 aa, Arabidopsis thaliana
  G989,1st SCR domain
LQTYNSVSPLIKFSHFTANQAIFQALDGEDSVHIIDLDVMQGLQWPALFHILASRPRKLRSIRITG

SEQ ID NO: 2818 - protein, 89 aa, Arabidopsis thaliana
  G989,2nd SCR domain
VVVHWMQHRLYDVTGNNLETLEILRRLKPNLITVVEQELSYDDGGSFLGRFVEALHYYSALFDALGDGLGEESGERFTVEQIVLGTEIR

SEQ ID NO: 2819 - protein, 73 aa, Arabidopsis thaliana
  G989,3rd SCR domain
NIVAHGGGRRKRMKWKEELSRVGFRPVSLRGNPATQAGLLLGMLPWNGYTLVEENGTLRLGWKDLSLLTASAW

SEQ ID NO: 2820 - protein, 8 aa, Arabidopsis thaliana
  G991,1st IAA domain
LELRLAPP

SEQ ID NO: 2821 - protein, 12 aa, Arabidopsis thaliana
  G991,2nd IAA domain
PVVGWPPVRSSR

SEQ ID NO: 2822 - protein, 34 aa, Arabidopsis thaliana
  G991,3rd IAA domain
YVKINMEGVPIGRKVNLSAYNNYQQLSHAVDQLF

SEQ ID NO: 2823 - protein, 37 aa, Arabidopsis thaliana
  G991,4th IAA domain
TLVYEDTEGDKVLVGDVPWEMFVSTVKRLHVLKTSHA

SEQ ID NO: 2824 - protein, 66 aa, Arabidopsis thaliana
  G993 AP2 domain
SSKYKGVVPQPNGRWGAQIYEKHQRVWLGTFNEEEEAASSYDIAVRRFRGRDAVTNFKSQVDGNDA

SEQ ID NO: 2825 - protein, 100 aa, Arabidopsis thaliana
  G993 B3 domain
REVLFEKTVTPSDVGKLNRLVIPKQHAEKHFPLPAMTTAMGMNPSPTKGVLINLEDRTGKVWRFRYSYWNSSQSYVLTKGWSRFVKEKNLRAGDVVCFER

SEQ ID NO: 2826 - protein, 110 aa, Arabidopsis thaliana
  G994,MYB-(R1)R2R3 domain
RKGPWTVEEDGKLVDFLRARGNCGGGGGGWCWRDVPKLAGLRRCGKSCRLRWTNYLRPDLKRGLFTEEEIQLVIDLHARLGNRWSKIAVELPGRTDNDIKNYWNTHIKRK

SEQ ID NO: 2827 - protein, 101 aa, Arabidopsis thaliana
  G996,MYB-(R1)R2R3 domain
KGLWSPEEDEKLLRYITKYGHGCWSSVPKQAGLQRCGKSCRLRWINYLRPDLKRGAFSQDEENLIIELHAVLGNRWSQIAAQLPGRTDNEIKNLWNSCLKK

SEQ ID NO: 2828 - protein, 65 aa, Arabidopsis thaliana
  G1006,AP2 domain
KAKHYRGVRQRPWGKFAAEIRDPAKNGARVWLGTFETAEDAALAYDIAAFRMRGSRALLNFPLRV

SEQ ID NO: 2829 - protein, 68 aa, Arabidopsis thaliana
  G1007,AP2 domain
KGVYRGARMRSWGKWVSEIREPRKKSRIWLGTFPTAEMAARAHDVAALSIKGSSAILNFPELADFLPR

SEQ ID NO: 2830 - protein, 56 aa, Arabidopsis thaliana
  G1011,MADS domain
VRGKIEMKKIENATSRQVTFSKRRNGLLKKAYELSVLCDAQLSLIIFSQRGRLYEF

SEQ ID NO: 2831 - protein, 57 aa, Arabidopsis thaliana
  G1012,WRKY domain
DDGYRWRKYGQKSVKNSLYPRSYYRCTQHMCNVKKQVQRLSKETSIVETTYEGIHNH

SEQ ID NO: 2832 - protein, 57 aa, Arabidopsis thaliana
  G1013,WRKY domain
DDGYKWRKYGQKSIKNSPNPRSYYKCTNPICNAKKQVERSIDESNTYIITYEGFHFH

SEQ ID NO: 2833 - protein, 374 aa, Arabidopsis thaliana
  G1017,ARF domain
PQLWHACAGSMVQIPSLNSTVFYFAQGHTEHAHAPPDFHAPRVPPLILCRVVSVKFLADAETDEVFAKITLLPLPGNDLDLENDAVLGLTPPSSDGNGNGKEKPASFAKTLTQSDANNGGGFSVPRYCAETIFPRLDYSAEPPVQTVIAKDIHGETWKFRHIYRGTPRRHLLTTGWSTFVNQKKLIAGDSIVFLRSESGDLCVGIRRAKRGGLGSNAGSDNPYPGFSGFLRDDESTTTTSKLMMMKRNGNNDGNAAATGRVRVEAVAEAVARAACGQAFEVVYYPRASTPEFCVKAADVRSAMRIRWCSGMRFKMAFETEDSSRISWFMGTVSAVQVADPIRWPNSPWRLLQVAWDEPDLLQNVKRVSPWLVEL

SEQ ID NO: 2834 - protein, 68 aa, Arabidopsis thaliana
  G1020,AP2 domain
EIRYRGVRKRPWGRYAAEIRDPVKKTRVWLGTFDTAQQAARAYDAAARDFRGVKAKTNFGVIVGSSPT

SEQ ID NO: 2835 - protein, 69 aa, Arabidopsis thaliana
  G1023,AP2 domain
VSKPVGVRQRKWGKWAAEIRHPITKVRTWLGTYETLEQAADAYATKKLEFDALAAATSAASSVLSNESG

SEQ ID NO: 2836 - protein, 73 aa, Arabidopsis thaliana
  G1033,HMG domain
DPNKPKRAPSAFFVFLEDFRVTFKKENPNVKAVSAVGKAGGQKWKSMSQAEKAPYEEKAAKRKAEYEKQMDAY

SEQ ID NO: 2837 - protein, 124 aa, Arabidopsis thaliana
  G1037,1st GARP domain
DQFPVGMRVLAVDDDQTCLKILESLLRHCQYHVTTTNQAQKALELLRENKNKFDLVISDVDMPDMDGFKLLELVGLEMDLPVIMLSAHSDPKYVMKGVTHGACDYLLKPVRIEELKNIWQHVVR

SEQ ID NO: 2838 - protein, 49 aa, Arabidopsis thaliana
  G1037,2nd GARP domain
WTVELHKKFVAAVNQLGYEKAMPKKILDLMNVEKLTRENVASHLQKFRL

SEQ ID NO: 2839 - protein, 50 aa, Arabidopsis thaliana
  G1038,GARP domain
WSFELHHKFVNAVNQIGCDHKAGPKKILDLMNVPWLTRENVASHLQKYRL

SEQ ID NO: 2840 - protein, 50 aa, Arabidopsis thaliana
  G1040,GARP domain
RWTSTLHAHFVHAVQLLGGHERATPKSVLELMNVKDLTLAHVKSHLQMYR

SEQ ID NO: 2841 - protein, 60 aa, Arabidopsis thaliana
  G1043,WRKY domain
EDAFSWRKYGQKEILNAKFPRSYFRCTHKYTQGCKATKQVQKVELEPKMFSITYIGNHTC

SEQ ID NO: 2842 - protein, 52 aa, Arabidopsis thaliana
  G1047,bZIP domain
RKRKRMESNRESAKRSRMRKQRHIDNLKDEANRLGLENRELANRLRIVLYNI

SEQ ID NO: 2843 - protein, 53 aa, Arabidopsis thaliana
  G1048,bZIP domain
DAVAKKRRRRVRNRDAAVRSRERKKEYVQDLEKKSKYLERECLRLGRMLECFV

SEQ ID NO: 2844 - protein, 56 aa, Arabidopsis thaliana
  G1049,bZIP domain
IINERKQRRMISNRESARRSRMRKQRHLDELWSQVMWLRIENHQLLDKLNNLSESH

SEQ ID NO: 2845 - protein, 54 aa, Arabidopsis thaliana
  G1050,bZIP domain
KRVKRILANRVSAARSKERKTRYMAELEHKVQTLQTEATTLSAQLTHLQRDSMG

SEQ ID NO: 2846 - protein, 62 aa, Arabidopsis thaliana
  G1051,bZIP domain
RVKRILANRQSAQRSRVRKLQYISELERSVTSLQAEVSVLSPRVAFLDHQRLLLNVDNSALK

SEQ ID NO: 2847 - protein, 61 aa, Arabidopsis thaliana
  G1052,bZIP domain
HDPKRVKRILANRQSAQRSRVRKLQYISELERSVTSLQTEVSVLSPRVAFLDHQRLLLNVD

SEQ ID NO: 2848 - protein, 47 aa, Arabidopsis thaliana
  G1053,bZIP domain
RKQRRMLSNRESARRSRMRKQRHLDELWSQVIRLRNENNCLIDKLNR

SEQ ID NO: 2849 - protein, 58 aa, Arabidopsis thaliana
  G1062,HLH/MYC domain
KKKGMPAKNLMAERRRRKKLNDRLYMLRSVVPKISKMDRASILGDAIDYLKELLQRIN

SEQ ID NO: 2850 - protein, 58 aa, Arabidopsis thaliana
  G1063,HLH/MYC domain
NVRISKDPQSVAARHRRERISERIRILQRLVPGGTKMDTASMLDEAIHYVKFLKKQVQ

SEQ ID NO: 2851 - protein, 64 aa, Arabidopsis thaliana
  G1064,PCF domain
STKDRHTKVDGRGRRIRMPALCAARVFQLTRELGHKSDGETIEWLLQQAEPSVIAATGTGTIPA

SEQ ID NO: 2852 - protein, 9 aa, Arabidopsis thaliana
  G1067 AT-hook domain
KRPRGRPPG

SEQ ID NO: 2853 - protein, 154 aa, Arabidopsis thaliana
  G1067,2nd conserved domain
GSKNKAKPPIIVTRDSPNALRSHVLEVSPGADIVESVSTYARRRGRGVSVLGGNGTVSNVTLRQPVTPGNGGGVSGGGGVVTLHGRFEILSLTGTVLPPPAPPGAGGLSIFLAGGQGQVVGGSVVAPLIASAPVILMAASFSNAVFERLPIEEE

SEQ ID NO: 2854 - protein, 8 aa, Arabidopsis thaliana
  G1068,AT-hook domain
KRNRGRPP

SEQ ID NO: 2855 - protein, 9 aa, Arabidopsis thaliana
  G1069,AT-hook domain
RRPRGRPPG

SEQ ID NO: 2856 - protein, 9 aa, Arabidopsis thaliana
  G1075,AT-hook domain
RRPRGRPAG

SEQ ID NO: 2857 - protein, 9 aa, Arabidopsis thaliana
  G1076,AT-hook domain
RRPRGRPPG

SEQ ID NO: 2858 - protein, 53 aa, Arabidopsis thaliana
  G1078,1st BZIPT2 domain
MGCAASKLDNEDAVRRCKDRRRLMKEAVYARHHLAAAHADYCRSLRITGSALS

SEQ ID NO: 2859 - protein, 111 aa, Arabidopsis thaliana
  G1078,2nd BZIPT2 domain
LCSTLDRLLAWEKKLYEEIKAREGFKIEHEKKLSQLQSQEYKGEDEAKLDKTKASITRLQSLIIVTSQAVTTTSTAIIRLRDTDLVPQLVELCHGFMYMWKSMHQYHETQN

SEQ ID NO: 2860 - protein, 50 aa, Arabidopsis thaliana
  G1079,BZIPT2 domain
MGCAASRIDNEEKVLVCRQRKRLMKKLLGFRGEFADAQLAYLRALRNTGV

SEQ ID NO: 2861 - protein, 53 aa, Arabidopsis thaliana
  G1082,1st BZIPT2 domain
MGCTSSKLDDLPAVALCRERCAFLEAAIHQRYALAESHVAYTHSLREIGHSLH

SEQ ID NO: 2862 - protein, 111 aa, Arabidopsis thaliana
  G1082,2nd BZIPT2 domain
NLSSTLHKLHLWEKKLYHEVKAEEKLRLAHEKKLRKLKRLDQRGAEAIKVDKTRKLVRDMSTKIRIAIQVVDKISVTINKIRDEDLWPQLNALIQGLTRMWKTMLECHQSQ

SEQ ID NO: 2863 - protein, 53 aa, Arabidopsis thaliana
  G1084,1st BZIPT2 domain
MGCSHSKLDDEEAVQICKDRKRFIKQAIEHRTKFASGHIAYIHSLRKVSDALH

SEQ ID NO: 2864 - protein, 130 aa, Arabidopsis thaliana
  G1084,2nd BZIPT2 domain
SHQTTLDRLFAWEKKLYDEVRVSNKRYKQLSGERVRRAYEKKCMQLRNQDVKGDDPLAVDKTRATIRDLDTQIKVSIHSIESISKRIETLRDQELLPQLLELVEGLTNGNHDHNRLTRMWKVMAESHQIQ

SEQ ID NO: 2865 - protein, 76 aa, Arabidopsis thaliana
  G1089,BZIPT2 domain
LEENETHATVLDKLLAWEKKLYDEVKAGELMKIEYQKKVAHLNRVKKRGGHSDSLERAKAAVSHLHTRYIVDMQSM

SEQ ID NO: 2866 - protein, 68 aa, Arabidopsis thaliana
  G1090,AP2 domain
QLSYRGIRRRKWGKWVSEIREPGKKTRIWLGSYETAEMAAAAYDAAALHLRGRGTNLNFPELVDSFPR

SEQ ID NO: 2867 - protein, 26 aa, Arabidopsis thaliana
  G1095,RING/C3H2C3 domain
CSVCLNEFQEDEKLRIIPNCCHVFHI

SEQ ID NO: 2868 - protein, 42 aa, Arabidopsis thaliana
  G1100,RING/C3H2C3 domain
CAVCICEFEDHETLRLMPECCHVFHADCVSVWLSDHSTCPLC

SEQ ID NO: 2869 - protein, 41 aa, Arabidopsis thaliana
  G1108,RING/C3H2C3 domain
CCICLAKYANNEELRELPCSHFFHKECVDKWLKINASCPLC

SEQ ID NO: 2870 - protein, 44 aa, Arabidopsis thaliana
  G1113,RING/C3H2C3 domain
CTVCLSDFVSDDKIRQLPKCGHVFHHRCLDRWIVDCNKITCPIC

SEQ ID NO: 2871 - protein, 9 aa, Arabidopsis thaliana
  G1128,AT-hook domain, domain in aa coordinates: 78-86
KKKRGRPRK

SEQ ID NO: 2872 - protein, 59 aa, Arabidopsis thaliana
  G1129,HLH/MYC domain
RRGQATDSHSIAERVRREKISERMKFLQDLVPGCDKITGKAGMLDEIINYVQSLQRQIE

SEQ ID NO: 2873 - protein, 58 aa, Arabidopsis thaliana
  G1133,HLH/MYC domain
SSKQETGSGLSDEQSRKDKIHTALRILESVVPGAKGKEALLLLDEAIDYLKLLKQSLN

SEQ ID NO: 2874 - protein, 59 aa, Arabidopsis thaliana
  G1134,HLH/MYC domain
KRGCATHPRSIAERVRRTRISDRIRKLQELVPNMDKQTNTADMLEEAVEYVKVLQRQIQ

SEQ ID NO: 2875 - protein, 58 aa, Arabidopsis thaliana
  G1136,HLH/MYC domain
NGREEPLNHVEAERQRREKLNQRFYSLRAVVPNVSKMDKASLLGDAISYINELKSKLQ

SEQ ID NO: 2876 - protein, 58 aa, Arabidopsis thaliana
  G1137,HLH/MYC domain
STKEDTGSGLSNEQSKKDKIRTALKILESVVPGAKGNEALLLLDEAIDYLKLLKRDLI

SEQ ID NO: 2877 - protein, 56 aa, Arabidopsis thaliana
  G1140,MADS domain
AREKIRIKKIDNITARQVTFSKRRRGIFKKADELSVLCDADVALIIFSATGKLFEF

SEQ ID NO: 2878 - protein, 58 aa, Arabidopsis thaliana
  G1142,HLH/MYC domain
RALAALRNHKEAERRRRERINSHLNKLRNVLSCNSKTDKATLLAKVVQRVRELKQQTL

SEQ ID NO: 2879 - protein, 58 aa, Arabidopsis thaliana
  G1143,HLH/MYC domain
EDENFKSPNLEAERRRREKLHCRLMALRSHVPIVTNMTKASIVEDAITYIGELQNNVK

SEQ ID NO: 2880 - protein, 44 aa, Arabidopsis thaliana
  G1145,bZIP domain
RRQKRMIKNRESAARSRARKQAYTHELEIKVSRLEEENERLRKQ

SEQ ID NO: 2881 - protein, 11 aa, Arabidopsis thaliana
  G1146,PAZ domain
GTSRPAHYHVL

SEQ ID NO: 2882 - protein, 21 aa, Arabidopsis thaliana
  G1150,PAZ domain
GVKGTSRPTHYHILWDENEFT

SEQ ID NO: 2883 - protein, 92 aa, Arabidopsis thaliana
  G1181,HS domain
PFLTKTFNLVEDSSIDDVISWNEDGSSFIVWNPTDFAKDLLPKHFKHNNFSSFVRQLNTYGFKKVVPDRWEFSNDFFKRGEKRLLREIQRRK

SEQ ID NO: 2884 - protein, 509 aa, Arabidopsis thaliana
  G1190,AKR domain
DYTPCTDPKRWKKYGVHRLSFLERHCPPVYEKNECLIPPPDGYKPPIRWPKSREQCWYRNVPYDWINKQKSNQHWLKKEGDKFHFPGGGTMFPRGVSHYVDLMQDLIPEMKDGTVRTAIDTGCGVASWGGDLLDRGILSLSLAPRDNHEAQVQFALERGIPAILGIISTQRLPFPSNAFDMAHCSRCLIPWTEFGGIYLLEIHRIVRPGGFWVLSGPPVNYNRRWRGWNTTMEDQKSDYNKLQSLLTSMCFKKYAQKDDIAVWQKLSDKSCYDKIAKNMEAYPPKCDDSIEPDSAWYTPLRPCVVAPTPKVKKSGLGSIPKWPERLHVAPERIGDVHGGSANSLKHDDGKWKNRVKHYKKVLPALGTDKIRNVMDMNTVYGGFSAALIEDPIWVMNVVSSYSANSLPVVFDRGLIGTYHDWCEAFSTYPRTYDLLHLDSLFTLESHRCEMKYILLEMDRILRPSGYVIIRESSYFMDAITTLAKGIRWSCRREETEYAVKSEKILVCQK

SEQ ID NO: 2885 - protein, 76 aa, Arabidopsis thaliana
  G1196,AKR domain
LHYAVAYSDPKVVTQVLDLDMADVNFRNSRGYTVLHIAAMRREPTIIIPLIQKGANASDFTFDGRSAVNICRRLTR

SEQ ID NO: 2886 - protein, 51 aa, Arabidopsis thaliana
  G1198,bZIP domain
KQLDAKTLRRLAQNREAARKSRLRKKAYVQQLESSRIKLSQLEQELQRARS

SEQ ID NO: 2887 - protein, 515 aa, Arabidopsis thaliana
  G1202,AKR domain
EYTPCEFVNRSLNFPRERLIYRERHCPEKHEIVRCRIPAPYGYSLPFRWPESRDVAWFANVPHTELTVEKKNQNWVRYEKDRFLFPGGGTMFPRGADAYIDEIGRLINLKDGSIRTAIDTGCGVASFGAYLMSRNIVTMSFAPRDTHEAQVQFALERGVPAIIGVLASIRLPFPARAFDIAHCSRCLIPWGQYNGTYLIEVDRVLRPGGYWILSGPPINWQRHWKGWERTRDDLNSEQSQIERVARSLCWRKLVQREDLAVWQKPTNHVHCKRNRIALGRPPFCHRTLPNQGWYTKLETCLTPLPEVTGSEIKEVAGGQLARWPERLNALPPRIKSGSLEGITEDEFVSNTEKWQRRVSYYKKYDQQLAETGRYRNFLDMNAHLGGFASALVDDPVWVMNVVPVEASVNTLGVIYERGLIGTYQNWCEAMSTYPRTYDFIHADSVFSLYKDRCDMEDILLEMDRILRPKGSVIIRDDIDVLTKVKKITDAMQWEGRIGDHENGPLEREKILFLVK

SEQ ID NO: 2888 - protein, 47 aa, Arabidopsis thaliana
  G1206,1st ENBP domain
CHQCLKGERITLLICSECEKTMFCLQCIRKWYPNLSEDDVVEKCPLC

SEQ ID NO: 2889 - protein, 274 aa, Arabidopsis thaliana
  G1206,2nd ENBP domain
LPRHCDEFISALPFQEYSDPRTGILNIATKLPEGFIKPDLGPKTYIAYGIPDELGRGDSVTKLHCDMSDAVNILTHTAEVTLSQEQISSVKALKQKHKLQNKVDKQSTEDCNEKEEEEEEELNMPEISSNENEETGSALWDIFRREDVPKLEEYLRKHCKEFRHTYCSPVTKVTTPTCINFMTNLFPVLTVSSFQVYHPIHDQSCYLTLEHKRKLKAEYGIEPWTFVQKLGEAVFIPAGCPHQVRNLKSCTKVAVDFVSPENIHECLRLTEEFR

SEQ ID NO: 2890 - protein, 60 aa, Arabidopsis thaliana
  G1225,HLH/MYC domain
EAENQRMTHIAVERNRRRQMNQHLSVLRSLMPQPFAHKGDQASIVGGAIDFIKELEHKLL

SEQ ID NO: 2891 - protein, 60 aa, Arabidopsis thaliana
  G1226,HLH/MYC domain
EVENQRMTHIAVERNRRRQMNEHLNSLRSLMPPSFLQRGDQASIVGGAIDFIKELEQLLQ

SEQ ID NO: 2892 - protein, 60 aa, Arabidopsis thaliana
  G1228,HLH/MYC domain
EIENQRINHIAVERNRRRQMNEHINSLRALLPPSYIQRGDQASIVGGAINYVKVLEQIIQ

SEQ ID NO: 2893 - protein, 60 aa, Arabidopsis thaliana
  G1229,HLH/MYC domain
QDGQQKMSHVTVERNRRKQMNEHLTVLRSLMPCFYVKRGDQASIIGGVVEYISELQQVLQ

SEQ ID NO: 2894 - protein, 85 aa, Arabidopsis thaliana
  G1242,1st SWI/SNF domain
DILEDYLMYRGYQYCRIDGNTGGDERDASIEAYNKPGSEKFVFLLSTRAGGLGINLATADVVILYDSDWNPQVDLQAQDRAHRIG

SEQ ID NO: 2895 - protein, 50 aa, Arabidopsis thaliana
  G1242,2nd SWI/SNF domain
GFSTWSRRDFNAFIRACEKYGRNDIKSIASEMEGKTEEEVERYAQVFQVR

SEQ ID NO: 2896 - protein, 62 aa, Arabidopsis thaliana
  G1242,3rd SWI/SNF domain
KGKLYNEECDRFMICMVHKLGYGNWDELKAAFRTSPLFRFDWFVKSRTTQELARRCDTLIRL

SEQ ID NO: 2897 - protein, 113 aa, Arabidopsis thaliana
  G1246,MYB-(R1)R2R3 domain
KKGPWTAAEDEILAAYVRENGEGNWNAVQKNTGLARCGKSCRLRWANHLRPNLKKGSFTGDEERLIIQLHAQLGNKWARMAAQLPGRTDNEIKNYWNTRLKRLLRQGLPLYPP

SEQ ID NO: 2898 - protein, 124 aa, Arabidopsis thaliana
  G1247,MYB-(R1)R2R3 domain
KSKWKPEEDRILKDYVIQYGDRTWTHVPKRTGLPHNPASCRFRWMNHLKPSLKKGPFTDEEEKRVLQLHAVLGNKWSQMAREVCNSLSFFFHSLHFHLLLLFDLNFCFFKFPGRTDNEIKNFWN

SEQ ID NO: 2899 - protein, 84 aa, Arabidopsis thaliana
  G1248,CAAT domain
QEESMMVKEQDRLLPIANVGRIMKNILPANAKVSKEAKETMQECVSEFISFVTGEASDKCHKEKRKTVNGDDICWAMANLGFDD

SEQ ID NO: 2900 - protein, 77 aa, Arabidopsis thaliana
  G1249,CAAT domain
PIGRVKKIMKLDKDINKINSEALHVITYSTELFLHFLAEKSAVVTAEKKRKTVNLDHLRIAVKRHQPTSDFLLDSLP

SEQ ID NO: 2901 - protein, 39 aa, Arabidopsis thaliana
  G1255,Z-CO-like domain
SCVKRRARWYCAADDAFLCQSCDSLVHSANPLARRHERV

SEQ ID NO: 2902 - protein, 69 aa, Arabidopsis thaliana
  G1266,AP2 domain
EKSYRGVRRRPWGKFAAEIRDSTRNGIRVWLGTFESAEEAALAYDQAAFSMRGSSAILNFSAERVQESL

SEQ ID NO: 2903 - protein, 58 aa, Arabidopsis thaliana
  G1267,WRKY domain
SDSWAWRKYGQKPIKGSPYPRGYYRCSSSKGCPARKQVERSRVDPSKLMITYACDHNH

SEQ ID NO: 2904 - protein, 47 aa, Arabidopsis thaliana
  G1269,MYB-related domain
EKWTEAEHEKFVEALKLYGRAWRRIEEHVGTKTAVQIRSHAQKFFTK

SEQ ID NO: 2905 - protein, 38 aa, Arabidopsis thaliana
  G1272,PAZ domain
PENVPPGTIIDNKICHPKNNDFYLCAHAGMIGTTRPTH

SEQ ID NO: 2906 - protein, 56 aa, Arabidopsis thaliana
  G1273,1st WRKY domain
VDGYNWRKYGQKQVKGSECPRSYYKCTHPKCPVKKKVERSVEGQVSEIVYQGEHNH

SEQ ID NO: 2907 - protein, 57 aa, Arabidopsis thaliana
  G1273,2nd WRKY domain
EDGFRWRKYGQKVVGGNAYPRSYYRCTSANCRARKHVERASDDPRAFITTYEGKHNH

SEQ ID NO: 2908 - protein, 57 aa, Arabidopsis thaliana
  G1275,WRKY domain
DDGFKWRKYGKKMVKNSPHPRNYYKCSVDGCPVKKRVERDRDDPSFVITTYEGSHNH

SEQ ID NO: 2909 - protein, 67 aa, Arabidopsis thaliana
  G1276,1st AP2 domain
SSQYRGVTFYRRTGRWESHIWDCGKQVYLGGFDTAHAAARAYDRAAVKFRGLEADINFVIGDYEEDL

SEQ ID NO: 2910 - protein, 56 aa, Arabidopsis thaliana
  G1276,2nd AP2 domain
NSRYQGVALQKIGGWGAQMEQLHGNMGCDKAAVQWKGREAASLIEPHASRMIPEAA

SEQ ID NO: 2911 - protein, 68 aa, Arabidopsis thaliana
  G1277,AP2 domain
ERPFKGIRMRKWGKWVAEIREPNKRSRLWLGSYSTPEAAARAYDTAVFYLRGPTATLNFPELLPCTSA

SEQ ID NO: 2912 - protein, 489 aa, Arabidopsis thaliana
  G1289,AKR domain
DYIPCLDNYAAIKQLKSRRHMEHRERHCPEPSPKCLLPLPDNYKPPVPWPKSRDMIWYDNVPHPKLVEYKKEQNWVKKEGEFLVFPGGGTQFKFGVTHYVEFIEKALPSIKWGKNIRVVLDVGCGVASFGGSLLDKDVITMSFAPKDEHEAQIQFALERGIPATLSVIGTQQLTFPSNAFDLIHCARCRVHWDADGGKPLLELNRVLRPGGFFIWSATPVYRDNDRDSRIWNEMVSLTKSICWKVVTKTVDSSGIGLVIYQKPTSESCYNKRSTQDPPLCDKKEANGSWYVPLAKCLSKLPSGNVQSWPELWPKRLVSVKPQSISVKAETLKKDTEKWSASVSDVYLKHLAVNWSTVRNVMDMNAGFGGFAAELINQPLWVMNDVPVDKPDTLSVVYDRGLIGVYHDWCESVNTYPRTYDLLHSSFLLGDLTQRCEIVQVVAEIDRIVRPGGYLVVQDNMETIMKLESILGSLHWSTKIYEDRFLVGRK

SEQ ID NO: 2913 - protein, 97 aa, Arabidopsis thaliana
  G1290,AKR domain
IYKALDSDDVELVKMLLLEGHTNLDEAYALHFAIAHCAVKTAYDLLELELADVNLRNPRGYTVLHVAAMRKEPKLIISLLMKGANILDTTLDGRTAL

SEQ ID NO: 2914 - protein, 106 aa, Arabidopsis thaliana
  G1304,MYB-(R1)R2R3 domain
KKGPWTQEEDDKLIDHIQKHGHGSWRALPKQAGLNRCGKSCRLRWTNYLRPDIKRGNFTEEEEQTIINLHSLLGNKWSSIAGNLPGRTDNEIKNYWNTHLRKKLLQ

SEQ ID NO: 2915 - protein, 104 aa, Arabidopsis thaliana
  G1305,MYB-(R1)R2R3 domain
KRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHLKKRL

SEQ ID NO: 2916 - protein, 103 aa, Arabidopsis thaliana
  G1309,MYB-(R1)R2R3 domain
RKGLWSPEEDQKLKSFILSRGHACWTTVPILAGLQRNGKSCRLRWINYLRPGLKRGSFSEEEEETILTLHSSLGNKWSRIAKYLPGRTDNEIKNYWHSYLKKR

SEQ ID NO: 2917 - protein, 102 aa, Arabidopsis thaliana
  G1311,MYB-(R1)R2R3 domain
RGPWLEEEDERLVKVISLLGERRWDSLAIVSGLKRSGKSCRLRWMNYLNPTLKRGPMSQEEERIIFQLHALWGNKWSKIARRLPGRTDNEIKNYWRTHYRKK

SEQ ID NO: 2918 - protein, 104 aa, Arabidopsis thaliana
  G1313,MYB-(R1)R2R3 domain
LKKGPWSSAEDDILIDYVNKHGEGNWNAVQKHTSLFRCGKSCRLRWANHLRPNLKKGAFSQEEEQLIVELHAKMGNRWARMAAHLPGRTDNEIKNYWNTRIKRR

SEQ ID NO: 2919 - protein, 103 aa, Arabidopsis thaliana
  G1314,MYB-(R1)R2R3 domain
RGPWSPEEDSKLRDYIEKYGNGGNWISFPLKAGLRRCGKSCRLRWLNYLRPNIKHGDFSEEEDRIIFSLFAAIGSRWSIIAAHLPGRTDNDIKNYWNTKLRKK

SEQ ID NO: 2920 - protein, 106 aa, Arabidopsis thaliana
  G1317,MYB-(R1)R2R3 domain
KKGPWTAEEDQKLIDYIRFHGPGNWRTLPKNAGLHRCGKSCRLRWTNYLRPDIKRGRFSFEEEETIIQLHSVMGNKWSAIAARLPGRTDNEIKNHWNTHIRKRLVR

SEQ ID NO: 2921 - protein, 105 aa, Arabidopsis thaliana
  G1322,MYB-(R1)R2R3 domain
RKGPWTMEEDFILFNYILNHGEGLWNSVAKASGLKRTGKSCRLRWLNYLRPDVRRGNITEEEQLLIIQLHAKLGNRWSKIAKHLPGRTDNEIKNFWRTKIQRHMK

SEQ ID NO: 2922 - protein, 102 aa, Arabidopsis thaliana
  G1323,MYB-(R1)R2R3 domain
KRGPWSHDEDLKLISFIHKNGHENWRSLPKQAGLLRCGKSCRLRWINYLRPDVKRGNFSAEEEDTIIKLHQSFGNKWSKIASKLPGRTDNEIKNVWHTHLKK

SEQ ID NO: 2923 - protein, 99 aa, Arabidopsis thaliana
  G1324,MYB-(R1)R2R3 domain
RRGPWTLEEDTLLTNYILHNGEGRWNHVAKCAGLKRTGKSCRLRWLNYLKPDIRRGNLTPQEQLLILELHSKWGNRWSKIAQYLPGRTDNEIKNYWRTR

SEQ ID NO: 2924 - protein, 104 aa, Arabidopsis thaliana
  G1326,MYB-(R1)R2R3 domain
QRGHWRPVEDDNLRQLVEQYGPKNWNFIAQHLYGRSGKSCRLRWYNQLDPNITKKPFTEEEEERLLKAHRIQGNRWASIARLFPGRTDNAVKNHFHVIMARRKR

SEQ ID NO: 2925 - protein, 103 aa, Arabidopsis thaliana
  G1327,MYB-(R1)R2R3 domain
VKRGPWSPQEDLTLITFIQKHGHQNWRSLPKLAGLLRCGKSCRLRWINYLRPDVKRGNFSKKEEDAIIHYHQTLGNKWSKIASFLPGRTDNEIKNVWNTHLKK

SEQ ID NO: 2926 - protein, 106 aa, Arabidopsis thaliana
  G1328,MYB-(R1)R2R3 domain
KKGPWTPEEDQKLIDYINIHGYGNWRTLPKNAGLQRCGKSCRLRWTNYLRPDIKRGRFSFEEEETIIQLHSIMGNKWSAIAARLPGRTDNEIKNYWNTHIRKRLLK

SEQ ID NO: 2927 - protein, 107 aa, Arabidopsis thaliana
  G1330,MYB-(R1)R2R3 domain
RGPWTVEEDLELINYIASHGEGRWNSLARCAELKRTGKSCRLRWLNYLRPDVRRGNITLEEQLLILELHTRWGNRWSKIAQYLPGRTDNEIKNYWRTRVQKHAKQLK

SEQ ID NO: 2928 - protein, 102 aa, Arabidopsis thaliana
  G1331,MYB-(R1)R2R3 domain
KGPWTAEEDRLLIEYVRVHGEGRWNSVSKLAGLKRNGKSCRLRWVNYLRPDLKRGQITPHEESIILELHAKWGNRWSTIARSLPGRTDNEIKNYWRTHFKKK

SEQ ID NO: 2929 - protein, 104 aa, Arabidopsis thaliana
  G1332,MYB-(R1)R2R3 domain
KRGLWKPEEDMILKSYVETHGEGNWADISRRSGLKRGGKSCRLRWKNYLRPNIKRGSMSPQEQDLIIRMHKLLGNRWSLIAGRLPGRTDNEVKNYWNTHLNKKP

SEQ ID NO: 2930 - protein, 58 aa, Arabidopsis thaliana
  G1334,CAAT domain
DGTIYVNSKQYHGIIRRRQSRAKAEKLSRCRKPYMHHSRHLHAMRRPRGSGGRFLNTK

SEQ ID NO: 2931 - protein, 20 aa, Arabidopsis thaliana
  G1335,1st Z-CLDSH domain
FGFITPDDGGDDLFVHQSSI

SEQ ID NO: 2932 - protein, 14 aa, Arabidopsis thaliana
  G1335,2nd Z-CLDSH domain
CYKCGEPGHMARDC

SEQ ID NO: 2933 - protein, 19 aa, Arabidopsis thaliana
  G1335,3rd Z-CLDSH domain
CYSCGESGHFARDCTSGGR

SEQ ID NO: 2934 - protein, 67 aa, Arabidopsis thaliana
  G1337,Z-CO-like domain
CDFCGERTAVLFCRADTAKLCLPCDQQVHTANLLSRKHVRSQICDNCGNEPVSVRCFTDNLILCQEC

SEQ ID NO: 2935 - protein, 89 aa, Arabidopsis thaliana
  G1340,TH domain
KPAELRWKWIEEYCWRRGCYRNQNQCNDKWDNLMRDYKKIREYERSRVESSFNTVTSSSYWKMDKTERKEKNLPSNMLPQIYDVLSELV

SEQ ID NO: 2936 - protein, 34 aa, Arabidopsis thaliana
  G1341,1st BZIPT2 domain
MGCCQSRIDSKEIVSRCKARKRYLKHLVKARQTL

SEQ ID NO: 2937 - protein, 111 aa, Arabidopsis thaliana
  G1341,2nd BZIPT2 domain
SHSSTVDRLYAWEKKLYQEVKYAESIKMDHEKKVEQVRRLEMKRAEYVKTEKAKKDVEKLESQLSVSSQAIQSASNEIIKLRETELYPQLVELVKGLMCMWRSMYESHQVQ

SEQ ID NO: 2938 - protein, 142 aa, Arabidopsis thaliana
  G1357,NAC domain
GFKFSPTDIELISYYLKRKMDGLERSVEIIPEVEIYNFEPWDLPDKSIVKSDSEWFFFCARGKKYPHGSQNRRATKIGYWKATGKERNVKSGSEVIGTKRTLVFHIGRAPKGGRTEWLMHEYCMIGVSLDALVICRLRRNTE

SEQ ID NO: 2939 - protein, 142 aa, Arabidopsis thaliana
  G1361,NAC domain
LPAGVKFDPTDQEVLEHLEGKVRDDAKKLHPLIDEFIRTIDGENGICYTHPEKLPGVNKDGTVRHFFHRPSKAYTTGTRKRRKVHTDSDVGGETRWHKTGKTRPVLAGGRVRGYKKILVLYTNYGKQKKPEKTNWVMHQYHL

SEQ ID NO: 2940 - protein, 60 aa, Arabidopsis thaliana
  G1363,CAAT domain
EPIFVNAKQYQAILRRRERRAKLEAQNKLIKVRKPYLHESRHLHALKRVRGSGGRFLNTK

SEQ ID NO: 2941 - protein, 90 aa, Arabidopsis thaliana
  G1364,CAAT domain
REQDRFLPIANISRIMKRGLPANGKIAKDAKEIVQECVSEFISFVTSEASDKCQREKRKTINGDDLLWAMATLGFEDYMEPLKVYLMRYR

SEQ ID NO: 2942 - protein, 68 aa, Arabidopsis thaliana
  G1380,AP2 domain
EPRYRGVRKRPWGRFAAEIRDPLKKSRVWLGTFDSAVDAARAYDTAARNLRGPKAKTNFPIDCSPSSP

SEQ ID NO: 2943 - protein, 57 aa, Arabidopsis thaliana
  G1382,1st WRKY domain
ADDGYNWRKYGQKHVKGSEFPRSYYKCTHPNCEVKKLFERSHDGQITDIIYKGTHDH

SEQ ID NO: 2944 - protein, 53 aa, Arabidopsis thaliana
  G1382,2nd WRKY domain
RWRKYGQKVVRGNPNPRSYYKCTAHGCPVRKHVERASHDPKAVITTYEGKHDH

SEQ ID NO: 2945 - protein, 68 aa, Arabidopsis thaliana
  G1384,AP2 domain
AKLYRGVRQRHWGKWVAEIRLPRNRTRLWLGTFDTAEEAALAYDRAAFKLRGDSARLNFPALRYQTGS

SEQ ID NO: 2946 - protein, 68 aa, Arabidopsis thaliana
  G1387,AP2 domain
SKKFRGVRQRQWGSWVSEIRHPLLKRRVWLGTFDTAETAARAYDQAAVLMNGQSAKTNFPVIKSNGSN

SEQ ID NO: 2947 - protein, 58 aa, Arabidopsis thaliana
  G1389,TEO domain
KDRHSKVFTSKGPRDRRVRLSAHTAIQFYDVQDRLGYDRPSKAVDWLIKKAKTAIDKL

SEQ ID NO: 2948 - protein, 9 aa, Arabidopsis thaliana
  G1399,AT-hook domain, domain in aa coordinates: 86-94
KKKRGRPRK

SEQ ID NO: 2949 - protein, 68 aa, Arabidopsis thaliana
  G1411,AP2 domain
RRHYRGVRQRPWGKWAAEIRDPKKAARVWLGTFETAESAALAYDEAALKFKGSKAKLNFPERVQLGSN

SEQ ID NO: 2950 - protein, 150 aa, Arabidopsis thaliana
  G1412,NAC domain
SLPPGFRFYPTDEELLVQYLCRKVAGYHFSLQVIGDIDLYKFDPWDLPSKALFGEKEWYFFSPRDRKYPNGSRPNRVAGSGYWKATGTDKIITADGRRVGIKKALVFYAGKAPKGTKTNWIMHEYRLIEHSRSHGSSKLDDWVLCRIYKK

SEQ ID NO: 2951 - protein, 58 aa, Arabidopsis thaliana
  G1417,WRKY domain
NDGCQWRKYGQKMAKGNPCPRAYYRCTMAVGCPVRKQVQRCAEDTTILTTTYEGNHNH

SEQ ID NO: 2952 - protein, 69 aa, Arabidopsis thaliana
  G1419,AP2 domain
QRHYRGVRRRPWGKYAAEIRDPNKKGVRVWLGTFDTAMEAARGYDKAAFKLRGSKAILNFPLEAGKHED

SEQ ID NO: 2953 - protein, 60 aa, Arabidopsis thaliana
  G1420,WRKY domain
DDGYRWRKYGQKAVKNSPYPRSYYRCTTVGCGVKKRVERSSDDPSIVMTTYEGQHTHPFP

SEQ ID NO: 2954 - protein, 63 aa, Arabidopsis thaliana
  G1421,AP2 domain
TRKFRGVRQRPWGKWAAEIRDPSRRVRVWLGTFDTAEEAAIVYDNAAIQLRGPNAELNFPPPP

SEQ ID NO: 2955 - protein, 57 aa, Arabidopsis thaliana
  G1423,MADS domain
GTKRKIAIETIQKRDSLRVTCTKRREGLYSKASQLCLLSDAQIAILATPPSSESNVS

SEQ ID NO: 2956 - protein, 154 aa, Arabidopsis thaliana
  G1425,NAC domain
GFRFHPTDEELVIHYLKRKADSVPLPVAIIADVDLYKFDPWELPAKASFGEQEWYFFSPRDRKYPNGARPNRAATSGYWKATGTDKPVISTGGGGSKKVGVKKALVFYSGKPPKGVKSDWIMHEYRLTDNKPTHICDFGNKKNSLRLDDWVLCR

SEQ ID NO: 2957 - protein, 49 aa, Arabidopsis thaliana
  G1435,GARP domain
WTPQLHKRFVDVVAHLGIKNAVPKTIMQLMNVEGLTRENVASHLQKYRL

SEQ ID NO: 2958 - protein, 85 aa, Arabidopsis thaliana
  G1444,GRF-like domain
PVPLSDLYFNRSPTATARYFRGGYKDGGDDFGSLQLSLPPPSQISDRLIQRDLIKKKEEVKALDDDNGDVDVKSRTDASGSKNVN

SEQ ID NO: 2959 - protein, 405 aa, Arabidopsis thaliana; identical to SEQ ID NO: 986
  G1446,MISC domain

SEQ ID NO: 2960 - protein, 6 aa, Arabidopsis thaliana
  G1449,1st IAA domain
WPPIKS

SEQ ID NO: 2961 - protein, 34 aa, Arabidopsis thaliana
  G1449,2nd IAA domain
FVKVYMEGVPIGRKLDLCVFSGYESLLENLSHMF

SEQ ID NO: 2962 - protein, 31 aa, Arabidopsis thaliana
  G1449,3rd IAA domain
VLTYEDKDGDWMMVGDIPWDMFLETVRRLKI

SEQ ID NO: 2963 - protein, 336 aa, Arabidopsis thaliana
  G1451,ARF domain
ELWHACAGPLVSLPSSGSRVVYFPQGHSEQVAATTNKEVDGHIPNYPSLPPQLICQLHNVTMHADVETDEVYAQMTLQPLTPEEQKETFVPIELGIPSKQPSNYFCKTLTASDTSTHGGFSVPRRAAEKVFPPLDYTLQPPAQELIARDLHDVEWKFRHIFRGQPKRHLLTTGWSVFVSAKRLVAGDSVIFIRNEKNQLFLGIRHATRPQTIVPSSVLSSDSMHIGLLAAAAHASATNSCFTVFFHPRASQSEFVIQLSKYIKAVFHTRISVGMRFRMLFETEESSVRRYMGTITGISDLDSVRWPNSHWRSVKVGWDESTAGERQPRVSLWEIEP

SEQ ID NO: 2964 - protein, 142 aa, Arabidopsis thaliana
  G1452,NAC domain
GFRFSPTDVELISYYLRRKIDGDENSVAVIAEVEIYKFEPWDLPEESKLKSENEWFYFCARGRKYPHGSQSRRATQLGYWKATGKERSVKSGNQVVGTKRTLVFHIGRAPRGERTEWIMHEYCIHGAPQDALVVCRLRKNAD

SEQ ID NO: 2965 - protein, 148 aa, Arabidopsis thaliana
  G1453,NAC domain
PPGFRFHPTDEELVGYYLKKKIASQRIDLDVIREIDLYKIEPWDLQERCRIGYEEQTEWYFFSHRDKKYPTGTRTNRATVAGFWKATGRDKAVYLNSKLIGMRKTLVFYRGRAPNGQKSDWIIHEYYSLESHQNSPPQEEGWVVCRAF

SEQ ID NO: 2966 - protein, 260 aa, Arabidopsis thaliana
  G1462,NAC domain
ELLYSEDEVIISRYLKGMVVNGDSWPDHFIEDANVFTKNPDKVFNSERPRFVIVKPRTEACGKTDGCDSGCWRIIGRDKLIKSEETGKILGFKKILKFCLKRKPIDYKRSWVMEEYRLTNNLNWKQDHVICKIRFMFEAEISFLLSKHFYTTSESVLENELLPSYGYYLSNTQEEDEFYLDAIMTSEGNEWPSYVTNNVYCLHPLELVDLQDRMFNDYGTCIFANKTCGETDKCDGGYWKILHGDKLIKSNFGKVIGFKK

SEQ ID NO: 2967 - protein, 148 aa, Arabidopsis thaliana
  G1463,NAC domain
PLFLGRFSFVMADTLLNAEDEVIISRYLKPMIVNRVSWPDLFIEDADVFNKDPYVKFHAEIPSFVIVKPRTKACGKTDGCDSGCWRIIGRDKLIKSEETGKILGFKKILKFCLKWKPREYKRSLVMEEYRLTNNFNWKQDHVICKIRL

SEQ ID NO: 2968 - protein, 65 aa, Arabidopsis thaliana
  G1465,NAC domain
KTDRCINGGYWKILHRDRLIKSKSGIVIGFKKVFKFHETEKERYFCGGEDVKVTWTLEEYRLSVK

SEQ ID NO: 2969 - protein, 267 aa, Arabidopsis thaliana
  G1466,PMR domain
GFGRDKVNGRYKVVRMSFAFWRVRQEEPVVECGVLDVDTGEWRKLSPPPYVVNVGSKSVCVNGSIYWLHIQTVYRILALDLHKQEFHKVPVPPTQITVDTQMVNLEDRLVLAITRVSPEWILEVWGMDTYKEKWSKTYSISLDHRVVSWRRQKRWFTPVAVSKQANLVFYDNKKRLFKYYPVKDEIRCLSLDICVLSPYVENLVPLPLKPSHPHPTPKNSDFEMRISRCRLFSTPGSWISKILKWNVMTLEILFTSLAIVGYICLPL

SEQ ID NO: 2970 - protein, 21 aa, Arabidopsis thaliana
  G1468,1st Z-C2H2 domain
CKACKKVFTSHQALGGHRASH

SEQ ID NO: 2971 - protein, 21 aa, Arabidopsis thaliana
  G1468,2nd Z-C2H2 domain
CTICHRVFSSGQALGGHKRCH

SEQ ID NO: 2972 - protein, 22 aa, Arabidopsis thaliana
  G1471,Z-C2H2 domain
CYLCKRAFPTPHALGGHGTTHK

SEQ ID NO: 2973 - protein, 24 aa, Arabidopsis thaliana
  G1472,Z-C2H2 domain
CRFCKRNFKSCFALGGHMKCHKKE

SEQ ID NO: 2974 - protein, 28 aa, Arabidopsis thaliana
  G1474,Z-C2H2 domain
CSFCRREFKSAQALGGHMNVHRRDRARL

SEQ ID NO: 2975 - protein, 21 aa, Arabidopsis thaliana
  G1476,Z-C2H2 domain
CTFCKRGFTNAQALGGHMNIH

SEQ ID NO: 2976 - protein, 45 aa, Arabidopsis thaliana
  G1478,Z-CO-like domain
CELCGENATVYCEADAAFLCRKCDRWVHSANFLARRHLRRVICTT

SEQ ID NO: 2977 - protein, 24 aa, Arabidopsis thaliana
  G1480,1st Z-CO-like domain
CDSCKSATAALYCRPDAAFLCLSC

SEQ ID NO: 2978 - protein, 25 aa, Arabidopsis thaliana
  G1480,2nd Z-CO-like domain
MCEVCEQAPAHVTCKADAAALCVTC

SEQ ID NO: 2979 - protein, 23 aa, Arabidopsis thaliana
  G1481,1st Z-CO-like domain
CDLCNGVARMYCESDQASLCWDC

SEQ ID NO: 2980 - protein, 27 aa, Arabidopsis thaliana
  G1481,2nd Z-CO-like domain
CSACQSLTPWKATGLRLGPTFSVCESC

SEQ ID NO: 2981 - protein, 59 aa, Arabidopsis thaliana
  G1482,Z-CO-like domain
CDVCDKEEASVFCTADEASLCGGCDHQVHHANKLASKHLRFSLLYPSSSNTSSPLCDIC

SEQ ID NO: 2982 - protein, 50 aa, Arabidopsis thaliana
  G1483,Z-CO-like domain
CCSDEAVLCKPCDIKVHEANKLFQRHHRVALQKDAASATTASGAPLCDIC

SEQ ID NO: 2983 - protein, 26 aa, Arabidopsis thaliana
  G1488,GATA/Zn domain
CLHCATDKTPQWRTGPMGPKTLCNAC

SEQ ID NO: 2984 - protein, 48 aa, Arabidopsis thaliana
  G1493,GARP domain
WSVELHQQFVAAVNQLGVEKAVPKKILELMNVPGLTRENVASHLQKYR

SEQ ID NO: 2985 - protein, 58 aa, Arabidopsis thaliana
  G1494,HLH/MYC domain
RRSRAAEVHNLSERRRRDRINERMKALQELIPHCSKTDKASILDEAIDYLKSLQLQLQ

SEQ ID NO: 2986 - protein, 59 aa, Arabidopsis thaliana
  G1496,HLH/MYC domain
RRGQATDRHSLAERARREKISKKMKYLQDIVPGCNKVTGKAGMLDEIINYVQCLQRQVE

SEQ ID NO: 2987 - protein, 58 aa, Arabidopsis thaliana
  G1499,HLH/MYC domain
NVRISDDPQSVAARHRRERISERIRILQRLVPGGTKMDTASMLDEAIRYVKFLKRQIR

SEQ ID NO: 2988 - protein, 14 aa, Arabidopsis thaliana
  G1504,GATA/Zn domain
CTHCETTTTPQWRE

SEQ ID NO: 2989 - protein, 27 aa, Arabidopsis thaliana
  G1506,GATA/Zn domain
CYHCGVTSTPLWRNGPPEKPVLCNACG

SEQ ID NO: 2990 - protein, 34 aa, Arabidopsis thaliana
  G1510,GATA/Zn domain
RVCSDCNTTKTPLWRSGPRGPKSLCNACGIRQRK

SEQ ID NO: 2991 - protein, 55 aa, Arabidopsis thaliana
  G1512,RING/C3HC4 domain
SGCFDCNICLDTAHDPVVTLCGHLFCWPCIYKWLHVQLSSVSVDQHQNNCPVCKS

SEQ ID NO: 2992 - protein, 38 aa, Arabidopsis thaliana
  G1517,RING/C3HC4 domain
CFICREPFLDPVVTKCKHYFCEHCALKHHTKNKKCFVC

SEQ ID NO: 2993 - protein, 38 aa, Arabidopsis thaliana
  G1519,RING/C3HC4 domain
CTLCLSTRQHPTATPCGHVFCWSCIMEWCNEKQECPLC

SEQ ID NO: 2994 - protein, 42 aa, Arabidopsis thaliana
  G1521,RING/C3HC4 domain
CPICLENLTERRSAAVITVCKHGYCLACIRKWSSFKRNCPLC

SEQ ID NO: 2995 - protein, 298 aa, Arabidopsis thaliana
  G1526,1st SWI/SNF domain
LLCELRPYQKQALHWMTQLEKGNCTDEAATMLHPCWEAYCLADKRELVVYLNSFTGDATIHFPSTLQMARGGILADAMGLGKTVMTISLLLAHSWKAASTGFLCPNYEGDKVISSSVDDLTSPPVKATKFLGFDKRLLEQKSVLQNGGNLIVCPMTLLGQWKTEIEMHAKPGSLSVYVHYGQSRPKDAKLLSQSDVVITTYGVLTSEFSQENSADHEGIYAVRWFRIVLDEAHTIKNSKSQISLAAAALVADRRWCLTGTPIQNNLEDLYSLLRFLRIEPWGTWAWWNKLVQKPFEEG

SEQ ID NO: 2996 - protein, 40 aa, Arabidopsis thaliana
  G1526,2nd SWI/SNF domain
CPICLEALEDAVLTPCAHRLCRECLLASWRNSTSGLCPVC

SEQ ID NO: 2997 - protein, 84 aa, Arabidopsis thaliana
  G1526,3rd SWI/SNF domain
DLLQIPLSRNNFSFVRLDGTLSQQQREKVLKEFSEDGSILVLLMSLKAGGVGINLTAASNAFVMDPWWNPAVEEQAVMRIHRIG

SEQ ID NO: 2998 - protein, 37 aa, Arabidopsis thaliana
  G1531,RING/C3HC4 domain
HPYMCDTSVRHSNCFKQFRRKTIKKRLYPKTLHCPLC

SEQ ID NO: 2999 - protein, 61 aa, Arabidopsis thaliana
  G1535,HB domain
PAKKKRYHRHTNRQIQEMEALFKENPHPDDKQRKRLSAELGLKPRQVKFWFQNRRTQMKAQ

SEQ ID NO: 3000 - protein, 61 aa, Arabidopsis thaliana
  G1537,HB domain
RWNPTKDQITLLENLYKEGIRTPSADQIQQITGRLRAYGHIEGKNVFYWFQNHKARQRQKQ

SEQ ID NO: 3001 - protein, 61 aa, Arabidopsis thaliana
  G1538,HB domain
IGGMLRKRKLTDEQVNMLEYSFGNEHKLESGRKEKIAGELGLDPRQVAVWFQNRRARWKNK

SEQ ID NO: 3002 - protein, 61 aa, Arabidopsis thaliana
  G1539,HB domain
RWNPTPDQLRVLEELYRQGTRTPSADHIQQITAQLRRYGKIEGKNVFYWFQNHKARERQKR

SEQ ID NO: 3003 - protein, 64 aa, Arabidopsis thaliana
  G1540,HB domain
STRWTPTTEQIKILKELYYNNAIRSPTADQIQKITARLRQFGKIEGKNVFYWFQNHKARERQKK

SEQ ID NO: 3004 - protein, 61 aa, Arabidopsis thaliana
  G1543,HB domain
APPRKKLRLTREQSRLLEDSFRQNHTLNPKQKEVLAKHLMLRPRQIEVWFQNRRARSKLKQ

SEQ ID NO: 3005 - protein, 64 aa, Arabidopsis thaliana
  G1545,HB domain
NEGNGWFRKRKLSDEQVRMLEISFEDDHKLESERKDRLASELGLDPRQVAVWFQNRRARWKNKR

SEQ ID NO: 3006 - protein, 61 aa, Arabidopsis thaliana
  G1549,HB domain
MTSEQLKFLERSFQEEIKLNPDRKMKLNPDRKMKLSKELGLQPRQIAVWFQNRKARWKNKQ

SEQ ID NO: 3007 - protein, 50 aa, Arabidopsis thaliana
  G1554,GARP domain
WSPDLHRRFVQALQMLGGSQVATPKQIRELMKVDGLTNDEVKSHLQKYRL

SEQ ID NO: 3008 - protein, 49 aa, Arabidopsis thaliana
  G1556,GARP domain
WTDDLDIRFIQVIEKLGGEESATPKRILSLMGVRDLTISHVKSHLQMYR

SEQ ID NO: 3009 - protein, 49 aa, Arabidopsis thaliana
  G1557,GARP domain
WNSDLHNSFVQAVEQLGGENRATPKMVLQLMDVRGLTISHVKSHLQMYR

SEQ ID NO: 3010 - protein, 92 aa, Arabidopsis thaliana
  G1560,HS domain
PFLTKTYDLVEDSRTNHVVSWSKSNNSFIVWDPQAFSVTLLPRFFKHNNFSSFVRQLNTYGFRKVNPDRWEFANEGFLRGQKHLLKNIRRRK

SEQ ID NO: 3011 - protein, 61 aa, Arabidopsis thaliana
  G1585,HB domain
RWNPKPEQIRILESIFNSGTINPPREEIQRIRIRLQEYGQIGDANVFYWFQNRKSRAKHKL

SEQ ID NO: 3012 - protein, 61 aa, Arabidopsis thaliana
  G1587,HB domain
RWNPTPEQITTLEELYRSGTRTPTTEQIQQIASKLRKYGRIEGKNVFYWFQNHKARERLKR

SEQ ID NO: 3013 - protein, 61 aa, Arabidopsis thaliana
  G1591,HB domain
RWCPTPEQLMILEEMYRSGIRTPNAVQIQQITAHLAFYGRIEGKNVFYWFQNHKARDRQKL

SEQ ID NO: 3014 - protein, 64 aa, Arabidopsis thaliana
  G1593,HB domain
NAWRPQRGLPEKAVSVLRSWLFEHFLHPYPRDLDKVMLAKQTGLTKSQVSNWFINARVRMWKPL

SEQ ID NO: 3015 - protein, 20 aa, Arabidopsis thaliana
  G1594,HB domain
SENMPFAMMDDSSGSFFTEE

SEQ ID NO: 3016 - protein, 51 aa, Arabidopsis thaliana
  G1634,1st MYB-related domain
SSWTKEENKKFERALAVYADDTPDRWFKVAAMIPGKTISDVMRQYSKLEED

SEQ ID NO: 3017 - protein, 49 aa, Arabidopsis thaliana
  G1634,2nd MYB-related domain
VPWTEEEHRRFLLGLLKYGKGDWRNISRNFVGSKTPTQVASHAQKYYQR

SEQ ID NO: 3018 - protein, 47 aa, Arabidopsis thaliana
  G1635,MYB-related domain
ERWTDEEHKKFVEALKLYGRAWRRIEEHVGSKTAVQIRSHAQKFFSK

SEQ ID NO: 3019 - protein, 49 aa, Arabidopsis thaliana
  G1637,MYB-related domain
KPWTEEEHRNFLIGLNKLGKGDWRGIAKSFVSTRTPTQVASHAQKYFIR

SEQ ID NO: 3020 - protein, 51 aa, Arabidopsis thaliana
  G1638,1st MYB-related domain
TKWTAEENKKFENALAFYDKDTPDRWSRVAAMLPGKTVGDVIKQYRELEED

SEQ ID NO: 3021 - protein, 49 aa, Arabidopsis thaliana
  G1638,2nd MYB-related domain
VPWTEEEHRQFLMGLKKYGKGDWRNIARNFVTTRTPTQVASHAQKYFIR

SEQ ID NO: 3022 - protein, 102 aa, Arabidopsis thaliana
  G1640,MYB-(R1)R2R3 domain
RGRWTAEEDEILTKYIQTNGEGSWRSLPKKAGLLRCGKSCRLRWINYLRRDLKRGNITSDEEEIIVKLHSLLGNRWSLIATHLPGRTDNEIKNYWNSHLSRK

SEQ ID NO: 3023 - protein, 51 aa, Arabidopsis thaliana
  G1641,1st MYB-related domain
ATWTAAENKAFENALAVYDDNTPDRWQKVAAVIPGKTVSDVIRQYNDLEAD

SEQ ID NO: 3024 - protein, 49 aa, Arabidopsis thaliana
  G1641,2nd MYB-related domain
VPWTEEEHKLFLMGLKKYGKGDWRNISRNFVITRTPTQVASHAQKYFIR

SEQ ID NO: 3025 - protein, 121 aa, Arabidopsis thaliana
  G1645,MYB-(R1)R2R3 domain
SSKPSVLGRGHWRPAEDVKLKELVSIYGPQNWNLIAEKLQGRSGKSCRLRWFNQLDPRINRRAFTEEEEERLMQAHRLYGNKWAMIARLFPGRTDNSVKNHWHVVMARKYREHSSAYRRRK

SEQ ID NO: 3026 - protein, 97 aa, Arabidopsis thaliana
  G1646,CAAT domain
QEIEQVNDFKNHQLPLARIKKIMKADEDVRMISAEAPILFAKACELFILELTIRSWLHAEENKRRTLQKNDIAAAITRTDIFDFLVDIVPREEIKEE

SEQ ID NO: 3027 - protein, 58 aa, Arabidopsis thaliana
  G1649,HLH/MYC domain
KRKRSTEVHKLYERKRRDEFNKKMRALQDLLPNCYKDDKASLLDEAIKYMRTLQLQVQ

SEQ ID NO: 3028 - protein, 58 aa, Arabidopsis thaliana
  G1650,HLH/MYC domain
KRSRAAIMHKLSERRRRQKINEMMKALQELLPRCTKTDRSSMLDDVIEYVKSLQSQIQ

SEQ ID NO: 3029 - protein, 58 aa, Arabidopsis thaliana
  G1652,HLH/MYC domain
RSQSNAQDHILAERKRREKLTQRFVALSALIPGLKKMDKASVLGDAIKHIKYLQESVK

SEQ ID NO: 3030 - protein, 58 aa, Arabidopsis thaliana
  G1655,HLH/MYC domain
GNCKSRKGLTETNRIKLPAVERKLKILGRLVPGCRKVSVPNLLDEATDYIAALEMQVR

SEQ ID NO: 3031 - protein, 115 aa, Arabidopsis thaliana
  G1660,DBP domain
TKASLQTSKSVSEARATAWEEAEKAKHMARFRREEMKIQAWENHQKAKSEAEMKKTEVKVERIKGRAQDRLMKKLATIERKAEEKRAAAEAKKDHQAAKTEKQAEQIRRTGKVPS

SEQ ID NO: 3032 - protein, 26 aa, Arabidopsis thaliana
  G1662,1st DBP domain
PQTPKEPMEFLSRSWSLSTSEISKAL

SEQ ID NO: 3033 - protein, 36 aa, Arabidopsis thaliana
  G1662,2nd DBP domain
TKRVCVYINKKSQVMIKLKSKHVGGAFSKKIKCVVY

SEQ ID NO: 3034 - protein, 58 aa, Arabidopsis thaliana
  G1666,HLH/MYC domain
RLPREDLSHVVAERRRREKLNEKFITLRSMVPFVTKMDKVSILGDTIAYVNHLRKRVH

SEQ ID NO: 3035 - protein, 9 aa, Arabidopsis thaliana
  G1667,AT-hook domain
KRPRGRPAG

SEQ ID NO: 3036 - protein, 154 aa, Arabidopsis thaliana
  G1672,NAC domain
VGLPAGVKFDPTDQELIEHLEAKVKGKEENKKWSSSHPLIDEFIPTIDGEDGICYTHPQKLPGVTRDGLSKHFFHKPSRAYTTGTRKRRKIIQTDHDSELTGSSETRWHKTGKTRPVMINGQQRGCKKILVLYTNFGKNRRPEKTNWVMHQYHL

SEQ ID NO: 3037 - protein, 165 aa, Arabidopsis thaliana
  G1677,NAC domain
DDVVLPGFRFHPTDEELVSFYLKRKVLHKSLPFDLIKKVDIYKYDPWDLPKLAAMGEKEWYFYCPRDRKYRNSTRPNRVTGGGFWKATGTDRPIYSLDSTRCIGLKKSLVFYRGRAAKGVKTDWMMHEFRLPSLSDSHHSSYPNYNNKKQHLNNNNNSKELPSND

SEQ ID NO: 3038 - protein, 42 aa, Arabidopsis thaliana
  G1700,RING/C3H2C3 domain
EMLPVVIYKESFIVKDSQCSVCLGDYQAEEKLQQMPSCGHTF

SEQ ID NO: 3039 - protein, 33 aa, Arabidopsis thaliana
  G1706,RING/C3H2C3 domain
DCAVCLCEFSEDDKLRLLPNCSHAFHIDCIDTW

SEQ ID NO: 3040 - protein, 41 aa, Arabidopsis thaliana
  G1718,RING/C3H2C3 domain
CVICLEEWKSEETVKEMPCKHRFHGGCIEKWLGFHGSCPVC

SEQ ID NO: 3041 - protein, 42 aa, Arabidopsis thaliana
  G1730,RING/C3H2C3 domain
CAICLSEFSDEDTVRLITVCRHPFHSNCIDLWFELHKTCPVC

SEQ ID NO: 3042 - protein, 43 aa, Arabidopsis thaliana
  G1743,RING/C3H2C3 domain
CAVCLYEFEGEQEIRWLRNCRHIFHRSCLDRWMDHDQKTCPLC

SEQ ID NO: 3043 - protein, 69 aa, Arabidopsis thaliana
  G1749,AP2 domain
EKKHKGVRKKPSGKWAAEIWDPSLKVRRWLGTFPTAEMAAKAYNDAAAEFVGRRSARRGTKNGEEASTK

SEQ ID NO: 3044 - protein, 63 aa, Arabidopsis thaliana
  G1750,AP2 domain
QKKYRGVRQRPWGKWAAEIRDPEQRRRIWLGTFATAEEAAIVYDNAAIKLRGPDALTNFTVQP

SEQ ID NO: 3045 - protein, 69 aa, Arabidopsis thaliana
  G1752,AP2 domain
ERSYRGVRKRPWGKFAAEIRDSTRNGIRVWLGTFDKAEEAALAYDQAAFATKGSLATLNFPVEVVRESL

SEQ ID NO: 3046 - protein, 69 aa, Arabidopsis thaliana
  G1753,AP2 domain
HPLYRGVRQRKNSNKWVSEIREPRKPNRIWLGTFSTPEMAAIAYDVAALALKGSQAELNFPNSVSSLPA

SEQ ID NO: 3047 - protein, 63 aa, Arabidopsis thaliana
  G1755,AP2 domain
ICDYTGVRQRTWGKWVAEIREPGRGAKLWLGTFSSSYEAALAYDEASKAIYGQSARLNLPLLP

SEQ ID NO: 3048 - protein, 63 aa, Arabidopsis thaliana
  G1756,WRKY domain
LLSDAWAWRKYGQKPIKGSPYPRSYYRCSSSKGCLARKQVERNPQNPEKFTITYTNEHNHELP

SEQ ID NO: 3049 - protein, 57 aa, Arabidopsis thaliana
  G1758,WRKY domain
DDGYKWRKYGKKPITGSPFPRHYHKCSSPDCNVKKKIERDTNNPDYILTTYEGRHNH

SEQ ID NO: 3050 - protein, 56 aa, Arabidopsis thaliana
  G1759,MADS domain
GRKKLEIKRIENKSSRQVTFSKRRNGLIEKARQLSVLCDASVALLVVSASGKLYSF

SEQ ID NO: 3051 - protein, 121 aa, Arabidopsis thaliana
  G1765,NAC domain
PGFRFHPTDEELLGYYLRRKVENKTIKLELIKQIDIYKYDPWDLPRVSSVGEKEWYFFCMRGRKYRNSVRPNRVTGSGFWKATGIDKPVYSNLDCVGLKKSLVYYLGSAGKGTKTDWMMHE

SEQ ID NO: 3052 - protein, 66 aa, Arabidopsis thaliana
  G1767,1st SCR domain
VLKFQEVSPWATFGHVAANGAILEAVDGEAKIHIVDISSTFCTQWPTLLEALATRSDDTPHLRLTT

SEQ ID NO: 3053 - protein, 96 aa, Arabidopsis thaliana
  G1767,2nd SCR domain
INCVGAMHGIASRGSPRDAVISSFRRLRPRIVTVVEEEADLVGEEEGGFDDEFLRGFGECLRWFRVCFESWEESFPRTSNERLMLERAAGRAIVDL

SEQ ID NO: 3054 - protein, 76 aa, Arabidopsis thaliana
  G1767,3rd SCR domain
CEPSDSTERRETARKWSRRMRNSGFGAVGYSDEVADDVRALLRRYKEGVWSMVQCPDAAGIFLCWRDQPVVWASAW

SEQ ID NO: 3055 - protein, 54 aa, Arabidopsis thaliana
  G1772,RING/C3HC4 domain
CDVCMEDLPGDHMTRMDCGHCFCNNCWTEHFTVQINEGQSKRIRCMAHQCNAIC

SEQ ID NO: 3056 - protein, 46 aa, Arabidopsis thaliana
  G1773,RING/C3HC4 domain
CGICFESYTRKEIARVSCGHPYCKTCWTGYITTKIEDGPGCLRVKC

SEQ ID NO: 3057 - protein, 124 aa, Arabidopsis thaliana
  G1777,RING/C3HC4 domain
CDICVEDVPGYQLTRMDCGHSFCNNCWTGHFTVKINEGQSKRIICMAHKCNAICDEDVVRALVSKSQPDLAEKFDRFLLESYIEDNKMVKWCPSTPHCGNAIRVEDDELCEVECSCGLQFCFSC

SEQ ID NO: 3058 - protein, 50 aa, Arabidopsis thaliana
  G1779,GATA/Zn domain
NGYNNDCVIRICSDCNTTKTPLWRSGPRGPKSLCNACGIRQRKARRAAMA

SEQ ID NO: 3059 - protein, 90 aa, Arabidopsis thaliana
  G1781,CAAT domain
KEQDRFLPIANVGRIMKKVLPGNGKISKDAKETVQECVSEFISFVTGEASDKCQREKRKTINGDDIIWAITTLGFEDYVAPLKVYLCKYR

SEQ ID NO: 3060 - protein, 60 aa, Arabidopsis thaliana
  G1782,CAAT domain
EPIFVNAKQYHAILRRRKHRAKLEAQNKLIKCRKPYLHESRHLHALKRARGSGGRFLNTK

SEQ ID NO: 3061 - protein, 189 aa, Arabidopsis thaliana
  G1784,PMR domain
SCDGLVCFYDTTRAVEVMNPATTMFIELPLSRIQQLCIYKPNPEVELEPVQDPNPVLDPVMTCSQIGVGKDSVSGSYKLVWMYNTSPATPPTCEVLDLDGKKWRFVNTTSLDHHQILCDQRPVFANGSLYWLTGDEEGYATTQTKLIVLDLHTEMFQVIQTPPFITRDASGDKIGLCNLDGRLCISELK

SEQ ID NO: 3062 - protein, 101 aa, Arabidopsis thaliana
  G1785,MYB-(R1)R2R3 domain
DKVNWTESEDIKLKEIMALGPKNKWTKVAKKFEGRTGKQCRERWYNHARPNIKKTAWSEEEDQILIEAHKVLGTKWVEIAQQLPGRSDNNIKNHWNTTKRR

SEQ ID NO: 3063 - protein, 51 aa, Arabidopsis thaliana
  G1789,MYB-related domain
GSWTVKQNKAFERALAVYDQDTPDRWHNVARAVGGKTPEEAKRQYDLLVRD

SEQ ID NO: 3064 - protein, 65 aa, Arabidopsis thaliana
  G1791,AP2 domain
NEMKYRGVRKRPWGKYAAEIRDSARHGARVWLGTFNTAEDAARAYDRAAFGMRGQRAILNFPHEY

SEQ ID NO: 3065 - protein, 77 aa, Arabidopsis thaliana
  G1793,1st AP2 domain
TSIYRGVTRHRWTGRYEAHLWDNSCRREGQSRKGRQVYLGGYDKEDKAARSYDLAALKYWGPSTTTNFPITNYEKEV

SEQ ID NO: 3066 - protein, 69 aa, Arabidopsis thaliana
  G1793,2nd AP2 domain
ASMYRGVTRHHQHGRWQARIGRVAGNKDLYLGTFSTEEEAAEAYDIAAIKFRGLNAVTNFEINRYDVKA

SEQ ID NO: 3067 - protein, 68 aa, Arabidopsis thaliana
  G1794,AP2 domain
RRRYRGVRQRPWGKWAAEIRDPFKAARVWLGTFDNAESAARAYDEAALRFRGNKAKLNFPENVKLVRP

SEQ ID NO: 3068 - protein, 68 aa, Arabidopsis thaliana
  G1796,AP2 domain
TTRYRGVRRRPWGRYAAEIRDPMSKERRWLGTFDTAEQAACAYDSAARAFRGAKARTNFTYPTAVIMP

SEQ ID NO: 3069 - protein, 57 aa, Arabidopsis thaliana
  G1797,MADS domain
MVRGKIEIKKIENVTSRQVTFSKRRSGLFKKAHELSVLCDAQVAAMIFSQKGRLYEF

SEQ ID NO: 3070 - protein, 57 aa, Arabidopsis thaliana
  G1798,MADS domain
MVRGKIEIKKIENVTSRQVTFSKRRSGLFKKAHELSVLCDAQVAAIVFSQSGRLHEY

SEQ ID NO: 3071 - protein, 51 aa, Arabidopsis thaliana
  G1804,bZIP domain
RRQRRMIKNRESAARSRARKQAYTVELEAELNQLKEENAQLKHALAELERK

SEQ ID NO: 3072 - protein, 61 aa, Arabidopsis thaliana
  G1806,bZIP domain
RTLRRLAQNREAARKSRLRKKAYVQQLENSRIRLAQLEEELKRARQQGSLVERGVSADHTH

SEQ ID NO: 3073 - protein, 61 aa, Arabidopsis thaliana
  G1808,bZIP domain
RKRKRMESNRESAKRSRMRKQSHIDNLREQVNRLDLENRELGNRLRLVLHQLQRVNSDNNR

SEQ ID NO: 3074 - protein, 14 aa, Arabidopsis thaliana
  G1809,bZIP domain
KMLINTRPKTDDNH

SEQ ID NO: 3075 - protein, 106 aa, Arabidopsis thaliana
  G1815,MYB-(R1)R2R3 domain
RGHWRISEDTQLMELVSVYGPQNWNHIAESMQGRTGKSCRLRWFNQLDPRINKRAFSDEEEERLLAAHRAFGNKWAMIAKLFNGRTDNALKNHWHVLMARKMRQQS

SEQ ID NO: 3076 - protein, 45 aa, Arabidopsis thaliana
  G1816,MYB-related domain
INMTEQEEDLIFRMYRLVGDRWDLIAGRVPGRQPEEIERYWIMRN

SEQ ID NO: 3077 - protein, 93 aa, Arabidopsis thaliana
  G1818,CAAT domain
KGMEGDLNVKNHEFPISRIKRIMKFDPDVSMIAAEAPNLLSKACEMFVMDLTMRSWLHAQESNRLTIRKSDVDAVVSQTVIFDFLRDDVPKDE

SEQ ID NO: 3078 - protein, 97 aa, Arabidopsis thaliana
  G1819,CAAT domain
QMGNATDVKHHAFPLTRIKKIMKSNPEVNMVTAEAPVLISKACEMLILDLTMRSWLHTVEGGRQTLKRSDTLTRSDISAATTRSFKFTFLGDVVPRD

SEQ ID NO: 3079 - protein, 64 aa, Arabidopsis thaliana
  G1820,CAAT domain
VHMVSAEAPIIFAKACEMFIVDLTMRSWLKAEENKRHTLQKSDISNAVASSFTYDFLLDVVPKD

SEQ ID NO: 3080 - protein, 90 aa, Arabidopsis thaliana
  G1821,CAAT domain
REQDRFMPIANVIRIMRRILPAHAKISDDSKETIQECVSEYISFITGEANERCQREQRKTITAEDVLWAMSKLGFDDYIEPLTLYLHRYR

SEQ ID NO: 3081 - protein, 48 aa, Arabidopsis thaliana
  G1823,GARP domain
WSIELHQQFVNAVNKLGIDKAVPKRILELMNVPGLSRENVASHLQKFR

SEQ ID NO: 3082 - protein, 49 aa, Arabidopsis thaliana
  G1825,GARP domain
WTPDLHLSFVRAVQRLGGPDRATPKLVLEMMNLKGLSIAHVKSHLQMYR

SEQ ID NO: 3083 - protein, 21 aa, Arabidopsis thaliana
  G1832,1st Z-C2H2 domain
CTECGKQFGSLKALFGHMRCH

SEQ ID NO: 3084 - protein, 17 aa, Arabidopsis thaliana
  G1832,2nd Z-C2H2 domain
CDGCKKVFGSHQALGGH

SEQ ID NO: 3085 - protein, 21 aa, Arabidopsis thaliana
  G1832,3rd Z-C2H2 domain
CNICSRVFSSGQALGGHMRCH

SEQ ID NO: 3086 - protein, 73 aa, Arabidopsis thaliana
  G1835,GATA/Zn domain
EQYPLRKCMHCEVTKTPQWRLGPMGPKTLCNACGVRYKSGRLFPEYRPAASPTFTPALHSNSHKKVAEMRNKR

SEQ ID NO: 3087 - protein, 87 aa, Arabidopsis thaliana
  G1836,CAAT domain
KEMEGNLDFKNHDLPITRIKKIMKYDPDVTMIASEAPILLSKACEMFIMDLTMRSWLHAQESKRVTLQKSNVDAAVAQTVIFDFLLD

SEQ ID NO: 3088 - protein, 53 aa, Arabidopsis thaliana
  G1837,1st BZIPT2 domain
MGIVASKGDSNTPLLNLCKERKELIKAARDARYHLARSHLLYFKSLLDFSKAL

SEQ ID NO: 3089 - protein, 110 aa, Arabidopsis thaliana
  G1837,2nd BZIPT2 domain
LSMTLEKLYMWEKKLHAEVTAEEKLRVAYEKAYKILNNLDQNGAESSELYEAETLVKLHLSKVNVSVRAVESISMRIHKIRDEELSFQVIEIINGFKTMWRFLAKCHHKQ

SEQ ID NO: 3090 - protein, 75 aa, Arabidopsis thaliana
  G1838,1st AP2 domain
SIYRGVTRHRWTGRYEAHLWDNSCRREGQARKGRQVYLGGYDKEDRAARAYDLAALKYWGSTATTNFPVSSYSKE

SEQ ID NO: 3091 - protein, 71 aa, Arabidopsis thaliana
  G1838,2nd AP2 domain
GASIYRGVTRHHQQGRWQARIGRVAGNKDLYLGTFATEEEAAEAYDIAAIKFRGINAVTNFEMNRYDIEAV

SEQ ID NO: 3092 - protein, 65 aa, Arabidopsis thaliana
  G1839,AP2 domain
EKKYKGVRKKPSGKWAAEIWDPRSKSRRWLGTFLTAEMAAQSYNDAAAEYRARRGKTNGEGIKRR

SEQ ID NO: 3093 - protein, 68 aa, Arabidopsis thaliana
  G1840,AP2 domain
EKKHKGVRKKPSGKWSAEIWDPSTRTRRWLGTFPTAEMAADAYDEAAAALVEKRSARRGSKKGEGSIH

SEQ ID NO: 3094 - protein, 68 aa, Arabidopsis thaliana
  G1841,AP2 domain
KRRYRGVRQRPWGKWAAEIRDPHRAARVWLGTFDTAEAAARAYDEAALRFRGNKAKLNFPEDVRILPP

SEQ ID NO: 3095 - protein, 56 aa, Arabidopsis thaliana
  G1842,MADS domain
GRRKVEIKRIENKSSRQVTFSKRRKGLIEKARQLSILCESSIAVVAVSGSGKLYDS

SEQ ID NO: 3096 - protein, 56 aa, Arabidopsis thaliana
  G1843,MADS domain
GRRKVEIKRIENKSSRQVTFCKRRNGLMEKARQLSILCESSVALIIISATGRLYSF

SEQ ID NO: 3097 - protein, 56 aa, Arabidopsis thaliana
  G1844,MADS domain
GRRRVEIKRIENKSSRQVTFCKRRNGLMEKARQLSILCGSSVALFIVSSTGKLYNS

SEQ ID NO: 3098 - protein, 68 aa, Arabidopsis thaliana
  G1846,AP2 domain
QPVYRGVRMRSWGKWVSEIREPRKKSRIWLGTFPTAEMAMRAHDVAAMSIKGTSAILNFPELSKLLPR

SEQ ID NO: 3099 - protein, 92 aa, Arabidopsis thaliana
  G1850,HS domain
PFLTKTYQLVEDPVYDELISWNEDGTTFIVWRPAEFARDLLPKYFKHNNFSSFVRQLNTYGFRKVVPDRWEFSNDCFKRGEKILLRDIQRRK

SEQ ID NO: 3100 - protein, 501 aa, Arabidopsis thaliana
  G1852,AKR domain
AHMPCEDPRRNSQLSREMNFYRERHCPLPEETPLCLIPPPSGYKIPVPWPESLHKIWHANMPYNKIADRKGHQGWMKREGEYFTFPGGGTMFPGGAGQYIEKLAQYIPLNGGTLRTALDMGCGVASFGGTLLSQGILALSFAPRDSHKSQIQFALERGVPAFVAMLGTRRLPFPAYSFDLMHCSRCLIPFTAYNATYFIEVDRLLRPGGYLVISGPPVQWPKQDKEWADLQAVARALCYELIAVDGNTVIWKKPVGDSCLPSQNEFGLELCDESVPPSDAWYFKLKRCVTRPSSVKGEHALGTISKWPERLTKVPSRAIVMKNGLDVFEADARRWARRVAYYRDSLNLKLKSPTVRNVMDMNAFFGGFAATLASDPVWVMNVIPARKPLTLDVIYDRGLIGVYHDWCEPFSTYPRTYDFIHVSGIESLIKRQDSSKSRCSLVDLMVEMDRILRPEGKVVIRDSPEVLDKVARMAHAVRWSSSIHEKEPESHGREKILIATK

SEQ ID NO: 3101 - protein, 512 aa, Arabidopsis thaliana
  G1855,AKR domain
EYTPCEDRQRGRRFDRNMMKYRERHCPVKDELLYCLIPPPPNYKIPFKWPQSRDYAWYDNIPHKELSVEKAVQNWIQVEGDRFRFPGGGTMFPRGADAYIDDIARLIPLTDGGIRTAIDTGCGVASFGAYLLKRDIMAVSFAPRDTHEAQVQFALERGVPAIIGIMGSRRLPYPARAFDLAHCSRCLIPWFKNDGLYLMEVDRVLRPGGYWILSGPPINWKQYWRGWERTEEDLKKEQDSIEDVAKSLCWKKVTEKGDLSIWQKPLNHIECKKLKQNNKSPPICSSDNADSAWYKDLETCITPLPETNNPDDSAGGALEDWPDRAFAVPPRIIRGTIPEMNAEKFREDNEVWKERIAHYKKIVPELSHGRFRNIMDMNAFLGGFAASMLKYPSWVMNVVPVDAEKQTLGVIYERGLIGTYQDWCEGFSTYPRTYDMIHAGGLFSLYEHRCDLTLILLEMDRILRPEGTVVLRDNVETLNKVEKIVKGMKWKSQIVDHEKGPFNPEKILVAVK

SEQ ID NO: 3102 - protein, 112 aa, Arabidopsis thaliana
  G1863,GRF-like domain
FFSWAQWQELELQALIYRYMLAGAAVPQELLLPIKKSLLHLSPSYFLHHPLQHLPHYQPAWYLGRAAMDPEPGRCRRTDGKKWRCSRDVFAGHKYCERHMHRGRNRSRKPVE

SEQ ID NO: 3103 - protein, 118 aa, Arabidopsis thaliana
  G1865,GRF-like domain
PFTESQWEELENQALVFKYLAANMPVPPHLLFLIKRPFLFSSSSSSSSSSSFFSPTLSPHFGWNVYEMGMGRKIDAEPGRCRRTDGKKWRCSKEAYPDSKYCERHMHRGKNRSSSRKP

SEQ ID NO: 3104 - protein, 107 aa, Arabidopsis thaliana
  G1868,GRF-like domain
PFTLTQWAELEQQALIYKYITANVPVPSSLLISIKKSFYPYGSLPPSSFGWGTFHLGFAGGNMDPEPGRCRRTDGKKWRCSRDAVPDQKYCERHINRGRHRSRKPVE

SEQ ID NO: 3105 - protein, 21 aa, Arabidopsis thaliana
  G1880,1st Z-C2H2 domain
CEICNQGFQRDQNLQMHRRRH

SEQ ID NO: 3106 - protein, 29 aa, Arabidopsis thaliana
  G1880,2nd Z-C2H2 domain
CPEPTCLHHNPCHALGDLVGIKKHFRRKH

SEQ ID NO: 3107 - protein, 29 aa, Arabidopsis thaliana
  G1884,Z-Dof domain
CPRCDSVNTKFCYYNNYSLSQPRHYCKNC

SEQ ID NO: 3108 - protein, 46 aa, Arabidopsis thaliana
  G1888,Z-CO-like domain
CAVCDKEEASVFCCADEAALCNGCDRHVHFANKLAGKHLRFSLTSP

SEQ ID NO: 3109 - protein, 113 aa, Arabidopsis thaliana
  G1893,Z-C2H2 domain
IHKHQEPTANHHEYYFMETTETSSNSNFLDQCQDSYRHDVTVDLHLGLPNLGDGGSSSSDVVLDSTDHQEGHHDHHQDQGLEVTMASDHDDEHGGLQRGNHLHHFWIPTPSQI

SEQ ID NO: 3110 - protein, 43 aa, Arabidopsis thaliana
  G1895,Z-Dof domain
CPRCNSADTKFCYYNNYNVNQPRHFCRKCQRYWTAGGSMRIVP

SEQ ID NO: 3111 - protein, 29 aa, Arabidopsis thaliana
  G1897,Z-Dof domain
CPRCESTNTKFCYYNNYNFSQPRHFCKSC

SEQ ID NO: 3112 - protein, 53 aa, Arabidopsis thaliana
  G1900,Z-Dof domain
LPCPRCNSMETKFCYYNNYNVNQPRHFCKACQRYWTSGGTMRSVPIGAGRRKN

SEQ ID NO: 3113 - protein, 29 aa, Arabidopsis thaliana
  G1902,Z-Dof domain
CPRCDSPNTKFCYYNNYNLSQPRHFCKSC

SEQ ID NO: 3114 - protein, 47 aa, Arabidopsis thaliana
  G1903,Z-Dof domain
CPRCESANTKFCYYNNYNVNQPRYFCRNCQRYWTAGGSMRNVPVGSG

SEQ ID NO: 3115 - protein, 29 aa, Arabidopsis thaliana
  G1909,Z-Dof domain
CPRCDSSNTKFCYYNNYNLTQPRHFCKGC

SEQ ID NO: 3116 - protein, 51 aa, Arabidopsis thaliana
  G1911,MYB-related domain
GSWTAKQNKAFEQALATYDQDTPNRWQNVAKVVGGKTTEEVKRHYELLVQD

SEQ ID NO: 3117 - protein, 27 aa, Arabidopsis thaliana
  G1917,GATA/Zn domain
CANCDTTSTPLWRNGPRGPKSLCNACG

SEQ ID NO: 3118 - protein, 74 aa, Arabidopsis thaliana
  G1919,RING/C3HC4 domain
CWRCRLESHRPVSCNKASDWLCSATMKISDESFSLYPTKTKTVTCPHCLCSLESDTKMPQFLTCVCRLRFCSRC

SEQ ID NO: 3119 - protein, 172 aa, Arabidopsis thaliana
  G1927,NAC domain
APGFRFHPTDEELVVYYLKRKICCKKLRVNAIGVVDVYKVDPSELPGLSMLKTGDRQWFFFTPRNRKYPNAARSSRGTATGYWKATGKDRVIEYNSRSVGLKKTLVFYRGRAPNGERTDWVMHEYTMDEEELGRCKNAKEYYALYKLYKKSGAGPKNGEQYGAPFQEEEWVD

SEQ ID NO: 3120 - protein, 21 aa, Arabidopsis thaliana
  G1928,1st Z-C2H2 domain
CEICNKGFQRDQNLQLHRRGH

SEQ ID NO: 3121 - protein, 21 aa, Arabidopsis thaliana
  G1928,2nd Z-C2H2 domain
CDKCSKKYAVQSDCKAHSKTC

SEQ ID NO: 3122 - protein, 23 aa, Arabidopsis thaliana
  G1929,Z-CO-like domain
CELCDGDASVFCEADSAFLCRKC

SEQ ID NO: 3123 - protein, 66 aa, Arabidopsis thaliana
  G1930 AP2 domain
SSRFKGVVPQPNGRWGAQIYEKHQRVWLGTFNEEDEAARAYDVAAHRFRGRDAVTNFKDTTFEEEV

SEQ ID NO: 3124 - protein, 95 aa, Arabidopsis thaliana
  G1930 B3 domain
AELLFEKTVTPSDVGKLNRLVIPKHQAEKHFPLPLGNNNVSVKGMLLNFEDVNGKVWRFRYSYWNSSQSYVLTKGWSRFVKEKRLCAGDLISFKR

SEQ ID NO: 3125 - protein, 63 aa, Arabidopsis thaliana
  G1932,AP2 domain
EVHYRGVRKRPWGRYAAEIRDPWKKTRVWLGTFDTPEEAALAYDGAARFLRGIKAKTNFPSPL

SEQ ID NO: 3126 - protein, 57 aa, Arabidopsis thaliana
  G1935,MADS domain
MGRVKLELKRIEKSTNRQITFSKRKKGLIKKAYELSTLCDIDLALLMFSPSDRLCLF

SEQ ID NO: 3127 - protein, 66 aa, Arabidopsis thaliana
  G1936,PCF domain
KKKPNKDRHLKVEGRGRRVRLPPLCAARIYQLTKELGHKSDGETLEWLLQHAEPSILSATVNGIKP

SEQ ID NO: 3128 - protein, 70 aa, Arabidopsis thaliana
  G1938,PCF domain
KRSSNKDRHTKVEGRGRRIRMPALCAARIFQLTRELGHKSDGETIQWLLQQAEPSIIAATGSGTIPASAL

SEQ ID NO: 3129 - protein, 9 aa, Arabidopsis thaliana
  G1944,AT-hook domain
KKKRGRPRK

SEQ ID NO: 3130 - protein, 92 aa, Arabidopsis thaliana
  G1946,HS domain
PFLSKTYDMVDDHNTDSIVSWSANNNSFIVWKPPEFARDLLPKNFKHNNFSSFVRQLNTYGFRKVDPDRWEFANEGFLRGQKHLLQSITRRK

SEQ ID NO: 3131 - protein, 92 aa, Arabidopsis thaliana
  G1947,HS domain
AFLTKTYNIVEDSSTNNIVSWSRDNNSFIVWEPETFALICLPRCFKHNNFSSFVRQLNTYGFKKIDTERWEFANEHFLKGERHLLKNIKRRK

SEQ ID NO: 3132 - protein, 366 aa, Arabidopsis thaliana; identical to SEQ ID NO: 1292
  G1948,AKR domain

SEQ ID NO: 3133 - protein, 164 aa, Arabidopsis thaliana
  G1950,AKR domain
LLSSSDEAKTVINSKDDEGWAPLHSAASIGNAELVEVLLTRGADVNAKNNGGRTALHYAASKGRLEIAQLLLTHGAKINITDKVGCTPLHRAASVGKLEVCEFLIEEGAEIDATDKMGQTALMHSVICDDKQVAFLLIRHGADVDVEDKEGYTVLGRATNEFRP

SEQ ID NO: 3134 - protein, 60 aa, Arabidopsis thaliana
  G1954,HLH/MYC domain
EVESQRMTHIAVERNRRKQMNEHLRVLRSLMPGSYVQRGDQASIIGGAIEFVRELEQLLQ

SEQ ID NO: 3135 - protein, 92 aa, Arabidopsis thaliana
  G1957,ABI3/VP-1 domain
KEHMFDKVVTPSDVGKLNRLVIPKQHAERYFPLDSSNNQNGTLLNFQDRNGKMWRFRYSYWNSSQSYVMTKGWSRFVKEKKLDAGDIVSFQR

SEQ ID NO: 3136 - protein, 49 aa, Arabidopsis thaliana
  G1958,GARP domain
WTPELHEAFVEAVNSLGGSERATPKGVLKIMKVEGLTIYHVKSHLQKYR

SEQ ID NO: 3137 - protein, 29 aa, Arabidopsis thaliana
  G1965,Z-Dof domain
CARCDSDNTKFCYYNNYSEFQPRYFCKNC

SEQ ID NO: 3138 - protein, 21 aa, Arabidopsis thaliana
  G1968,1st Z-C2H2 domain
NPKKNKRFVDHRQIMALKQQQ

SEQ ID NO: 3139 - protein, 23 aa, Arabidopsis thaliana
  G1968,2nd Z-C2H2 domain
DSCADTNRTIKIHSKSPMVKKAN

SEQ ID NO: 3140 - protein, 77 aa, Arabidopsis thaliana
  G1983,Z-C3H domain
DSDSDDPYASDHFRMFEFKIRRCTRSRSHDWTDCPFAHPGEKARRRDPRRFQYSGEVCPEFRRGGDCSRGDDCEFAH

SEQ ID NO: 3141 - protein, 21 aa, Arabidopsis thaliana
  G1985,Z-C2H2 domain
CSFCIRGFSNAQALGGHMNIH

SEQ ID NO: 3142 - protein, 21 aa, Arabidopsis thaliana
  G1990,1st Z-C2H2 domain
CKTCDRTFPSFQALGGHRASH

SEQ ID NO: 3143 - protein, 23 aa, Arabidopsis thaliana
  G1990,2nd Z-C2H2 domain
HECGICGAEFTSGQALGGHMRRH

SEQ ID NO: 3144 - protein, 21 aa, Arabidopsis thaliana
  G1993,Z-C2H2 domain
CEFCERGFSNAQALGGHMNIH

SEQ ID NO: 3145 - protein, 21 aa, Arabidopsis thaliana
  G1995,Z-C2H2 domain
CHYCFRNFPTSQALGGHQNAH

SEQ ID NO: 3146 - protein, 67 aa, Arabidopsis thaliana
  G1998,Z-CO-like domain
CDHCATSQALIYCKSDLAKLCLNCDVHVHSANPLSHRHIRSLICEKCFSQPAAIRCLDEKVSYCQGC

SEQ ID NO: 3147 - protein, 41 aa, Arabidopsis thaliana
  G1999,Z-CO-like domain
CELCLNKHAVWYCASDDAFLCHVCDESVHSANHVATKHERV

SEQ ID NO: 3148 - protein, 105 aa, Arabidopsis thaliana
  G2007,MYB-(R1)R2R3 domain
KGPWTAEEDKKLINFILTNGHCCWRALPKLAGLRRCGKSCRLRWTNYLRPDLKRGLLSDAEEQLVIDLHALLGNRWSKIAARLPGRTDNEIKNHWNTHIKKKLLK

SEQ ID NO: 3149 - protein, 75 aa, Arabidopsis thaliana
  G2010,SBP domain
LCQVDRCTADMKEAKLYHRRHKVCEVHAKASSVFLSGLNQRFCQQCSRFHDLQEFDEAKRSCRRRLAGHNERRRK

SEQ ID NO: 3150 - protein, 92 aa, Arabidopsis thaliana
  G2011,HS domain
PFLSKTFDLVDDPTLDPVISWGLTGASFVVWDPLEFARIILPRNFKHNNFSSFVRQLNTYGFRKIDTDKWEFANEAFLRGKKHLLKNIHRRR

SEQ ID NO: 3151 - protein, 101 aa, Arabidopsis thaliana
  G2030,AKR domain
DGLTPLHCAAVSNSIKILKVFSHKTPSSFDILTQPHNETVFHLAVRHKNLKAFKFMAQKVHLEKLLYKPDKYGNTVLHTAASLGSTSLAEYIINETKIHTK

SEQ ID NO: 3152 - protein, 202 aa, Arabidopsis thaliana
  G2035,AKR domain
AGETAVYISAAENLEDIFRYLIRFSSLETVKIRSKSDMNAFHVAAKRGHLGIVKELLRLWPELCRICDASNTSPLYAAAVQDHLEIVNAMLDVDPSCAMIVRKNGKTSLHTAGRYGLLRIVKALIEKDAAIVGVKDKKGQTALHMAVKGRSLEVVEEILQADYTILNERDRKGNTALHIATRKARPQITSLLLTFTAIEVNA

SEQ ID NO: 3153 - protein, 237 aa, Arabidopsis thaliana
  G2041,1st SWI/SNF domain
LKRKLHLHQKKAFEFLWKNLAGSVVPAMMDPSSDKIGGCVVSHTPGAGKTFLIIAFLASYLKIFPGKRPLVLAPKTTLYTWYKEFIKWEIPVPVHLLHGRRTYCMSKEKTIQFEGIPKPSQDVMHVLDCLDKIQKWHAQPSVLVMGYTSFLTLMREDSKFAHRKYMAKVLRESPGLLVLDEGHNPRSTKSRLRKALMKVDTDLRILLSGTLFQNNFCEYFNTLCLARPKFVHEVLVE

SEQ ID NO: 3154 - protein, 86 aa, Arabidopsis thaliana
  G2041,2nd SWI/SNF domain
ELFENVFRWKRGRELLTLTGDLELFERGRVIDKFEEPGGQSRVLLASITACAEGISLTAASRVIMLDSEWNPSKTKQAIARAFRPG

SEQ ID NO: 3155 - protein, 152 aa, Arabidopsis thaliana
  G2051,NAC domain
PPGFRFYPTDEELVGYYLHRRNEGLEIELEIIPLMDLYKFDPWELPEKSFLPNRDMEWFFFCHRDRKYQNGSRINRATKSGYWKATGKDRKIVCHSSSSSSSSSITGCRKTLVFYMGRAPFGGRTEWVMHEYRLFDNDTSQGSLNFKGDFAL

SEQ ID NO: 3156 - protein, 152 aa, Arabidopsis thaliana
  G2052,NAC domain
PPGFRFHPTDEELIEYYLKRKVEGLEIELEVIPVIDLYSFDPWELPDKSFLPNRDMEWYFFCSRDKKYPNGFRTNRGTKAGYWKATGKDRKITSRSSSIIGYRKTLVFYKGRAPLGDRSNWIMHEYRLCDDDTSQGSQNLKGAFVLCRVAMK

SEQ ID NO: 3157 - protein, 147 aa, Arabidopsis thaliana
  G2053,NAC domain
GLRFRPTDKEIVVDYLRPKNSDRDTSHVDRVISTVTIRSFDPWELPCQSRIKLKDESWCFFSPKENKYGRGDQQIRKTKSGYWKITGKPKPILRNRQEIGEKKVLMFYMSKELGGSKSDWVMHEYHAFSPTQMMMTYTICKVMFKGD

SEQ ID NO: 3158 - protein, 58 aa, Arabidopsis thaliana
  G2057,TEO domain
KDRHSKVCTAKGPRDRRVRLSAHTAIQFYDVQDRLGFDRPSKAVDWLIKKAKTSIDEL

SEQ ID NO: 3159 - protein, 68 aa, Arabidopsis thaliana
  G2059,AP2 domain
TKLYRGVRQRHWGKWVAEIRLPRNRTRVWLGTFETAEQAAMAYDTAAYILRGEFAHLNFPDLKHQLKS

SEQ ID NO: 3160 - protein, 60 aa, Arabidopsis thaliana
  G2060,WRKY domain
DGCQWRKYGQKTAKTNPLPRAYYRCSMSSNCPVRKQVQRCGEEETSAFMTTYEGNHDHPL

SEQ ID NO: 3161 - protein, 57 aa, Arabidopsis thaliana
  G2063,MADS domain
KGKQKINIKKIEKDEGRSVTFSKRLNGIYTKISELSILCGVEVAFIGYSCSGKPYTF

SEQ ID NO: 3162 - protein, 63 aa, Arabidopsis thaliana
  G2067,AP2 domain
IKKYKGVRMRSWGSWVTEIRAPNQKTRIWLGSYSTAEAAARAYDAALLCLKGPKANLNFPNIT

SEQ ID NO: 3163 - protein, 93 aa, Arabidopsis thaliana
  G2070,bZIP domain
VPVDDKKRRRTISNRESAKRSRMKKKKRFEELTEEVNRLNIRNQELKNRLANVVSCGNFISRENNRLKTESVCLEIRLLELYRFLVAMQSPIS

SEQ ID NO: 3164 - protein, 52 aa, Arabidopsis thaliana
  G2071,bZIP domain
LEKVVERRQKRMIKNRESAARSRARKQAYTLELEAEIESLKLVNQDLQKKQA

SEQ ID NO: 3165 - protein, 60 aa, Arabidopsis thaliana
  G2072,bZIP domain
QNAHRARLRRLEYISDLERTIQVLQVEGCEMSSAIHYLDQQLLMLSMENRALKQRMDSLA

SEQ ID NO: 3166 - protein, 132 aa, Arabidopsis thaliana
  G2084,RING/C3HC4 domain
ELESVSEWEDVRCVICMEPPHNAVLLQCSSFSKGCRAYMCDTSARHSNCFKQYRRSNSSSRCSGKTLHCPYCRGEVQGTMKSTCARRFMNARPRCCTVDKCDFSGTYAQLKNHLKTEHPGFTPPKLDPWEQH

SEQ ID NO: 3167 - protein, 28 aa, Arabidopsis thaliana
  G2085,GATA/Zn domain
CTHCGISSKCTPMMRRGPSGPRTLCNAC

SEQ ID NO: 3168 - protein, 26 aa, Arabidopsis thaliana
  G2094,GATA/Zn domain
CAICGTSKTPLWRGGPAGPKSLCNAC

SEQ ID NO: 3169 - protein, 54 aa, Arabidopsis thaliana
  G2105,TH domain
VRSRLDHKFKEANQKGPLWDEVSRIMSEEHGYTRSGKKCREKFENLYKYYKKTK

SEQ ID NO: 3170 - protein, 84 aa, Arabidopsis thaliana
  G2106,1st AP2 domain
SSVHRGVTRHRWTGRYEAHLWDKNSWNETQTKKGRQVYLGAYDEEDAAARAYDLAALKYWGRDTILNFPVNFLGILLCNYEEDI

SEQ ID NO: 3171 - protein, 69 aa, Arabidopsis thaliana
  G2106,2nd AP2 domain
VSKYRGVAKHHHNGRWEARIGRVFGNKYLYLGTYATQEEAAIAYDIAAIEYRGLNAVTNFDISRYLKLP

SEQ ID NO: 3172 - protein, 68 aa, Arabidopsis thaliana
  G2107,AP2 domain
HPIYRGVRRRDGDKWVCEVREPIHQRRVWLGTYPTADMAARAHDVAVLALRGRSACLNFSDSAWRLPV

SEQ ID NO: 3173 - protein, 68 aa, Arabidopsis thaliana
  G2108,AP2 domain
EGKYLGVRRRPWGRYAAEIRNPFTKERHWLGTFDTAEEAAFAYDVAARSISGSLATTNFFYTENTSLE

SEQ ID NO: 3174 - protein, 57 aa, Arabidopsis thaliana
  G2109,MADS domain
MGRVKLKIKRLESTSNRQVTYTKRKNGILKKAKELSILCDIDIVLLMFSPTGRATAF

SEQ ID NO: 3175 - protein, 60 aa, Arabidopsis thaliana
  G2110,WRKY domain
NDGCQWRKYGQKIAKGNPCPRAYYRCTIAASCPVRKQVQRCSEDMSILISTYEGTHNHPL

SEQ ID NO: 3176 - protein, 57 aa, Arabidopsis thaliana
  G2111,MADS domain
MTRKKLNLSYITNESMRKATFNKRKKGLVKKIHELSVLCGIEACAVIYSPFNSNPEV

SEQ ID NO: 3177 - protein, 68 aa, Arabidopsis thaliana
  G2113,AP2 domain
AARAYDKRAIEFRGAKAKTNFPCYNINAHCLSLTQSLSQSSTVESSFPNLNLGSDSVSSRFPFPKIQV

SEQ ID NO: 3178 - protein, 75 aa, Arabidopsis thaliana
  G2114,1st AP2 domain
TSQYRGVTRHRWTGRYEAHLWDNSCKKEGQTRRGRQVYLGGYDEEEKAARAYDLAALKYWGPTTHLNFPLSNYEK

SEQ ID NO: 3179 - protein, 71 aa, Arabidopsis thaliana
  G2114,2nd AP2 domain
ASVYRGVTRHHQHGRWQARIGRVAGNKDLYLGTFSTQEEAAEAYDIAAIKFRGLNAVTNFDINRYDVKRIC

SEQ ID NO: 3180 - protein, 67 aa, Arabidopsis thaliana
  G2115,AP2 domain
IKKYKGVRMRSWGSWVSEIRAPNQKTRIWLGSYSTAEAAARAYDVALLCLKGPQANLNFPTSSSSHH

SEQ ID NO: 3181 - protein, 61 aa, Arabidopsis thaliana
  G2116,bZIP domain
KRAKRILANRQSAARSKERKARYIQELERKVQSLQTEATTLSAQLTLYQRDTNGLANENTE

SEQ ID NO: 3182 - protein, 61 aa, Arabidopsis thaliana
  G2117,bZIP domain
ERKRRRKVSNRESARRSRMRKQRHMEELWSMLVQLINKNKSLVDELSQARECYEKVIEENM

SEQ ID NO: 3183 - protein, 11 aa, Arabidopsis thaliana
  G2123,GF14 domain
VKGDYFRYMAE

SEQ ID NO: 3184 - protein, 58 aa, Arabidopsis thaliana
  G2124,TEO domain
KDRHSKVCTLRGLRDRRVRLSVPTAIQLYDLQERLGVDQPSKAVDWLLDAAKEEIDEL

SEQ ID NO: 3185 - protein, 70 aa, Arabidopsis thaliana
  G2129,bZIP domain
ERKKKRKLSNRESAKRSREKKQKHLEEMSIQLNQLKIQNQELKNQLRYVLYHCQRTKMENDRLLMEHRIL

SEQ ID NO: 3186 - protein, 69 aa, Arabidopsis thaliana
  G2130,AP2 domain
KPKKYRGVRQRPWGKFAAEIRDPSSRTRIWLGTFVTAEEAAIAYDRAAIHLKGPKALTNFLTPPTPTPV

SEQ ID NO: 3187 - protein, 72 aa, Arabidopsis thaliana
  G2131,1st AP2 domain
SSPYRGVTRHRWTGRYEAHLWDKNSWNDTQTKKGRQVYLGAYDEEEAAARAYDLAALKYWGRDTLLNFPLPS

SEQ ID NO: 3188 - protein, 72 aa, Arabidopsis thaliana
  G2131,2nd AP2 domain
SGFSRGVSKYRGVARHHHNGRWEARIGRVFGNKYLYLGTYATQEEAAIAYDIAAIEYRGLNAVTNFDVSRYL

SEQ ID NO: 3189 - protein, 68 aa, Arabidopsis thaliana
  G2132,AP2 domain
SSGFKGVRRRPWGKFAAEIRNPFEKKRKWLGTFPTEEEAAEAYQKSKREFDERLGLVKQEKDLVDLTK

SEQ ID NO: 3190 - protein, 58 aa, Arabidopsis thaliana
  G2136,MADS domain
GRQKIEIKEIMLETRRQVTFSKRRSGLFKKAAELSVLCGAQIGIITFSRCDRIYSFGN

SEQ ID NO: 3191 - protein, 60 aa, Arabidopsis thaliana
  G2137,WRKY domain
TKKMDLEMFLGVQGKRCVDITSKARKRGAERSPSMEREIGLSLSLEKKQKQEESKEAVQS

SEQ ID NO: 3192 - protein, 73 aa, Arabidopsis thaliana
  G2138,AP2 domain
EKKYRGVRQRPWGKWVAEIRCGRGACKGRRDRLWLGTFNTAEEAALAYDNASIKLIGPHAPTNFGLPAENQED

SEQ ID NO: 3193 - protein, 58 aa, Arabidopsis thaliana
  G2140,HLH/MYC domain
KALAASKSHSEAERRRRERINNHLAKLRSILPNTTKTDKASLLAEVIQHVKELKRETS

SEQ ID NO: 3194 - protein, 59 aa, Arabidopsis thaliana
  G2141,HLH/MYC domain
RRGQATNSHSLAERVRREKISERMKFLQDLVPGCNKVTGKAVMLDEIINYVQSLQRQVE

SEQ ID NO: 3195 - protein, 59 aa, Arabidopsis thaliana
  G2142,HLH/MYC domain
KASAIRSKHSVTEQRRRSKINERFQILRELIPNSEQKRDTASFLLEVIDYVQYLQEKVQ

SEQ ID NO: 3196 - protein, 58 aa, Arabidopsis thaliana; identical to SEQ ID NO: 2850
  G2143,HLH/MYC domain

SEQ ID NO: 3197 - protein, 59 aa, Arabidopsis thaliana
  G2144,HLH/MYC domain
RRGQATDSHSLAERARREKINARMKLLQELVPGCDKIQGTALVLDEIINHVQSLQRQVE

SEQ ID NO: 3198 - protein, 58 aa, Arabidopsis thaliana
  G2145,HLH/MYC domain
TKGTATDPQSLYARKRREKINERLKTLQNLVPNGTKVDISTMLEEAVHYVKFLQLQIK

SEQ ID NO: 3199 - protein, 58 aa, Arabidopsis thaliana
  G2146,HLH/MYC domain
LAAAIRGSGGSGRRRKLSAVGNRVRVLGGLVPGCRRTALPELLDETADYIAALEMQVR

SEQ ID NO: 3200 - protein, 58 aa, Arabidopsis thaliana
  G2147,HLH/MYC domain
RRGRAAAIHNESERRRRDRINQRMRTLQKLLPTASKADKVSILDDVIEHLKQLQAQVQ

SEQ ID NO: 3201 - protein, 59 aa, Arabidopsis thaliana
  G2150,HLH/MYC domain
RRGQATDSHSLAERARREKISERMTLLQDLVPGCNRITGKAVMLDEIINYVQSLQRQVE

SEQ ID NO: 3202 - protein, 9 aa, Arabidopsis thaliana
  G2153 AT-hook domain
RRPRGRPAG

SEQ ID NO: 3203 - protein, 152 aa, Arabidopsis thaliana
  G2153 2nd conserved domain
GSKNKPKPPIFVTRDSPNALKSHVMEIASGTDVIETLATFARRRQRGICILSGNGTVANVTLRQPSTAAVAAAPGGAAVLALQGRFEILSLTGSFLPGPAPPGSTGLTIYLAGGQGQVVGGSVVGPLMAAGPVMLIAATFSNATYERLPLEE

SEQ ID NO: 3204 - protein, 9 aa, Arabidopsis thaliana
  G2155,AT-hook domain
GRPRGRPRG

SEQ ID NO: 3205 - protein, 9 aa, Arabidopsis thaliana
  G2156 AT-hook domain
KRPRGRPPG

SEQ ID NO: 3206 - protein, 153 aa, Arabidopsis thaliana
  G2156 2nd conserved domain
GSKNKPKPPVIVTRDSPNVLRSHVLEVSSGADIVESVTTYARRRGRGVSILSGNGTVANVSLRQPATTAAHGANGGTGGVVALHGRFEILSLTGTVLPPPAPPGSGGLSIFLSGVQGQVIGGNVVAPLVASGPVILMAASFSNATFERLPLED

SEQ ID NO: 3207 - protein, 9 aa, Arabidopsis thaliana
  G2157 AT-hook domain
RRPRGRPPG

SEQ ID NO: 3208 - protein, 145 aa, Arabidopsis thaliana
  G2157 2nd conserved domain
GSKNKPKSPVVVTKESPNSLQSHVLEIATGADVAESLNAFARRRGRGVSVLSGSGLVTNVTLRQPAASGGVVSLRGQFEILSMCGAFLPTSGSPAAAAGLTIYLAGAQGQVVGGGVAGPLIASGPVIVIAATFCNATYERLPIEE

SEQ ID NO: 3209 - protein, 131 aa, Arabidopsis thaliana
  G2184,NAC domain
APGFRFHPTDEELVMYYLKRKICRKRLRVNVIGVVDVYKMDPEELPGQSMLKTGDRQWFYFTPRSRKYPNAARSNRGTENGYWKATGKDRVIEYNSRSVGLKKTLVFYRGRAPSGERTDWVMHEYTMDEDE

SEQ ID NO: 3210 - protein, 101 aa, Arabidopsis thaliana
  G2192,bZIP-NIN domain
YFTGSLKDAAKSLGVCPTTMKRICRQHGISRWPSRKIKKVNRSITKLKRVIESVQGTDGGLDLTSMAVSSIPWTHGQTSAQPLNSPNGSKPPELPNTNNSP

SEQ ID NO: 3211 - protein, 48 aa, Arabidopsis thaliana
  G2207,1st bZIP-NIN domain
AGLPGRVFLGKLPEWTPDVRFFKSEEYPRVHHAQDCDVRGTLAIPVFE

SEQ ID NO: 3212 - protein, 82 aa, Arabidopsis thaliana
  G2207,2nd bZIP-NIN domain
MMAEKKRTKADKTITLDVLRQYFAGSLKDAAKNIGVCPTTLKRICRQHGIQRWPSRKIKKVGHSLQKIQRVIDSVQGVSGPL

SEQ ID NO: 3213 - protein, 50 aa, Arabidopsis thaliana
  G2213,bZIP-NIN domain
FFDRPIMKAAKELNVGLTVLKKRCRELGIYRWPHRKLKSLNSLIKNLKNV

SEQ ID NO: 3214 - protein, 97 aa, Arabidopsis thaliana
  G2215,bZIP-NIN domain
QAAIALNVGLTLLKRRCRELGIRRWPHRKLMSLNTLISNVKELQKMEGEENAEKLQDALEMLEKEKRTIEDLPDLEFKDKTKRLRQACFKANHKRKK

SEQ ID NO: 3215 - protein, 42 aa, Arabidopsis thaliana
  G2226,RING/C3H2C3 domain
CSVCLSKFQGDSEINKLKCGHLFHKTCLEKWIDYWNITCPLC

SEQ ID NO: 3216 - protein, 41 aa, Arabidopsis thaliana
  G2227,RING/C3H2C3 domain
CAVCTEIFETETEAREMPCKHLFHDDCIVPWLSIRNSCPVC

SEQ ID NO: 3217 - protein, 42 aa, Arabidopsis thaliana
  G2239,RING/C3H2C3 domain
CAICLNEFEDDETLRLLPKCDHVFHPHCIDAWLEAHVTCPVC

SEQ ID NO: 3218 - protein, 44 aa, Arabidopsis thaliana
  G2251,RING/C3H2C3 domain
CAVCLYDFENDDEIRRLTNCRHIFHRGCLDRWMMGYNQMTCPLC

SEQ ID NO: 3219 - protein, 42 aa, Arabidopsis thaliana
  G2269,RING/C3H2C3 domain
CSICLCEYMEEEMLRMMPECKHYFHVYCLDAWLKLNGSCPVC

SEQ ID NO: 3220 - protein, 59 aa, Arabidopsis thaliana
  G2290,WRKY domain
EDGYRWRKYGQKAVKNSPFPRSYYRCTNSRCTVKKRVERSSDDPSIVITTYEGQHCHQT

SEQ ID NO: 3221 - protein, 68 aa, Arabidopsis thaliana
  G2291,AP2 domain
TGGFMGVRKRPWGRWSAEIRDRIGRCRHWLGTFDTAEEAARAYDAAARRLRGTKAKTNFVIPPLFPKE

SEQ ID NO: 3222 - protein, 64 aa, Arabidopsis thaliana
  G2294,AP2 domain
MKKYKGVRMRSWGSWVSEIRAPNQKTRIWLGSYSTAEAAARAYDAALLCLKGSSANNLNFPEIS

SEQ ID NO: 3223 - protein, 57 aa, Arabidopsis thaliana
  G2295,MADS domain
MVPKVVDLQRIANDKTRITTYKKRKASLYKKAQEFSTLCGVETCLIVYGPTKATDVV

SEQ ID NO: 3224 - protein, 61 aa, Arabidopsis thaliana
  G2296,WRKY domain
IDGFIWRKYGQKTIKTSPHQRWYYRCAYAKDQNCDATKRVQKIQDNPPVYRNTYVGQHACE

SEQ ID NO: 3225 - protein, 67 aa, Arabidopsis thaliana
  G2298,AP2 domain
SPKYTGVRKRKWGKWVAEIRLPNSRDRIWLGSFDSAEKAARAFDAALYCLRGPGARFNFPDNPPEIP

SEQ ID NO: 3226 - protein, 49 aa, Arabidopsis thaliana
  G2311,MYB-related domain
LKWTAEEEEALLAGIRKHGPGKWKNILRDPEFADQLIHRSNIDLKDKWR

SEQ ID NO: 3227 - protein, 49 aa, Arabidopsis thaliana
  G2313,MYB-related domain
NPWTEEEHRLFLQGLKKYGEGASTLTSTNFVKTKTPRQVSSHAQYYKRQ

SEQ ID NO: 3228 - protein, 47 aa, Arabidopsis thaliana
  G2317,MYB-related domain
EKWSEEEHDRFLEAIKLYGRGWRQIQEHIGTKTAVQIRSHAQKFFSK

SEQ ID NO: 3229 - protein, 47 aa, Arabidopsis thaliana
  G2319,MYB-related domain
ESWTEEEHDKFLEALQLFDRDWKKIEDFVGSKTVIQIRSHAQKYFLK

SEQ ID NO: 3230 - protein, 113 aa, Arabidopsis thaliana
  G2334,GRF-like domain
FFSWAQWQELELQALIYRYMLAGASVPQELLLPIKKSLLHQSPMHFLHHPLQHSFPHHQPSWYWGRGAMDPEPGRCKRTDGKKWRCSRDVVAGHKYCDRHIHRGRNRSRKPVE

SEQ ID NO: 3231 - protein, 107 aa, Arabidopsis thaliana
  G2340,MYB-(R1)R2R3 domain
KGAWTQEEDQKLIAYVQRHGEGGWRTLPDKAGLKRCGKSCRLRWANYLRPDIKRGEFSQDEEDSIINLHAIHGNKWSAIARKIPRRTDNEIKNHWNTHIKKCLVKKG

SEQ ID NO: 3232 - protein, 103 aa, Arabidopsis thaliana
  G2343,MYB-(R1)R2R3 domain
RGLWSPEEDEKLIRYITTHGYGCWSEVPEKAGLQRCGKSCRLRWINYLRPDIRRGRFSPEEEKLIISLHGVVGNRWAHIASHLPGRTDNEIKNYWNSWIKKKI

SEQ ID NO: 3233 - protein, 60 aa, Arabidopsis thaliana
  G2344,CAAT domain
EPVFVNAKQYHGILRRRQSRARLESQNKVIKSRKPYLHESRHLHAIRRPRGCGGRFLNAK

SEQ ID NO: 3234 - protein, 90 aa, Arabidopsis thaliana
  G2345,CAAT domain
REQDRFLPIANISRIMKRGLPLNGKIAKDAKETMQECVSEFISFVTSEASDKCQREKRKTINGDDLLWAMATLGFEDYIDPLKVYLMRYR

SEQ ID NO: 3235 - protein, 77 aa, Arabidopsis thaliana
  G2346,SBP domain
CQVEGCRMDLSNVKAYYSRHKVCCIHSKSSKVIVSGLHQRFCQQCSRFHQLSEFDLEKRSCRRRLACHNERRRKPQP

SEQ ID NO: 3236 - protein, 77 aa, Arabidopsis thaliana
  G2347,SBP domain
SRLCQVDRCTVNLTEAKQYYRRHRVCEVHAKASAATVAGVRQRFCQQCSRFHELPEFDEAKRSCRRRLAGHNERRRK

SEQ ID NO: 3237 - protein, 96 aa, Arabidopsis thaliana
  G2348,SBP domain
LPKKKRVRGGSGVARCQVPDCEADISELKGYHKRHRVCLRCATASFVVLDGENKRYCQQCGKFHLLPDFDEGKRSCRRKLERHNNRRKRKPVDKGG

SEQ ID NO: 3238 - protein, 103 aa, Arabidopsis thaliana
  G2371,ABI3/VP-1 domain
RESLFEKSLTPSDVGKLNRLVIPKQHAEKYFPLNNNNNNGGSGDDVATTEKGMLLSFEDESGKCWKFRYSYWNSSQSYVLTKGWSRYVKDKHLDAGDVVFFQR

SEQ ID NO: 3239 - protein, 361 aa, Arabidopsis thaliana
  G2372,ARF domain
PTIWRACAGASVQIPVLHSRVYYFPQGHVEHCCPLLSTLPSSTSPVPCIITSIQLLADPVTDEVFAHLILQPMTQQQFTPTNYSRFGRFDGDVDDNNKVTTFAKILTPSDANNGGGFSVPRFCADSVFPLLNFQIDPPVQKLYVTDIHGAVWDFRHIYRGTPRRHLLTTGWSKFVNSKKLIAGDSVVFMRKSADEMFIGVRRTPISSSDGGSSYYGGDEYNGYYSQSSVAKEDDGSPKKTFRRSGNGKLTAEAVTDAINRASQGLPFEVVFYPAAGWSEFVVRAEDVESSMSMYWTPGTRVKMAMETEDSSRITWFQGIVSSTYQETGPWRGSPWKQLQITWDEPEILQNVKRVNPWQVEI

SEQ ID NO: 3240 - protein, 61 aa, Arabidopsis thaliana
  G2373,TH domain
GGSGVGDVARAILGFTEAYEKAETAKLKLMAELEKERMKFAKEMELQRMQFLKTQLEITQN

SEQ ID NO: 3241 - protein, 98 aa, Arabidopsis thaliana
  G2375,TH domain
QWSIEETKELLAIREELDQTFMETKRNKLLWEVVAAKMADKGFVRSAEQCKSKWKNLVTRYKACETTEPDAIRQQFPFYNEIQSIFEARMQRMLWSEA

SEQ ID NO: 3242 - protein, 92 aa, Arabidopsis thaliana
  G2379,1st TH domain
GREDWWSEEATATLVEAWGNRYVKLNHGNLRQNDWKDVADAVNSRHGDNSRKKTDLQCKNRVDTLKKKYKTEKAKLSPSTWRFYNRLDVLIG

SEQ ID NO: 3243 - protein, 60 aa, Arabidopsis thaliana
  G2379,2nd TH domain
GSTCRELATAILKFGEVYERIEGKKQQMMIELEKQRMEVTKEVELKRMNMLMEMQLEIEK

SEQ ID NO: 3244 - protein, 88 aa, Arabidopsis thaliana
  G2382,1st TH domain
WREQEAFVLLEVWGDRFLQLGRRSLRNEDWNEVAEKVSEELRMEKSETQCRRMIDDLKRKYRKEKIKVEKSGLGSSKWSFFNKLDMLL

SEQ ID NO: 3245 - protein, 88 aa, Arabidopsis thaliana
  G2382,2nd TH domain
MLADSVERFGKVYEKMEKSKKEQMKELEKMRADFQRDLELQKKQIVDRAQSEIARLREEEENHHGGGDDDESEDEEMENDSDVNLSDE

SEQ ID NO: 3246 - protein, 61 aa, Arabidopsis thaliana
  G2383,TEO domain
KKRDRHSKICTAQGPRDRRMRLSLQIARKFFDLQDMLGFDKASKTIEWLFSKSKTSIKQLK

SEQ ID NO: 3247 - protein, 41 aa, Arabidopsis thaliana
  G2394,RING/C3H2C3 domain
CCICLTRYGDDEQVRELPCSHVFHVDCVDKWLKINATCPLC

SEQ ID NO: 3248 - protein, 41 aa, Arabidopsis thaliana
  G2404,RING/C3H2C3 domain
CIICQDEYEAKDEVGELRCGHRFHIDCVNQWLVRKNSCPVC

SEQ ID NO: 3249 - protein, 51 aa, Arabidopsis thaliana
  G2417,GARP domain
RWTPELHEVFVDAVNQLGGSNEATPKGVLKHMKVEGLTIFHVKSHLQKYRT

SEQ ID NO: 3250 - protein, 103 aa, Arabidopsis thaliana
  G2423,MYB-(R1)R2R3 domain
KRGPWTAEEDFKLMNYIATNGEGRWNSLSRCAGLQRTGKSCRLRWLNYLRPDVRRGNITLEEQLLILELHSRWGNRWSKIAQYLPGRTDNEIKNYWRTRVQKH

SEQ ID NO: 3251 - protein, 108 aa, Arabidopsis thaliana
  G2425,MYB-(R1)R2R3 domain
LRKGEWTAEEDRKLVVYINEHGLGEWGSLPKRAGLQRCGKSCRLRWLNYLRPGIKRGKFTPQEEEEIIKYHALLGNRWAAIAKQMPNRTDNDIKNHWNSCLKKRLAKK

SEQ ID NO: 3252 - protein, 54 aa, Arabidopsis thaliana
  G2430,GARP domain
WTEELHQKFLEAIEIIGGIEKANPKVLVECLQEMRIEGITRSNVASHLQKHRIN

SEQ ID NO: 3253 - protein, 43 aa, Arabidopsis thaliana
  G2432,Z-Dof domain
CPRCKSMETKFCYFNNYNVNQPRHFCKGCQRYWTAGGALRNVP

SEQ ID NO: 3254 - protein, 96 aa, Arabidopsis thaliana
  G2436,Z-CO-like domain
CDTCRSAACTVYCEADSAYLCTTCDARVHAANRVASRHERVRVCQSCESAPAAFLCKADAASLCTACDAEIHSANPLARRHQRVPILPLSANSCSS

SEQ ID NO: 3255 - protein, 67 aa, Arabidopsis thaliana
  G2443,Z-CO-like domain
CDTCRSNACTVYCHADSAYLCMSCDAQVHSANRVASRHKRVRVCESCERAPAAFLCEADDASLCTAC

SEQ ID NO: 3256 - protein, 52 aa, Arabidopsis thaliana
  G2452,1st MYB-related domain
ATWTAEENKRFEKALAYLDDKDNLESWSKIADLIPGKTVADVIKRYKELEDD

SEQ ID NO: 3257 - protein, 49 aa, Arabidopsis thaliana
  G2452,2nd MYB-related domain
VPWTEDEHLRFLMGLKKYGKGDWRNIAKSFVTTRTPTQVASHAQKYFLR

SEQ ID NO: 3258 - protein, 40 aa, Arabidopsis thaliana
  G2453,1st YABBY domain
ICHVQCGFCTTILLVSVPFTSLSMVVTVRCGHCTSLLSVN

SEQ ID NO: 3259 - protein, 47 aa, Arabidopsis thaliana
  G2453,2nd YABBY domain
KPPEKRQRAPSAYNCFIKEEIRRLKAQNPSMAHKEAFSLAAKNWAHF

SEQ ID NO: 3260 - protein, 39 aa, Arabidopsis thaliana
  G2455,1st YABBY domain
VCYVHCSFCTTILAVSVPYASLFTLVTVRCGHCTNLLSL

SEQ ID NO: 3261 - protein, 48 aa, Arabidopsis thaliana
  G2455,2nd YABBY domain
RPPEKRQRVPSAYNRFIKEEIQRIKACNPEISHREAFSTAAKNWAHFP

SEQ ID NO: 3262 - protein, 39 aa, Arabidopsis thaliana
  G2456,1st YABBY domain
LCYVHCSFCDTVLAVSVPPSSLFKTVTVRCGHCSNLLSV

SEQ ID NO: 3263 - protein, 48 aa, Arabidopsis thaliana
  G2456,2nd YABBY domain
RPPEKRQRVPSAYNRFIKEEIQRIKAGNPDISHREAFSAAAKNWAHFP

SEQ ID NO: 3264 - protein, 39 aa, Arabidopsis thaliana
  G2457,1st YABBY domain
LYYVRCSICNTILAVGIPLKRMLDTVTVKCGHCGNLSFL

SEQ ID NO: 3265 - protein, 48 aa, Arabidopsis thaliana
  G2457,2nd YABBY domain
KPPEKKQRLPSAYNRFMRDEIQRIKSANPEIPHREAFSAAAKNWAKYI

SEQ ID NO: 3266 - protein, 39 aa, Arabidopsis thaliana
  G2459,1st YABBY domain
LCYIPCNFCNIILAVNVPCSSLFDIVTVRCGHCTNLWSV

SEQ ID NO: 3267 - protein, 48 aa, Arabidopsis thaliana
  G2459,2nd YABBY domain
RPPEKRQRVPSAYNQFIKEEIQRIKANNPDISHREAFSTAAKNWAHFP

SEQ ID NO: 3268 - protein, 51 aa, Arabidopsis thaliana
  G2465,GARP domain
CWSPELHRRFLNALQQLGGSHVATPKQIRDHMKVDGLTNDEVKSHLQKYRL

SEQ ID NO: 3269 - protein, 92 aa, Arabidopsis thaliana
  G2467,HS domain
PFLTKTFEMVGDPNTNHIVSWNRGGISFVVWDPHSFSATILPLYFKHNNFSSFVRQLNTYGFRKIEAERWEFMNEGFLMGQRDLLKSIKRRT

SEQ ID NO: 3270 - protein, 15 aa, Arabidopsis thaliana
  G2492,1st ENBP domain
CMFCSSTCNCRACLR

SEQ ID NO: 3271 - protein, 245 aa, Arabidopsis thaliana
  G2492,2nd ENBP domain
LPRHAEEFLCSLPLKHYTHPVNGPLNLAVKLPQNCLKPDMGPKTYVASGFAQELGRGDSVTKLHCDMSDAVNILTHISEVPNMQPGIGNLKKKHAEQDLKELYSSVANKEEMMEILENSRQQVQNVETDDGALWDIFRREDIPKLESYIEKHHKEFRHLYCCPVSQVVHPIHDQNFYLTRYHIMKLKEEYGIEPWTFNRKLGDAVLIPVGCPHQVRNLKSCNKVALDFVSPENVSECLRLTKQYR

SEQ ID NO: 3272 - protein, 129 aa, Arabidopsis thaliana
  G2505,NAC domain
VPPGFRFHPTDEELLHYYLKKKISYQKFEMEVIREVDLNKLEPWDLQERCKIGSTPQNEWYFFSHKDRKYPTGSRTNRATHAGFWKATGRDKCIRNSYKKIGMRKTLVFYKGRAPHGQKTDWIMHEYRL

SEQ ID NO: 3273 - protein, 68 aa, Arabidopsis thaliana
  G2509,AP2 domain
KRHYRGVRQRPWGKWAAEIRDPQKAARVWLGTFETAEAAALAYDNAALKFKGSKAKLNFPERAQLASN

SEQ ID NO: 3274 - protein, 68 aa, Arabidopsis thaliana
  G2510,AP2 domain
HPVYHGVRKRRWGKWVSEIREPRKKSRIWLGSFPVPEMAAKAYDVAAFCLKGRKAQLNFPEEIEDLPR

SEQ ID NO: 3275 - protein, 69 aa, Arabidopsis thaliana
  G2512,AP2 domain
EKSYRGVRKRPWGKFAAEIRDSTRKGIRVWLGTFDTAEAAALAYDQAAFALKGSLAVLNFPADVVEESL

SEQ ID NO: 3276 - protein, 68 aa, Arabidopsis thaliana
  G2513,AP2 domain
HPVYRGIRRRNGDKWVCEVREPTHQRRIWLGTYPTADMAARAHDVAVLALRGRSACLNFADSAWRLPV

SEQ ID NO: 3277 - protein, 67 aa, Arabidopsis thaliana
  G2514,AP2 domain
DPVYRGIRCRSGKWVSEIREPRKTTRIWLGTYPMAEMAAAAYDVAAMALKGREAVLNFPGSVGSYPV

SEQ ID NO: 3278 - protein, 57 aa, Arabidopsis thaliana
  G2515,MADS domain
MGRGRVQLRRIENKIRRQVTFSKRRTGLVKKAQEISVLCDAEVALIVFSPKGKLFEY

SEQ ID NO: 3279 - protein, 61 aa, Arabidopsis thaliana
  G2517,WRKY domain
LDDGYKWRKYGQKPVKDSPFPRNYYRCTTTWCDVKKRVERSFSDPSSVITTYEGQHTHPRP

SEQ ID NO: 3280 - protein, 59 aa, Arabidopsis thaliana
  G2520,HLH/MYC domain
RRGQATDSHSLAERARREKISERMKILQDLVPGCNKVIGKALVLDEIINYIQSLQRQVE

SEQ ID NO: 3281 - protein, 9 aa, Arabidopsis thaliana
  G2522,1st AT-hook domain, domain in aa coordinates: 101-109
KRKRGRPRK

SEQ ID NO: 3282 - protein, 45 aa, Arabidopsis thaliana
  G2522,2nd domain
SASGAVSTATLLQPAPSHGTIIYEGLFELISLSTSYLNTTDNDYP

SEQ ID NO: 3283 - protein, 113 aa, Arabidopsis thaliana
  G2525,DBP domain
KTVGRWLKDRKEKKKEETRTQNAQVHAAVSVAAVASAVAAVAAATAASSPGKNEQMARIDMAMASAAALVAAQCVEAAEIMGADRDHLTSVVSSAVNVKSHDDIVTLTAAAAT

SEQ ID NO: 3284 - protein, 161 aa, Arabidopsis thaliana
  G2531,NAC domain
TCPSCGHKLHHHQDDQVGSIKDLPSLPAGVKFDPSDKEILMHLEAKVSSDKRKLHPLIDEFIPTLEGENGICYTHPEKLPGVSKDGQVRHFFHRPSKAYTTGTRKRRKVSTDEEGHETRWHKTGKTRPVLSQSGETGFKKILVLYTNYGRQKKPEKTNWVM

SEQ ID NO: 3285 - protein, 104 aa, Arabidopsis thaliana
  G2535,NAC domain
VPPGFRFHPTEEELLKYYLRKKISNIKIDLDVIPDIDLNKLEPWDIQEMCKIGTTPQNDWYFYSHKDKKYPTGTRTNRATTVGFWKATGRDKTIYTNGDRIGMR

SEQ ID NO: 3286 - protein, 131 aa, Arabidopsis thaliana
  G2536,NAC domain
LSVGFRFYPTEVELLTYYLRIQLGGGNATIHSLIPILDVFSVEPTQLPNLAGERCRGDAEQWIFFVPRQEREARGGRPSRTTGSGYWKATGSPGPVFSPDNRVIGVKKTMVFYTGKAPTGRKTKWKMNEYK

SEQ ID NO: 3287 - protein, 125 aa, Arabidopsis thaliana
  G2539,NAC domain
PGYRFVPKDQELIFHYLKPFSQGNKCSLLNVPIHRVNIYESNPQHLSEKYEKGNDKDWFYISERTKTGKAGRSNKRVDNGGYWSATVAAQKINAGNGIVGYKTSLEYYVGKQSNSVKGDWLMQEY

SEQ ID NO: 3288 - protein, 61 aa, Arabidopsis thaliana
  G2543,HB domain
RKKKRYHRHTAQQIQRLESSFKECPHPDEKQRNQLSRELGLAPRQIKFWFQNRRTQLKAQH

SEQ ID NO: 3289 - protein, 64 aa, Arabidopsis thaliana
  G2550,HB domain
PAWRPQRGLPENSVSILRAWLFEHFLHPYPKESEKIMLSKQTGLSKNQVANWFINARVRLWKPM

SEQ ID NO: 3290 - protein, 58 aa, Arabidopsis thaliana
  G2552,HLH/MYC domain
KTKTDRSRTLISERRRRGRMKDKLYALRSLVPNITKMDKASIVGDAVLYVQELQSQAK

SEQ ID NO: 3291 - protein, 59 aa, Arabidopsis thaliana
  G2555,HLH/MYC domain
KRGCATHPRSIAERVRRTRISDRIRRLQELVPNMDKQTNTADMLEEAVEYVKALQSQIQ

SEQ ID NO: 3292 - protein, 58 aa, Arabidopsis thaliana
  G2557,HLH/MYC domain
NVKISTDPQTVAARQRRERISEKIRVLQTLVPGGTKMDTASMLDEAANYLKFLRAQVK

SEQ ID NO: 3293 - protein, 111 aa, Arabidopsis thaliana
  G2559,DBP domain
RLEQDKRISLIKAWEEAEKSKVENKAQKKISSVGAWENSKKASVEAELKKIEEQLNKKKAHYTEQMKNKIAQIHKEAEEKRAMTEAKRGEDVLKAEEMAAKYRATGTAPTK

SEQ ID NO: 3294 - protein, 50 aa, Arabidopsis thaliana
  G2565,GARP domain
WTPELHEAFVEAINQLGGSERATPKAVLKLINSPGLTVYHVKSHLQKYRT

SEQ ID NO: 3295 - protein, 367 aa, Arabidopsis thaliana
  G2567,ARF domain
PQLWHACAGGMVRMPPMNSKVFYFPQGHAENAYDCVDFGNLPIPPMVLCRVLAIKYMADAESDEVFAKLRLIPLKDDEYVDHEYGDGEDSNGFESNSEKTPSFAKTLTQSDANNGGGFSVPRYCAETIFPRLDYNAEPPVQTILAKDVHGDVWKFRHIYRGTPRRHLLTTGWSNFVNQKKLVAGDSIVFMRAENGDLCVGIRRAKRGGIGNGPEYSAGWNPIGGSCGYSSLLREDESNSLRRSNCSLADRKGKVTAESVIEAATLAISGRPFEVVYYPRASTSEFCVKALDARAAMRIPWCSGMRFKMAFETEDSSRISWFMGTVSAVNVSDPIRWPNSPWRLLQVAWDEPDLLQNVKRVNPWLVEL

SEQ ID NO: 3296 - protein, 49 aa, Arabidopsis thaliana
  G2570,GARP domain
WTDSLHDLFLQAIRHIGLDKAVPKKILAFMSVPYLTRENVASHLQKYRI

SEQ ID NO: 3297 - protein, 68 aa, Arabidopsis thaliana
  G2571,AP2 domain
KKLYRGVRQRHWGKWVAEIRLPQNRMRVWLGTYDTAEAAAYAYDRAAYKLRGEYARLNFPNLKDPSEL

SEQ ID NO: 3298 - protein, 60 aa, Arabidopsis thaliana
  G2574,WRKY domain
TMNDGCQWRKYGQKIAKGNPCPRAYYRCTVAPGCPVRKQVQRCADDMSILITTYEGTHSH

SEQ ID NO: 3299 - protein, 56 aa, Arabidopsis thaliana
  G2575,WRKY domain
DGYRWRKYGQKAVKNSPYPRSYYRCTTQKCNVKKRVERSFQDPSIVITTYEGKHNH

SEQ ID NO: 3300 - protein, 68 aa, Arabidopsis thaliana
  G2579,AP2 domain
PGRFLGVRRRPWGRYAAEIRDPTTKERHWLGTFDTAHEAALAYDRAALSMRGTQARTNFVYTPTDVHT

SEQ ID NO: 3301 - protein, 68 aa, Arabidopsis thaliana
  G2583,AP2 domain
SRKFRGVRQRQWGSWVSEIRHPLLKRRVWLGTFETAEAAARAYDQAALLMNGQNAKTNFPVVKSEEGS

SEQ ID NO: 3302 - protein, 60 aa, Arabidopsis thaliana
  G2585,WRKY domain
ESSTPIYHDGFLWRKYGQKQIKESEYQRSYYKCAYTKDQNCEAKKQVQKIQHNPPLYSTT

SEQ ID NO: 3303 - protein, 58 aa, Arabidopsis thaliana
  G2587,WRKY domain
NDGFTWRKYGQKTIKASAHKRCYYRCTYAKDQNCNATKRVQKIKDNPPVYRTTYLGKH

SEQ ID NO: 3304 - protein, 57 aa, Arabidopsis thaliana
  G2589,MADS domain
MRTKTKLVLIPDRHFRRATFRKRNAGIRKKLHELTTLCDIKACAVIYSPFENPTVWP

SEQ ID NO: 3305 - protein, 56 aa, Arabidopsis thaliana
  G2590,MADS domain
RSKIKLSLIANKTSRRTTFRKRKGGITNKLHELTTLCGVKACAVISSPYENPVVWP

SEQ ID NO: 3306 - protein, 311 aa, Arabidopsis thaliana
  G2592,TUBBY domain
PGPRDGIIQCYIKRDKSNMTYHLYLSLSPAILVESGKFLLSAKRSRRATYTEYVISMDADNISRSSSTYIGKLKSNFLGTKFIVYDTAPAYNSSQILSPPNRSRSFNSKKVSPKVPSGSYNIAQVTYELNLLGTRGPRRMNCIMHSIPSLALEPGGTVPSQPEFLQRSLDESFRSIGSSKIVNHSGDFTRPKEEEGKVRPLVLKTKPPRWLQPLRCWCLNFKGRVTVASVKNFQLMSAATVQPGSGSDGGALATRPSLSPQQPEQSNHDKIILHFGKVGKDMFTMDYRYPLSAFQAFAISLSTFDTKLACE

SEQ ID NO: 3307 - protein, 286 aa, Arabidopsis thaliana
  G2603,TUBBY domain
PGPRDSLVQCFIKRNRITQSYHLYLGLTNSLTDDGKFLLAACKLKHTTCTDYIISLRSDDMSRRSQAYVGKVRSNFLGTKFTVFDGNLLPSTGAAKLRKSRSYNPAKVSAKVPLGSYPVAHITYELNVLGSRGPRKMQCLMDTIPTSTMEPQGVASEPSEFPLLGTRSTLSRSQSKPLRSSSSHLKETPLVLSNKTPRWHEQLRCWCLNFHGRVTVASVKNFQLVAAGASCGSGTGMSPERQSERIILQFGKVGKDMFTMDYGYPISAFQAFAICLSSFETRIACE

SEQ ID NO: 3308 - protein, 31 aa, Arabidopsis thaliana
  G2604,1st Z-LSDlike domain
QLVCSGCRNLLMYPVGATSVCCAVCNAVTAV

SEQ ID NO: 3309 - protein, 31 aa, Arabidopsis thaliana
  G2604,2nd Z-LSDlike domain
QLVCGGCHTLLMYIRGATSVQCSCCHTVNLA

SEQ ID NO: 3310 - protein, 61 aa, Arabidopsis thaliana
  G2616,HB domain
RWTPTTTQLQILENIYKEGSGTPNPRRIKEITMELSEHGQIMEKNVYHWFQNRRARSKRKQ

SEQ ID NO: 3311 - protein, 21 aa, Arabidopsis thaliana
  G2617,Z-C2H2 domain
SFCGREFKSAQALGGHMNVHR

SEQ ID NO: 3312 - protein, 70 aa, Arabidopsis thaliana
  G2628,bZIP domain
EKRLRRMASNRESARRTRMRERMMKEGLQMQVKQLMAYNQFLYNKYISLLEYNHQILQENSQLKETVSSF

SEQ ID NO: 3313 - protein, 89 aa, Arabidopsis thaliana
  G2631,CAAT domain
KEDASLPKATMTKIIKEMLPADVRVARDAQDLLIECCVEFINLISSESNEVCNKEDKRTIAPEHVLKALQVLGFGEYVEEVYAAYEQHK

SEQ ID NO: 3314 - protein, 58 aa, Arabidopsis thaliana
  G2632,CAAT domain
EPVFVNAKQYQAILRRRQARAKAELEKKLIKSRKPYLHESRHQHAMRRPRGTGGRFAK

SEQ ID NO: 3315 - protein, 66 aa, Arabidopsis thaliana
  G2633,1st SCR domain
MHILYEVCPYFKFGYMSANGAIAEAMKEENRVHIIDFQIGQGSQWVTLIQAFAARPGGPPRIRITG

SEQ ID NO: 3316 - protein, 89 aa, Arabidopsis thaliana
  G2633,2nd SCR domain
FVLHHMPDESVSTENHRDRLLRMVKSLSPKVVTLVEQESNTNTAAFFPRFMETMNYYAAMFESIDVTLPRDHKQRINVEQHCLARDVVN

SEQ ID NO: 3317 - protein, 73 aa, Arabidopsis thaliana
  G2633,3rd SCR domain
CEGADRVERHELLGKWRSRFGMAGFTPYPLSPLVNSTIKSLLRNYSDKYRLEERDGALYLGWMHRDLVASCAW

SEQ ID NO: 3318 - protein, 133 aa, Arabidopsis thaliana
  G2636,NAC domain
FEDESLMPPGFRFHPTDEELITYYLLKKVLDSNFSCAAISQVDLNKSEPWELPEKAKMGEKEWYFFTLRDRKYPTGLRTNRATEAGYWKATGKDREIKSSKTKSLLGMKKTLVFYKGRAPKGEKSCWVMHEYR

SEQ ID NO: 3319 - protein, 54 aa, Arabidopsis thaliana
  G2639,SRS domain
GSGGPSCQDCGNQSKKDCSHMRCRTCCKSRGLDCPTHVKSTWVPAAKRRERQQQ

SEQ ID NO: 3320 - protein, 44 aa, Arabidopsis thaliana
  G2640,SRS domain
DCGNQAKKDCSHMRCRTCCKSRGFECSTHVRSTWVPAAKRRERQ

SEQ ID NO: 3321 - protein, 44 aa, Arabidopsis thaliana
  G2649,SRS domain
CQDCGNQAKKECKQRRCRTCCKSRGFDCSTHVKSTWVSAARRRE

SEQ ID NO: 3322 - protein, 58 aa, Arabidopsis thaliana
  G2650,TEO domain
KDRHSKVCTVRGLRDRRIRLSVMTAIQVYDLQERLGLSQPSKVIDWLLEVAKNDVDLL

SEQ ID NO: 3323 - protein, 60 aa, Arabidopsis thaliana
  G2655,HLH/MYC domain
EIENQRMTHIAVERNRRKQMNEYLAVLRSLMPPYYAQRGDQASIVGGAINYLKELEHHLQ

SEQ ID NO: 3324 - protein, 58 aa, Arabidopsis thaliana
  G2661,HLH/MYC domain
TSTLSTDPQSVAARDRRHRISDRFKILQSMVPGGAKMDTVSMLDEAISYVKFLKAQIW

SEQ ID NO: 3325 - protein, 71 aa, Arabidopsis thaliana
  G2679,CPP domain
LYCECFASGSYCNGCNCVNCHNKLENESSRQVAISGILERNPDAFKPKIAGSPHGMKDLQENVQQVLLIGK

SEQ ID NO: 3326 - protein, 115 aa, Arabidopsis thaliana
  G2682,CPP domain
KGCRCKQSKCLKLYCDCFASGVVCTDCDCVDCHNNSEKCDAREAAMVNVLGRNPNAFSEKALGSLTDNQAAPDTKPGLLSRGCKCKRTRCLKKYCECFQANLLCSDNCKCINCKN

SEQ ID NO: 3327 - protein, 52 aa, Arabidopsis thaliana
  G2686,WRKY domain
QRCYYRCAYAKDQNCYATKRVQMIQDSPPVYRTTYLGQHTCKAFGVHDNTYG

SEQ ID NO: 3328 - protein, 63 aa, Arabidopsis thaliana
  G2690,1st AP2 domain
TTKFKGVVQQQNGHWGAQIYADHRRIWLGTFKSAHEAAAAYDSASIKLRSFDANSHRNFPWSD

SEQ ID NO: 3329 - protein, 100 aa, Arabidopsis thaliana
  G2690,2nd AP2 domain
CTQLFQKELTPSDVGKLNRLVIPKKYAVKYMPFISDDQSEKETSEGVEDVEVVFYDRAMRQWKFRYCYWRSSQSFVFTRGWNGFVKEKNLKEKDIIVFYT

SEQ ID NO: 3330 - protein, 69 aa, Arabidopsis thaliana
  G2691,AP2 domain
FKYPVGVRPRPSGKFAAEILNPFTKTKKWLGTYETPAEAEKAYVDKKVEYDALASSGSAVSSSVVTVTS

SEQ ID NO: 3331 - protein, 446 aa, Arabidopsis thaliana; identical to SEQ ID NO: 1642
  G2694,OTHER domain

SEQ ID NO: 3332 - protein, 66 aa, Arabidopsis thaliana
  G2699,1st SCR domain
LAAFVDLTPWHRFGFIAANAAILTAVEGYSTVHIVDLSLTHCMQIPTLIDAMASRLNKPPPLLKLT

SEQ ID NO: 3333 - protein, 91 aa, Arabidopsis thaliana
  G2699,2nd SCR domain
MMLRYIPEEPLTSSSSSLRTVFLKQLRSLNPRIVTLIEEDVDLTSENLVNRLKSAFNYFWIPFDTTDTFMSEQRRWYEAEISWKIENVVAK

SEQ ID NO: 3334 - protein, 75 aa, Arabidopsis thaliana
  G2699,3rd SCR domain
KEGAERVERTETKRRWIERMREAEFGGVRVKEDAVADVKAMLEEHAVGWGMKKEDDDESLVLTWKGHSVVFATVW

SEQ ID NO: 3335 - protein, 51 aa, Arabidopsis thaliana
  G2701,1st MYB-related domain
GSWTKEENKMFERALAIYAEDSPDRWFKVASMIPGKTVFDVMKQYSKLEED

SEQ ID NO: 3336 - protein, 49 aa, Arabidopsis thaliana
  G2701,2nd MYB-related domain
VPWTEEEHRRFLLGLLKYGKGDWRNISRNFVVSKTPTQVASHAQKYYQR

SEQ ID NO: 3337 - protein, 101 aa, Arabidopsis thaliana
  G2702,MYB-(R1)R2R3 domain
RKGLWSPDEDEKLIRYMLTNGQGCWSDIARNAGLLRCGKSCRLRWINYLRPDLKRGSFSPQEEDLIFHLHSILGNRWSQIATRLPGRTDNEIKNFWNSTLK

SEQ ID NO: 3338 - protein, 323 aa, Arabidopsis thaliana
  G2713,TUBBY domain
PGPRDAMIQCFIKRDKSKLTFHLFLCLSPALLVENGKFLLSAKRTRRTTRTEYIISMDADNISRSSNSYLGKLRSNFLGTKFLVYDTQPPPNTSSSALITDRTSRSRFHSRRVSPKVPSGSYNIAQITYELNVLGTRGPRRMHCIMNSIPISSLEPGGSVPNQPEKLVPAPYSLDDSFRSNISFSKSSFDHRSLDFSSSRFSEMGISCDDNEEEASFRPLILKNKQPRWHEQLQCWCLNFRGRVTVASVKNFQLVAARQPQPQGTGAAAAPTSAPAHPEQDKVILQFGKVGKDMFTMDYRYPLSAFQAFAICLSSFDTKLACE

SEQ ID NO: 3339 - protein, 49 aa, Arabidopsis thaliana
  G2717,MYB-related domain
QKWTQEEESALKSGVIKHGPGKWRTILKDPEFSGVLYLRSNVDLKDKWR

SEQ ID NO: 3340 - protein, 45 aa, Arabidopsis thaliana
  G2718,MYB-related domain
IAMAQEEEDLICRMYKLVGERWDLIAGRIPGRTAEEIERFWVMKN

SEQ ID NO: 3341 - protein, 99 aa, Arabidopsis thaliana
  G2719,MYB-(R1)R2R3 domain
KGPWSTEEDAVLTKLVRKLGPRNWSLIARGIPGRSGKSCRLRWCNQLDPCLKRKPFSDEEDRMIISAHAVHGNKWAVIAKLLTGRTDNAIKNHWNSTLR

SEQ ID NO: 3342 - protein, 51 aa, Arabidopsis thaliana
  G2723,MYB-related domain
SSWTSKQNKMFERALAVYDKDTPDRWQNVAKAVGSKSAEEVKRHYDILVED

SEQ ID NO: 3343 - protein, 107 aa, Arabidopsis thaliana
  G2724,MYB-(R1)R2R3 domain
RGPWTVEEDMKLVSYISLHGEGRWNSLSRSAGLNRTGKSCRLRWLNYLRPDIRRGDISLQEQFIILELHSRWGNRWSKIAQHLPGRTDNEIKNYWRTRVQKHAKLLK

SEQ ID NO: 3344 - protein, 49 aa, Arabidopsis thaliana; identical to SEQ ID NO: 2957
  G2741,GARP domain

SEQ ID NO: 3345 - protein, 49 aa, Arabidopsis thaliana
  G2743,GARP domain
WSQELHRRFLNALKQLGGPHVATPKQIRDIMKVDGLTNDEVKSHLQKYR

SEQ ID NO: 3346 - protein, 95 aa, Arabidopsis thaliana
  G2747,ABI3/VP-1 domain
REHMFDKVVTPSDVGKLNRLVIPKQHAERYFPLDNSTTNDSNKGLLLNFEDRSGNSWRFRYSYWNSSQSYVMTKGWSRFVKDKKLDAGDIVSFQR

SEQ ID NO: 3347 - protein, 196 aa, Arabidopsis thaliana
  G2754,1st SWI/SNF domain
TGGQLKSYQLKGVKWLISLWQNGLNGILADQMGLGKTIQTIGFLSHLKGNGLDGPYLVIAPLSTLSNWFNEIARFTPSINAIIYHGDKNQRDELRRKHMPKTVGPKFPIVITSYEVAMNDAKRILRHYPWKYVVIDEGHRLKNHKCKLLRELKHLKMDNKLLLTGTPLQNNLSELWSLLNFILPDIFTSHDEFESW

SEQ ID NO: 3348 - protein, 85 aa, Arabidopsis thaliana
  G2754,2nd SWI/SNF domain
DIMDYYFSEKGFEVCRIDGSVKLDERRRQIKDFSDEKSSCSIFLLSTRAGGLGINLTAADTCILYDSDWNPQMDLQAMDRCHRIG

SEQ ID NO: 3349 - protein, 89 aa, Arabidopsis thaliana
  G2757,1st TH domain
WTDEETAALVNAYKDKWFALRRGNLRAADWDDVAAAVSSSSTVGGPPKSAIQCRHKIEKLRKRYRGEKQRALNRPGKFSSSWDLFPILD

SEQ ID NO: 3350 - protein, 87 aa, Arabidopsis thaliana
  G2757,2nd TH domain
KHEQMNAAAEVESDPIDEVVSSVKMLTEMFVRVENSKMEMMREMEKSRMEMELKHCQMMLESQQQIIGAFAEALSEKKSTNARRPVS

SEQ ID NO: 3351 - protein, 61 aa, Arabidopsis thaliana
  G2763,HLH/MYC domain
GSIRSKKQRATVLRLKAKGLPAVQRKVKVLSRLVPGCRKQSLPVVLEETTDYIAAMEMQIR

SEQ ID NO: 3352 - protein, 58 aa, Arabidopsis thaliana
  G2765,HLH/MYC domain
KALAASKSHSEAERRRRERINTHLAKLRSILPNTTKTDKASLLAEVIQHMKELKRQTS

SEQ ID NO: 3353 - protein, 59 aa, Arabidopsis thaliana
  G2766,HLH/MYC domain
KRGFATHPRSIAERERRTRISGKLKKLQELVPNMDKQTSYADMLDLAVEHIKGLQHQVE

SEQ ID NO: 3354 - protein, 59 aa, Arabidopsis thaliana
  G2768,DBP domain
ELPPELKCPLCKEVMKDAALTSKCCYKSFCDKCIRDHIISKSMCVCGRSDVLADDLLPN

SEQ ID NO: 3355 - protein, 58 aa, Arabidopsis thaliana
  G2771,HLH/MYC domain
KRSRAADMHNLSERRRRERINERMKTLQELLPRCRKTDKVSMLEDVIEYVKSLQLQIQ

SEQ ID NO: 3356 - protein, 58 aa, Arabidopsis thaliana
  G2774,HLH/MYC domain
RPRLETLSPLPSFKVRKEKLGDRITALQQLVSPFGKTDTASVLNEAVEYIKFLQEQVT

SEQ ID NO: 3357 - protein, 58 aa, Arabidopsis thaliana
  G2776,HLH/MYC domain
RNQSNAQDHIIAERKRREKLTQRFVALSALVPGLKKMDKASVLGDALKHIKYLQERVG

SEQ ID NO: 3358 - protein, 59 aa, Arabidopsis thaliana
  G2777,HLH/MYC domain
KLNTPRSKHSATEQRRRSKINDRFQMLRQLIPNSDQKRDKASFLLEVIEYIQFLQEKAD

SEQ ID NO: 3359 - protein, 59 aa, Arabidopsis thaliana
  G2779,HLH/MYC domain
RRGQATDSHSLAERVRRGKINERLRCLQDMVPGCYKAMGMATMLDEIINYVQSLQNQVE

SEQ ID NO: 3360 - protein, 62 aa, Arabidopsis thaliana
  G2783,1st ACBF-like domain
TLWIGDLQYWMDENFLYGCFAHTGEMVSAKVIRNKQTGQVEGYGFIEFASHAAAERVLQTFN

SEQ ID NO: 3361 - protein, 85 aa, Arabidopsis thaliana
  G2783,2nd ACBF-like domain
DSPDYTIFVGDLAADVTDYILLETFRASYPSVKGAKVVIDRVTGRTKGYGFVRFSDESEQIRAMTEMNGVPCSTRPMRIGPAASK

SEQ ID NO: 3362 - protein, 57 aa, Arabidopsis thaliana
  G2783,3rd ACBF-like domain
TVFVGGLDASVTDDHLKNVFSQYGEIVHVKIPAGKRCGFVQFSEKSCAEEALRMLNG

SEQ ID NO: 3363 - protein, 122 aa, Arabidopsis thaliana
  G2784,DBP domain
KRKEEVRLQRAEVHAAVSLAGLAAALAAVASENAGKDGGNGRPSTRETAVASAAAVVAAQCAQMAETMGANRDQLSTMIGSAMTGTSVSEILTLTASATTSLRGAATLKARRGCKINRLNGS

SEQ ID NO: 3364 - protein, 9 aa, Arabidopsis thaliana
  G2789 AT-hook domain
RRPRGRPAG

SEQ ID NO: 3365 - protein, 142 aa, Arabidopsis thaliana
  G2789 2nd conserved domain
GSKNKPKAPIIVTRDSANAFRCHVMEITNACDVMESLAVFARRRQRGVCVLTGNGAVTNVTVRQPGGGVVSLHGRFEILSLSGSFLPPPAPPAASGLKVYLAGGQGQVIGGSVVGPLTASSPVVVMAASFGNASYERLPLEE

SEQ ID NO: 3366 - protein, 58 aa, Arabidopsis thaliana
  G2790,HLH/MYC domain
GKRNQEKSSVGIAKVRKERLGERIAALQQLVSPYGKTDAASVLHEAMGYIKFLQDQIQ

SEQ ID NO: 3367 - protein, 58 aa, Arabidopsis thaliana
  G2791,HLH/MYC domain
RRGQATDPHSIAERLRRERIAERMKSLQELVPNTNKTDKASMLDEIIEYVRFLQLQVK

SEQ ID NO: 3368 - protein, 149 aa, Arabidopsis thaliana
  G2802,NAC domain
LPAGVKFDPTDQELIEHLEAKVLAKDFKSHPLIDEFIPTIEGEDGICYTHPEKLPGVTRDGLSRHFFHRPSKAYTTGTRKRRKIQTECDNNLQGSSSSGETRWHKTGKTRPVMVNGKQKGCKKILVLYTNFGKNRKPEKTNWVMHQYHL

SEQ ID NO: 3369 - protein, 168 aa, Arabidopsis thaliana
  G2805,NAC domain
MKSRREQSIEEAIVANYLKMMIDNVNVWPRHFLRSEDVYCKNPWTLFVTRDPIILHFGRYFFVNRSVNSGLTDGCEYGCWRIIGRDRVIKSVTTGKILGLKKVYKFCETDRKPKSVFKFLEKEKRRVRDRRIWAMEEYRFASTWKQDYVICKIRRLYPQPFDYMLAQH

SEQ ID NO: 3370 - protein, 21 aa, Arabidopsis thaliana
  G2826,Z-C2H2 domain
CQYCCREFGNSQALGGHQNAH

SEQ ID NO: 3371 - protein, 22 aa, Arabidopsis thaliana
  G2830,Z-C2H2 domain
CPRCNGVFDTSQKFAAHMLSHY

SEQ ID NO: 3372 - protein, 21 aa, Arabidopsis thaliana
  G2832,1st Z-C2H2 domain
CKYCYKTFPSGKALGGHIRIH

SEQ ID NO: 3373 - protein, 21 aa, Arabidopsis thaliana
  G2832,2nd Z-C2H2 domain
CRECGRVFVSLKALRGHMACH

SEQ ID NO: 3374 - protein, 21 aa, Arabidopsis thaliana
  G2832,3rd Z-C2H2 domain
CPICFRMFKSGQALGGHKRSH

SEQ ID NO: 3375 - protein, 21 aa, Arabidopsis thaliana
  G2834,1st Z-C2H2 domain
CTICGKGFKRDANLRMHMRGH

SEQ ID NO: 3376 - protein, 22 aa, Arabidopsis thaliana
  G2834,2nd Z-C2H2 domain
CSRCHTKKFSVIADLKTHEKHC

SEQ ID NO: 3377 - protein, 21 aa, Arabidopsis thaliana
  G2837,Z-C2H2 domain
CHICGRGFGSWKAVFGHMRAH

SEQ ID NO: 3378 - protein, 21 aa, Arabidopsis thaliana
  G2838,Z-C2H2 domain
CHYCFRNFPTSQALGGHQNAH

SEQ ID NO: 3379 - protein, 27 aa, Arabidopsis thaliana
  G2839,1st Z-C2H2 domain
KRVFRCKTCLKEFSSFQALGGHRASHK

SEQ ID NO: 3380 - protein, 29 aa, Arabidopsis thaliana
  G2839,2nd Z-C2H2 domain
HPCPICGVEFPMGQALGGHMRRHRSEKAS

SEQ ID NO: 3381 - protein, 58 aa, Arabidopsis thaliana
  G2846,HLH/MYC domain
KPRVTTPSPLPTFKVRKENLRDQITSLQQLVSPFGKTDTASVLQEAIEYIKFLHDQVT

SEQ ID NO: 3382 - protein, 58 aa, Arabidopsis thaliana
  G2847,HLH/MYC domain
KPKLQVPSSQSTLKVRKEKLGGRIASLHQLVSPFGKTDTASVLSEAIGYIRFLHSQIE

SEQ ID NO: 3383 - protein, 57 aa, Arabidopsis thaliana
  G2850,HLH/MYC domain
PRVESRSSCPPFKVRKEKLGDRIAALQQLVSPFGKTDTASVLMEAIGYIKFLQSQIE

SEQ ID NO: 3384 - protein, 58 aa, Arabidopsis thaliana
  G2851,HLH/MYC domain
PRLQPSPSSQSTLKVRKEKLGGRIAALHQLVSPFGKTDTASVLSEAIGYIRFLQSQIE

SEQ ID NO: 3385 - protein, 141 aa, Arabidopsis thaliana
  G2854,ACBF-like domain
KVIRNKQNGYSEGYGFIEFVNHATAERNLQTYNGAPMPSSEQAFRLNWAQLGAGERRQAEGPEHTVFVGDLAPDVTDHMLTETFKAVYSSVKGAKVVNDRTTGRSKGYGFVRFADESEQIRAMTEMNGQYCSSRPMRTGPA

SEQ ID NO: 3386 - protein, 59 aa, Arabidopsis thaliana
  G2859,HLH/MYC domain
RRGQATDSHSIAERVRRGKINERLKCLQDIVPGCYKTMGMATMLDEIINYVQSLQNQVE

SEQ ID NO: 3387 - protein, 66 aa, Arabidopsis thaliana
  G2865,HLH/MYC domain
TKKEKKLLHRNIERQRRQEMAILFASLRSQLPLKYIKALSSQGKRAMSDHVNGAVSFIKDTQTRIK

SEQ ID NO: 3388 - protein, 17 aa, Arabidopsis thaliana
  G2866,1st IAA domain
YVKVNMEGVPIGRKIDL

SEQ ID NO: 3389 - protein, 30 aa, Arabidopsis thaliana
  G2866,2nd IAA domain
YADKEGDWMMVGDVPWEMFLSSVRRLKISR

SEQ ID NO: 3390 - protein, 384 aa, Arabidopsis thaliana
  G2869,ARF domain
EQLWKLCAGPLCDIPKLGEKVYYFPQGHIELVSSLSLYSFSLLSLSLSLSLSLSLSLSLSLSPFSLFSLFSLSPLSLSLSLSLLLSHVEASTREELNELQPICDFPSKLQCRVIAIQLKVENNSDETYAEITLMPDTTQVVIPTQNQNQFRPLVNSFTKVLTASDTSVHGGFSVPKKHAIECLPPLDMSQPLPTQEILAIDLHGNQWRFRHIYRGTAQRHLLTIGWNAFTTSKKLVEGDVIVFVRGETGELRVGIRRAGHQQGNIPSSIVSIESMRHGIIASAKHAFDNQCMFIVVYKPRSSQFIVSYDKFLDVVNNKFNVGSRFTMRFEGDDFSERRSFGTIIGVSDFSPHWKCSEWRSLEVQWDEFASFPRPNQVSPWDIEH

SEQ ID NO: 3391 - protein, 49 aa, Arabidopsis thaliana
  G2884,GARP domain
WDEELHQNFLNAVDFLGLERAVPKKILDVMKVDYISRENVASHLQKFRL

SEQ ID NO: 3392 - protein, 48 aa, Arabidopsis thaliana
  G2885,GARP domain
WSQELHQKFVSAVQQLGLDKAVPKKILDLMSIEGLTRENVASHLQKYR

SEQ ID NO: 3393 - protein, 177 aa, Arabidopsis thaliana
  G2887,NAC domain
TQLAPGFRFHPTDVELVRYYLKRKILGKKLLVDAIAEVDIYKFEPPDLPDMSFIRSGDLKWHFFCPREKKYASGVRANRATECGYWKTTGKERPVLCNSEVVGKIKTLVYHFGKSPRGERTDWVMHEYRLDDKVLTQMNVPQDTYVVCVLFKKDGPGPRNGAQYGAPFKEEDWSDEE

SEQ ID NO: 3394 - protein, 21 aa, Arabidopsis thaliana
  G2888,1st Z-C2H2 domain
CEICNQGFQRDQNLQMHRRRH

SEQ ID NO: 3395 - protein, 21 aa, Arabidopsis thaliana
  G2888,2nd Z-C2H2 domain
CERCSKGYAVQSDYKAHLKTC

SEQ ID NO: 3396 - protein, 102 aa, Arabidopsis thaliana
  G2893,MYB-(R1)R2R3 domain
RKGPWTLEEDTLLTNYISHNGEGRWNLLAKSSGLKRAGKSCRLRWLNYLKPDIKRGNLTPQEQLLILELHSKWGNRWSKISKYLPGRTDNDIKNYWRTRVQK

SEQ ID NO: 3397 - protein, 73 aa, Arabidopsis thaliana
  G2898,HMG domain
QTKMPKKPATAFFFFLDDFRKQYQEENPDVKSMREIGKTCGEKWKTMTYEEKVKYYDIATEKREEFHRAMTEY

SEQ ID NO: 3398 - protein, 109 aa, Arabidopsis thaliana
  G2907,1st PCGL domain
ELDVGQILSEARHRWLRPPEICEILQNYQRFQISTEPPTTPSSGSVFMFDRKVLRYFRKDGHNWRKKKDGKTVKEAHERLKAGSVDVLHCYYAHGQDNENFQRRSYWLL

SEQ ID NO: 3399 - protein, 70 aa, Arabidopsis thaliana
  G2907,2nd PCGL domain
AAAIRIQNKFRGYKGRKDYLITRQRIIKIQAHVRGYQFRKNYRKIIWSVGVLEKVILRWRRKGAGLRGFK

SEQ ID NO: 3400 - protein, 85 aa, Arabidopsis thaliana
  G2913,ARID domain
VFWDTLRRFHSIMSTKFMIPVIGGKELDLHVLYVEVTRRGGYEKVVVEKKWREVGGVFRFSATTTSASFVLRKHYLNLLFHYEQV

SEQ ID NO: 3401 - protein, 64 aa, Arabidopsis thaliana
  G2930,HLH/MYC domain
SGAAKKQDHNAKERLRRMRLHASYLTLGTLLPDHSSSSSKKKWSAPSIIDNVITYIPKLQNEVG

SEQ ID NO: 3402 - protein, 61 aa, Arabidopsis thaliana
  G2933,HLH/MYC domain
PVVVKKLNHNASERDRRKKINTLFSSLRSCLPASDQSKKLSIPETVSKSLKYIPELQQQVK

SEQ ID NO: 3403 - protein, 61 aa, Arabidopsis thaliana
  G2934,HLH/MYC domain
NKKKKKLLHRDIERQRRQEMATLFATLRTHLPLKYIKGKRAVSDHVNGAVNFIKDTEARIK

SEQ ID NO: 3404 - protein, 17 aa, Arabidopsis thaliana
  G2958,1st IAA domain
YVKVALDGAAYLRKVDL

SEQ ID NO: 3405 - protein, 30 aa, Arabidopsis thaliana
  G2958,2nd IAA domain
YEDKDGDLMLVGDVPWMMFVESCKRMRLMK

SEQ ID NO: 3406 - protein, 23 aa, Arabidopsis thaliana
  G2964,1st Z-C3H domain
PCTKFFSTSGCPFGDNCHFLHYV

SEQ ID NO: 3407 - protein, 35 aa, Arabidopsis thaliana
  G2964,2nd Z-C3H domain
HPGSNYKTKICDRYSKGNCTYGDRCHFAHGESELR

SEQ ID NO: 3408 - protein, 23 aa, Arabidopsis thaliana
  G2967,1st Z-C2H2 domain
CEECGKGFRYEKYFKNHRSMMHL

SEQ ID NO: 3409 - protein, 28 aa, Arabidopsis thaliana
  G2967,2nd Z-C2H2 domain
HRCRLCNKIFSSYQALGGHQTFHRMSKC

SEQ ID NO: 3410 - protein, 23 aa, Arabidopsis thaliana
  G2969,Z-C2H2 domain
CNSCGEIFPKINLLENHIAIKHA

SEQ ID NO: 3411 - protein, 25 aa, Arabidopsis thaliana
  G2972,1st Z-C2H2 domain
CKTCGRKFGTLKGVYGHQRMHSGNH

SEQ ID NO: 3412 - protein, 21 aa, Arabidopsis thaliana
  G2972,2nd Z-C2H2 domain
CSICEKSFVCSQALGSHQRLH

SEQ ID NO: 3413 - protein, 18 aa, Arabidopsis thaliana
  G2972,3rd Z-C2H2 domain
CGKSFVCSQALGGHQTLH

SEQ ID NO: 3414 - protein, 20 aa, Arabidopsis thaliana
  G2979,E2F domain
VRRLYDIANVFASMNLIEKT

SEQ ID NO: 3415 - protein, 19 aa, Arabidopsis thaliana
  G2981,E2F domain
RRRVYDALNVLMAMDIISK

SEQ ID NO: 3416 - protein, 18 aa, Arabidopsis thaliana
  G2982,E2F domain
RRVYDALNVFMALDIIAR

SEQ ID NO: 3417 - protein, 61 aa, Arabidopsis thaliana
  G2983,HB domain
RWNPTQEQIGILEMLYKGGMRTPNAQQIEHITLQLGKYGKIEGKNVFYWFQNHKARERQKQ

SEQ ID NO: 3418 - protein, 56 aa, Arabidopsis thaliana
  G2989 ZF domain
VTYKECLKNHAAAIGGHALDGCGEFMPSPSSTPSDPTSLKCAACGCHRNFHRRETD

SEQ ID NO: 3419 - protein, 64 aa, Arabidopsis thaliana
  G2989 HB domain
RKRFRTKFSSNQKEKMHEFADRIGWKIQKRDEDEVRDFCREIGVDKGVLKVWMHNNKNSFKFSG

SEQ ID NO: 3420 - protein, 56 aa, Arabidopsis thaliana
  G2990 ZF domain
FTYKECLKNHAAALGGHALDGCGEFMPSPSSISSDPTSLKCAACGCHRNFHRRDPD

SEQ ID NO: 3421 - protein, 64 aa, Arabidopsis thaliana
  G2990 HB domain
RKRFRTKFSQFQKEKMHEFAERVGWKMQKRDEDDVRDFCRQIGVDKSVLKVWMHNNKNTFNRRD

SEQ ID NO: 3422 - protein, 56 aa, Arabidopsis thaliana
  G2991 ZF domain
ATYKECLKNHAAGIGGHALDGCGEFMPSPSFNSNDPASLTCAACGCHRNFHRREED

SEQ ID NO: 3423 - protein, 64 aa, Arabidopsis thaliana
  G2991 HB domain
RKRFRTKFSQYQKEKMFEFSERVGWRMPKADDVVVKEFCREIGVDKSVFKVWMHNNKISGRSGA

SEQ ID NO: 3424 - protein, 56 aa, Arabidopsis thaliana
  G2992 ZF domain
VCYKECLKNHAANLGGHALDGCGEFMPSPTATSTDPSSLRCAACGCHRNFHRRDPS

SEQ ID NO: 3425 - protein, 64 aa, Arabidopsis thaliana
  G2992 HB domain
RKRTRTKFTPEQKIKMRAFAEKAGWKINGCDEKSVREFCNEVGIERGVLKVWMHNNKYSLLNGK

SEQ ID NO: 3426 - protein, 54 aa, Arabidopsis thaliana
  G2993 ZF domain
IKYKECLKNHAATMGGNAIDGCGEFMPSGEEGSIEALTCSVCNCHRNFHRRETE

SEQ ID NO: 3427 - protein, 64 aa, Arabidopsis thaliana
  G2993 HB domain
KKRFRTKFTQEQKEKMISFAERVGWKIQRQEESVVQQLCQEIGIRRRVLKVWMHNNKQNLSKKS

SEQ ID NO: 3428 - protein, 54 aa, Arabidopsis thaliana
  G2994 ZF domain
IKYKECLKNHAAAMGGNATDGCGEFMPSGEDGSIEALTCSACNCHRNFHRKEVE

SEQ ID NO: 3429 - protein, 64 aa, Arabidopsis thaliana
  G2994 HB domain
KKRFRTKFTPEQKEKMLSFAEKVGWKIQRQEDCVVQRFCEEIGVKRRVLKVWMHNNKIHFSKKN

SEQ ID NO: 3430 - protein, 54 aa, Arabidopsis thaliana
  G2996 ZF domain
FRFRECLKNQAVNIGGHAVDGCGEFMPAGIEGTIDALKCAACGCHRNFHRKELP

SEQ ID NO: 3431 - protein, 64 aa, Arabidopsis thaliana
  G2996 HB domain
RKRHRTKFTAEQKERMLALAERIGWRIQRQDDEVIQRFCQETGVPRQVLKVWLHNNKHTLGKSP

SEQ ID NO: 3432 - protein, 54 aa, Arabidopsis thaliana
  G2997 ZF domain
IRYRECLKNHAVNIGGHAVDGCCEFMPSGEDGTLDALKCAACGCHRNFHRKETE

SEQ ID NO: 3433 - protein, 64 aa, Arabidopsis thaliana
  G2997 HB domain
TKRFRTKFTAEQKEKMLAFAERLGWRIQKHDDVAVEQFCAETGVRRQVLKIWMHNNKNSLGKKP

SEQ ID NO: 3434 - protein, 54 aa, Arabidopsis thaliana
  G2998 ZF domain
VRYRECLKNHAASVGGSVHDGCGEFMPSGEEGTIEALRCAACDCHRNFHRKEMD

SEQ ID NO: 3435 - protein, 64 aa, Arabidopsis thaliana
  G2998 HB domain
KKRFRTKFTTDQKERMMDFAEKLGWRMNKQDEEELKRFCGEIGVKRQVFKVWMHNNKNNAKKPP

SEQ ID NO: 3436 - protein, 54 aa, Arabidopsis thaliana
  G2999 ZF domain
ARYRECQKNHAASSGGHVVDGCGEFMSSGEEGTVESLLCAACDCHRSFHRKEID

SEQ ID NO: 3437 - protein, 64 aa, Arabidopsis thaliana
  G2999 HB domain
KKRFRTKFNEEQKEKMMEFAEKIGWRMTKLEDDEVNRFCREIKVKRQVFKVWMHNNKQAAKKKD

SEQ ID NO: 3438 - protein, 54 aa, Arabidopsis thaliana
  G3000 ZF domain
AKYRECQKNHAASTGGHVVDGCCEFMAGGEEGTLGALKCAACNCHRSFHRKEVY

SEQ ID NO: 3439 - protein, 64 aa, Arabidopsis thaliana
  G3000 HB domain
KKRVRTKINEEQKEKMKEFAERLGWRMQKKDEEEIDKFCRMVNLRRQVFKVWMHNNKQAMKRNN

SEQ ID NO: 3440 - protein, 49 aa, Arabidopsis thaliana
  G3002 ZF domain
CVYRECMRNHAAKLGSYAIDGCREYSQPSTGDLCVACGCHRSYHRRIDV

SEQ ID NO: 3441 - protein, 63 aa, Arabidopsis thaliana
  G3002 HB domain
QRRRKSKFTAEQREAMKDYAAKLGWTLKDKRALREEIRVFCEGIGVTRYHFKTWVNNNKKFYH

SEQ ID NO: 3442 - protein, 150 aa, Arabidopsis thaliana
  G3003,Z-C2H2 domain
WIPAPEQILIGFTHFSCHVCFKTFNRYNNLQMHMWGHGSQYRKGPESLKGTQPRAMLGIPCYCCVEGCRNNIDHPRSKPLKDFRTLQTHYKRKHGHKPFSCRLCGKLLAVKGDWRTHEKNCGKRWVCVCGSDFKHKRSLKDHVKAFGSGH

SEQ ID NO: 3443 - protein, 266 aa, Arabidopsis thaliana
  G3008,EIL domain
LSPMDDEEEEISYDDLKRRMWKDRNLMEKKLKQQKRHSNDVVSFTTHRAEASRRKKMARSQDSVLKYMMKIMEVCKAKGFVYGIVPEKGKPITGSSDSLRRWWKENVQFDQNAPDAITDYLALAAAAAAAELIDKSSSSSSLLHMLQELQDTTLGSLLSALMQHCMPPQRRFPLEKGIAPPWWPTGTELWWGEQGAAHEHGAPPYRKPHDLRKSWKVSVLAAVIKHMSPNLGRVRRLARQSKSLQDKMMAKETDTWSRVLNQEEAL

SEQ ID NO: 3444 - protein, 58 aa, Arabidopsis thaliana
  G3017,HLH/MYC domain
ATTSPKDPQSLAAKNRRERISERLKVLQELVPNGTKVDLVTMLEKAIGYVKFLQVQVK

SEQ ID NO: 3445 - protein, 58 aa, Arabidopsis thaliana
  G3021,HLH/MYC domain
DGIRILERPDKEGGNEEGGIEERLRELKKLLPGGEEMNVEEMLSEIGNYIKCLELQTI

SEQ ID NO: 3446 - protein, 49 aa, Arabidopsis thaliana
  G3032,GARP domain
WTNRLQLVFDDAVVRLGGLFSATPKAINELISEEGLTGDQIRSHLQVLR

SEQ ID NO: 3447 - protein, 59 aa, Arabidopsis thaliana
  G3044,HLH/MYC domain
RRGQATNSHSLAERVRREKISERMKFLQDLVPGCDKVTGKAVMLDEIINYVQSLQCQIE

SEQ ID NO: 3448 - protein, 20 aa, Arabidopsis thaliana
  G3054,1st Z-C3H domain
CFKFRAGTCPYSASSCHFAH

SEQ ID NO: 3449 - protein, 20 aa, Arabidopsis thaliana
  G3054,2nd Z-C3H domain
CNKWQTTGYCPFGSHCHFAH

SEQ ID NO: 3450 - protein, 19 aa, Arabidopsis thaliana
  G3055,1st Z-C3H domain
CCKFRAGTCPYITNCNFAH

SEQ ID NO: 3451 - protein, 20 aa, Arabidopsis thaliana
  G3055,2nd Z-C3H domain
CKKFYTEEGCPYGESCTFLH

SEQ ID NO: 3452 - protein, 22 aa, Arabidopsis thaliana
  G3055,3rd Z-C3H domain
CNKWEITGYCPFGAKCHFAHGA

SEQ ID NO: 3453 - protein, 69 aa, Arabidopsis thaliana
  G3059,Z-C3H domain
NQGMTKTELCNKWQETGTCPYGDHCQFAHGIKELRPVIRHPRYKTEVCRMVLAGDNCPYGHRCHFRHSL

SEQ ID NO: 3454 - protein, 20 aa, Arabidopsis thaliana
  G3060,1st Z-C3H domain
CTKFFSTSGCPFGENCHFLH

SEQ ID NO: 3455 - protein, 19 aa, Arabidopsis thaliana
  G3060,2nd Z-C3H domain
CERFSKGNCTFGDRCHFAH

SEQ ID NO: 3456 - protein, 18 aa, Arabidopsis thaliana
  G3061,1st Z-C2H2 domain
CNKGFQREQNLQLHKRGH

SEQ ID NO: 3457 - protein, 20 aa, Arabidopsis thaliana
  G3061,2nd Z-C2H2 domain
CDCGTLFSRKDSFISHRSFC

SEQ ID NO: 3458 - protein, 22 aa, Arabidopsis thaliana
  G3067,Z-C2H2 domain
CHKCGEKFSKLEAAEAHHLTKH

SEQ ID NO: 3459 - protein, 22 aa, Arabidopsis thaliana
  G3070,Z-C2H2 domain
CQKCHERVRDLDAFEAHYLSNH

SEQ ID NO: 3460 - protein, 84 aa, Arabidopsis thaliana
  G3074,CAAT domain
KKLDTRFPAARIKKIMQADEDVGKIALAVPVLVSKSLELFLQDLCDRTYEITLERGAKTVSSLHLKHCVERYNVFDFLREVVSK

SEQ ID NO: 3461 - protein, 82 aa, Arabidopsis thaliana
  G3075,CAAT domain
PMNRIRRIMRSDNSAPQIMQDAVFLVNKATEMFIERFSEEAYDSSVKDKKKFIHYKHLSSVVSNDQRYEFLADSVPEKLKAE

SEQ ID NO: 3462 - protein, 31 aa, Arabidopsis thaliana
  G3076,1st bZIP-ZW2 domain
FFGSVWLNPLENACSWLTGWKPSMVFRMVDR

SEQ ID NO: 3463 - protein, 28 aa, Arabidopsis thaliana
  G3076,2nd bZIP-ZW2 domain
ADCVRLKTLKGILDILTPPQCVEFLAAA

SEQ ID NO: 3464 - protein, 31 aa, Arabidopsis thaliana
  G3083,1st bZIP-ZW2 domain
VMASPWASALERSLQWVGGWRPTTLFHLVYT

SEQ ID NO: 3465 - protein, 28 aa, Arabidopsis thaliana
  G3083,2nd bZIP-ZW2 domain
TDDLRLRTITRVVEVLSPLQQAEFLVAA

SEQ ID NO: 3466 - protein, 17 aa, Arabidopsis thaliana
  G3084,1st IAA domain
YVKVTMDGLVVGRKVCV

SEQ ID NO: 3467 - protein, 30 aa, Arabidopsis thaliana
  G3084,2nd IAA domain
YRDEEGLWRNAGDVPWNEFIESVERLRITR

SEQ ID NO: 3468 - protein, 59 aa, Arabidopsis thaliana
  G3086,HLH/MYC domain
KRGCATHPRSIAERVRRTKISERMRKLQDLVPNMDTQTNTADMLDLAVQYIKDLQEQVK

SEQ ID NO: 3469 - protein, 98 aa, Arabidopsis thaliana
  G3091,PLATZ domain
PPWLKPLLKEQFFVHCKFHGDSHKSECNMYCLDCTNGPLCSLCLAHHKDHRTIQIRRSSYHDVIRVNEIQKYLDIGGIQTYVINSAKVVFLNERPQPR

SEQ ID NO: 3470 - protein, 137 aa, Arabidopsis thaliana
  G3094,PLATZ domain
PAWLEVLLKDKFFNACLDHEDDKKNEKNILCIDCCLTICPHCLSSHTSHRLLQIRRYVYRDVLRVEDGSKLMDCSLIQPYTTNSSKVVFINERPQSRQFRGSGNICITCDRSLQSPYLFCCLSCKISDVIMRQRGLS

SEQ ID NO: 3471 - protein, 136 aa, Arabidopsis thaliana
  G3095,PLATZ domain
NPPPWLIPMLRANYFIPCSIHAASNKSECNMFCLDCSSEAFCSYCLLNHRNHRVLQIRRSSYHNVVRVNEIQKYIDISCVQTYIINSARIVFLNERPQPRIGKGVTNTCEICCRSLLDSFRFCSLGCKLGGMKRDP

SEQ ID NO: 3472 - protein, 42 aa, Arabidopsis thaliana
  G3111,RING/C3H2C3 domain
CAICLAEFSAGDELRVLPQCGHGFHVACIDTWLGSHSSCPSC

SEQ ID NO: 3473 - protein, 65 aa, Oryza sativa
  G3380,AP2 domain
ETTKYRGVRRRPSGKFAAEIRDSSRQSVRVWLGTFDTAEEAARAYDRAAYAMRGHLAVLNFPAEA

SEQ ID NO: 3474 - protein, 65 aa, Oryza sativa
  G3381,AP2 domain
LVAKYRGVRRRPWGKFAAEIRDSSRHGVRVWLGTFDTAEEAARAYDRSAYSMRGANAVLNFPADA

SEQ ID NO: 3475 - protein, 65 aa, Oryza sativa
  G3383,AP2 domain
TATKYRGVRRRPWGKFAAEIRDPERGGARVWLGTFDTAEEAARAYDRAAYAQRGAAAVLNFPAAA

SEQ ID NO: 3476 - protein, 64 aa, Oryza sativa
  G3388 AP2 domain
SSRYKGVVPQPNGRWGAQIYERHARVWLGTFPDEEAAARAYDVAALRYRGRDAATNFPGAAASA

SEQ ID NO: 3477 - protein, 94 aa, Oryza sativa
  G3388 B3 domain
LFEKAVTPSDVGKLNRLVVPKQHAEKHFPLRRAASSDSASAAATGKGVLLNFEDGEGKVWRFRYSYWNSSQSYVLTKGWSRFVREKGLRAGDTI

SEQ ID NO: 3478 - protein, 66 aa, Oryza sativa
  G3389 AP2 domain
SSRYKGVVPQPNGRWGAQIYERHARVWLGTFPDEEAAARAYDVAALRFRGRDAVTNRAPAAEGASA

SEQ ID NO: 3479 - protein, 90 aa, Oryza sativa
  G3389 B3 domain
LFEKAVTPSDVGKLNRLVVPKQQAERHFPFPLRRHSSDAAGKGVLLNFEDGDGKVWRFRYSYWNSSQSYVLTKGWSRFVREKGLRPGDTV

SEQ ID NO: 3480 - protein, 70 aa, Oryza sativa
  G3391 AP2 domain
SSKFKGVVPQPNGRWGAQIYERHQRVWLGTFAGEDDAARAYDVAAQRFRGRDAVTNFRPLAEADPDAAAE

SEQ ID NO: 3481 - protein, 86 aa, Oryza sativa
  G3391 B3 domain
LFDKTVTPSDVGKLNRLVIPKQHAEKHFPLQLPSAGGESKGVLLNFEDAAGKVWRFRYSYWNSSQSYVLTKGWSRFVKEKGLHADG

SEQ ID NO: 3482 - protein, 45 aa, Oryza sativa
  G3393,MYB-related domain
VHFTEEEEDLVFRMHRLVGNRWELIAGRIPGRTAKEVEMFWAVKH

SEQ ID NO: 3483 - protein, 89 aa, Oryza sativa
  G3394,CAAT domain
RQDRFLPIANISRIMKKAIPANGKIAKDAKETVQECVSEFISFITSEASDKCQREKRKTINGDDLLWAMATLGFEDYIEPLKVYLQKYR

SEQ ID NO: 3484 - protein, 90 aa, Oryza sativa
  G3395,CAAT domain
REQDRFLPIANISRIMKKAVPANGKIAKDAKETLQECVSEFISFVTSEASDKCQKEKRKTINGEDLLFAMGTLGFEEYVDPLKIYLHKYR

SEQ ID NO: 3485 - protein, 90 aa, Oryza sativa
  G3396,CAAT domain
KEQDRFLPIANIGRIMRRAVPENGKIAKDSKESVQECVSEFISFITSEASDKCLKEKRKTINGDDLIWSMGTLGFEDYVEPLKLYLRLYR

SEQ ID NO: 3486 - protein, 90 aa, Oryza sativa
  G3397,CAAT domain
REQDRFLPIANVSRIMKKALPANAKISKDAKETVQECVSEFISFITGEASDKCQREKRKTINGDDLLWAMTTLGFEDYVDPLKHYLHKFR

SEQ ID NO: 3487 - protein, 90 aa, Oryza sativa
  G3398,CAAT domain
REQDRFLPIANVSRIMKRALPANAKISKDAKETVQECVSEFISFITGEASDKCQREKRKTINGDDLLWAMTTLGFEDYIDPLKLYLHKFR

SEQ ID NO: 3488 - protein, 9 aa, Oryza sativa
  G3399 AT-hook domain
RRPRGRPPG

SEQ ID NO: 3489 - protein, 147 aa, Oryza sativa
  G3399 2nd conserved domain
GSKNKPKPPIIVTRDSPNALHSHVLEVAGGADVVDCVAEYARRRGRGVCVLSGGGAVVNVALRQPGASPPGSMVATLRGRFEILSLTGTVLPPPAPPGASGLTVFLSGGQGQVIGGSVVGPLVAAGPVVLMAASFANAVYERLPLEG

SEQ ID NO: 3490 - protein, 9 aa, Oryza sativa
  G3400 AT-hook domain
RRPRGRPLG

SEQ ID NO: 3491 - protein, 147 aa, Oryza sativa
  G3400 2nd conserved domain
GSKNKPKPPIIVTRDSPNAFHSHVLEVAAGTDIVECVCEFARRRGRGVSVLSGGGAVANVALRQPGASPPGSLVATMRGQFEILSLTGTVLPPPAPPSASGLTVFLSGGQGQVVGGSVAGQLIAAGPVFLMAASFANAVYERLPLDG

SEQ ID NO: 3492 - protein, 9 aa, Oryza sativa
  G3401 AT-hook domain
RRPRGRPPG

SEQ ID NO: 3493 - protein, 144 aa, Oryza sativa
  G3401 2nd conserved domain
GSKNKPKPPIFVTRDSPNALRSHVMEVAGGADVAESIAHFARRRQRGVCVLSGAGTVTDVALRQPAAPSAVVALRGRFEILSLTGTFLPGPAPPGSTGLTVYLAGGQGQVVGGSVVGTLTAAGPVMVIASTFANATYERLPLDQ

SEQ ID NO: 3494 - protein, 9 aa, Oryza sativa
  G3407 AT-hook domain
RRPRGRPPG

SEQ ID NO: 3495 - protein, 150 aa, Oryza sativa
  G3407 2nd conserved domain
GSKNKPKPPVIITRESANALRAHILEVAAGCDVFEALTAYARRRQRGVCVLSAAGTVANVTLRQPQSAQPGPASPAVATLHGRFEILSLAGSFLPPPAPPGATSLAAFLAGGQGQVVGGSVAGALIAAGPVVVVAASFSNVAYERLPLED

SEQ ID NO: 3496 - protein, 9 aa, Oryza sativa
  G3408 AT-hook domain
KKRRGRPPG

SEQ ID NO: 3497 - protein, 158 aa, Oryza sativa
  G3408 2nd conserved domain
GSKNKPKPPVVITREAEPAAAMRPHVIEIPGGRDVAEALARFSSRRNLGICVLAGTGAVANVSLRHPSPGVPGSAPAAIVFHGRYEILSLSATFLPPAMSSVAPQAAVAAAGLSISLAGPHGQIVGGAVAGPLYAATTVVVVAAAFTNPTFHRLPADD

SEQ ID NO: 3498 - protein, 85 aa, Oryza sativa
  G3429,CAAT domain
ELPMANLVRLIKKVLPGKAKIGGAAKGLTHDCAVEFVGFVGDEASEKAKAEHRRTVAPEDYLGSFGDLGFDRYVDPMDAYIHGYR

SEQ ID NO: 3499 - protein, 45 aa, Zea mays
  G3431,MYB-related domain
VDFTEAEEDLVSRMHRLVGNRWEIIAGRIPGRTAEEVEMFWSKKY

SEQ ID NO: 3500 - protein, 66 aa, Zea mays
  G3432 AP2 domain
SSRYKGVVPQPNGRWGAQIYERHQRVWLGTFAGEADAARAYDVAAQRFRGRDAVTNFRPLADADPD

SEQ ID NO: 3501 - protein, 88 aa, Zea mays
  G3432 B3 domain
LFDKTVTPSDVGKLNRLVIPKQHAEKHFPLQLPSAGGESKGVLLNLEDAAGKVWRFRYSYWNSSQSYVLTKGWSRFVKEKGLQAGDVV

SEQ ID NO: 3502 - protein, 90 aa, Zea mays
  G3434,CAAT domain
REQDRFLPIANISRIMKKAVPANGKIAKDAKETLQECVSEFISFVTSEASDKCQKEKRKTINGDDLLWAMATLGFEEYVEPLKIYLQKYK

SEQ ID NO: 3503 - protein, 90 aa, Zea mays
  G3435,CAAT domain
REQDRFLPIANVSRIMKKALPANAKISKDAKETVQECVSEFISFITGEASDKCQREKRKTINGDDLLWAMTTLGFEDYVEPLKHYLHKFR

SEQ ID NO: 3504 - protein, 90 aa, Zea mays
  G3436,CAAT domain
REQDRFLPIANVSRIMKKALPANAKISKDAKETVQECVSEFISFITGEASDKCQREKRKTINGDDLLWAMTTLGFEDYVEPLKLYLHKFR

SEQ ID NO: 3505 - protein, 90 aa, Zea mays
  G3437,CAAT domain
KEQDRFLPIANVSRIMKRSLPANAKISKEAKETVQECVSEFISFVTGEASDKCQREKRKTINGDDLLWAMTTLGFEAYVAPLKSYLNRYR

SEQ ID NO: 3506 - protein, 45 aa, Zea mays; identical to SEQ ID NO: 3499
  G3444,MYB-related domain

SEQ ID NO: 3507 - protein, 45 aa, Glycine max
  G3445,MYB-related domain
VEFSEAEEILIAMVYNLVGERWSLIAGRIPGRTAEEIEKYWTSRF

SEQ ID NO: 3508 - protein, 45 aa, Glycine max; identical to SEQ ID NO: 3507
  G3446,MYB-related domain

SEQ ID NO: 3509 - protein, 45 aa, Glycine max; identical to SEQ ID NO: 3507
  G3447,MYB-related domain

SEQ ID NO: 3510 - protein, 45 aa, Glycine max
  G3448,MYB-related domain
VEFSEDEETLIIRMYKLVGERWSIIAGRIPGRTAEEIEKYWTSRF

SEQ ID NO: 3511 - protein, 45 aa, Glycine max
  G3449,MYB-related domain
VEFSEDEETLIIRMYKLVGERWSLIAGRIPGRTAEEIEKYWTSRF

SEQ ID NO: 3512 - protein, 45 aa, Glycine max
  G3450,MYB-related domain
IHMSEQEEDLIRRMYKLVGDKWNLIAGRIPGRKAEEIERFWIMRH

SEQ ID NO: 3513 - protein, 62 aa, Glycine max
  G3451 AP2 domain
SSKYKGVVPQPNGRWGAQIYEKHQRVWLGTFNEEDEAARAYDIAAQRFRGKDAVTNFKPLAG

SEQ ID NO: 3514 - protein, 100 aa, Glycine max
  G3451 B3 domain
LFEKAVTPSDVGKLNRLVIPKQHAEKHFPLQSSNGVSATTIAAVTATPTAAKGVLLNFEDVGGKVWRFRYSYWNSSQSYVLTKGWSRFVKEKNLKAGDTV

SEQ ID NO: 3515 - protein, 66 aa, Glycine max
  G3452 AP2 domain
SSKYKGVVPQPNGRWGAQIYEKHQRVWLGTFNEEDEAARAYDIAALRFRGPDAVTNFKPPAASDDA

SEQ ID NO: 3516 - protein, 96 aa, Glycine max
  G3452 B3 domain
LFEKTVTPSDVGKLNRLVIPKQHAEKHFPLSGSGDESSPCVAGASAAKGMLLNFEDVGGKVWRFRYSYWNSSQSYVLTKGWSRFVKEKNLRAGDAV

SEQ ID NO: 3517 - protein, 66 aa, Glycine max
  G3453 AP2 domain
SSKYKGVVPQPNGRWGAQIYEKHQRVWLGTFNEEDEAVRAYDIVAHRFRGRDAVTNFKPLAGADDA

SEQ ID NO: 3518 - protein, 96 aa, Glycine max
  G3453 B3 domain
LVEKTVTPSDVGKLNRLVIPKQHAEKHFPLSGSGGGALPCMAAAAGAKGMLLNFEDVGGKVWRFRYSYWNSSQSYVLTKGWSRFVKEKNLRAGDAV

SEQ ID NO: 3519 - protein, 70 aa, Glycine max
  G3455 AP2 domain
SSKYKGVVPQPNGRWGSQIYEKHQRVWLGTFNEEDEAARAYDVAVQRFRGKDAVTNFKPLSGTDDDDGES

SEQ ID NO: 3520 - protein, 100 aa, Glycine max
  G3455 B3 domain
REQLFQKAVTPSDVGKLNRLVIPKQHAEKHFPLQSAANGVSATATAAKGVLLNFEDVGGKVWRFRYSYWNSSQSYVLTKGWSRFVKEKNLKAGDTVCFQR

SEQ ID NO: 3521 - protein, 9 aa, Glycine max
  G3456 AT-hook domain
RRPRGRPPG

SEQ ID NO: 3522 - protein, 144 aa, Glycine max
  G3456 2nd conserved domain
GSRNKPKPPIFVTRDSPNALRSHVMEIAVGADIADCVAQFARRRQRGVSILSGSGTVVNVNLRQPTAPGAVMALHGRFDILSLTGSFLPGPSPPGATGLTIYLAGGQGQIVGGGVVGPLVAAGPVLVMAATFSNATYERLPLED

SEQ ID NO: 3523 - protein, 9 aa, Glycine max
  G3459 AT-hook domain
RRPRGRPPG

SEQ ID NO: 3524 - protein, 144 aa, Glycine max
  G3459 2nd conserved domain
GSKNKPKPPVIITRESANTLRAHILEVGSGSDVFDCVTAYARRRQRGICVLSGSGTVTNVSLRQPAAAGAVVTLHGRFEILSLSGSFLPPPAPPGATSLTIYLAGGQGQVVGGNVIGELTAAGPVIVIAASFTNVAYERLPLEE

SEQ ID NO: 3525 - protein, 9 aa, Glycine max
  G3460 AT-hook domain
RRPRGRPSG

SEQ ID NO: 3526 - protein, 144 aa, Glycine max
  G3460 2nd conserved domain
GSKNKPKPPVIITRESANTLRAHILEVGSGSDVFDCVTAYARRRQRGICVLSGSGTVTNVSLRQPAAAGAVVRLHGRFEILSLSGSFLPPPAPPGATSLTIYLAGGQGQVVGGNVVGELTAAGPVIVIAASFTNVAYERLPLEE

SEQ ID NO: 3527 - protein, 90 aa, Glycine max
  G3470,CAAT domain
REQDRYLPIANISRIMKKALPPNGKIAKDAKDTMQECVSEFISFITSEASEKCQKEKRKTINGDDLLWAMATLGFEDYIEPLKVYLARYR

SEQ ID NO: 3528 - protein, 90 aa, Glycine max; identical to SEQ ID NO: 3527
  G3471,CAAT domain

SEQ ID NO: 3529 - protein, 90 aa, Glycine max
  G3472,CAAT domain
REQDRFLPIANVSRIMKKALPANAKISKEAKETVQECVSEFISFITGEASDKCQKEKRKTINGDDLLWAMTTLGFEEYVEPLKVYLHKYR

SEQ ID NO: 3530 - protein, 91 aa, Glycine max
  G3473,CAAT domain
REQDRFLPIANVSRIMKKALPANAKISKDAKETVQECVSEFISFHSPGGLAGECQKEKRKTINGDDLLWAMTTLGFEEYVEPLKVYLHKYR

SEQ ID NO: 3531 - protein, 90 aa, Glycine max
  G3474,CAAT domain
REQDRFLPIANVSRIMKKALPANAKISKEAKETVQECVSEFISFITGEASDKCQKEKRKTINGDDLLWAMTTLGFEDYVDPLKIYLHKYR

SEQ ID NO: 3532 - protein, 90 aa, Glycine max
  G3475,CAAT domain
REQDRFLPIANVSRIMKKALPANAKISKDAKETVQECVSEFISFITGEASDKCQREKRKTINGDDLLWAMTTLGFEDYVEPLKGYLQRFR

SEQ ID NO: 3533 - protein, 90 aa, Glycine max
  G3476,CAAT domain
REQDRFLPIANVSRIMKKALPANAKISKDAKETVQECVSEFISFITGEASDKCQREKRKTINGDDLLWAMTTLGFEEYVEPLKIYLQRFR

SEQ ID NO: 3534 - protein, 90 aa, Glycine max; identical to SEQ ID NO: 3532
  G3478,CAAT domain

SEQ ID NO: 3535 - protein, 56 aa, Oryza sativa
  G3479,MADS domain
GRGKIVIRRIDNSTSRQVTFSKRRNGIFKKAKELAILCDAEVGLVIFSSTGRLYEY

SEQ ID NO: 3536 - protein, 56 aa, Oryza sativa
  G3480,MADS domain
GRGKIVIRRIDNSTSRQVTFSKRRNGIFKKAKELAILCDAEVGLMIFSSTGRLYEY

SEQ ID NO: 3537 - protein, 56 aa, Oryza sativa
  G3481,MADS domain
GRGKIVIRRIDNSTSRQVTFSKRRNGLLKKAKELSILCDAEVGLVVFSSTGRLYEF

SEQ ID NO: 3538 - protein, 56 aa, Oryza sativa
  G3482,MADS domain
RGKGCWSKGEEGQEEKIKIKERMEERKRCSVSRESSFCTSDTHAIGIFLAHFRTTQ

SEQ ID NO: 3539 - protein, 56 aa, Oryza sativa
  G3483,MADS domain
GRGKIEIKRIDNATSRQVTFSKRRSGLFKKARELSILCDAEVGLLVFSSTSRLYDF

SEQ ID NO: 3540 - protein, 56 aa, Glycine max
  G3484,MADS domain
GRGKIAIRRIDNSTSRQVTFSKRRNGLLKKARELSILCDAEVGLMVFSSTGKLYDY

SEQ ID NO: 3541 - protein, 56 aa, Glycine max
  G3485,MADS domain
GRGKIVIRRIDNSTSRQVTFSKRRNGLLKKAKELAILCDAEVGVMIFSSTGKLYDF

SEQ ID NO: 3542 - protein, 56 aa, Zea mays
  G3487,MADS domain
GRGKIEIKRIDNATSRQVTFSKRRGGLFKKAKELAILCDAEVGLVVFSSTGRLYHF

SEQ ID NO: 3543 - protein, 56 aa, Zea mays
  G3488,MADS domain
GRGKIVIRRIDNSTSRQVTFSKRRNGIFKKARELAILCDAEVGLVIFSSTGRLYEY

SEQ ID NO: 3544 - protein, 56 aa, Zea mays; identical to SEQ ID NO: 3535
  G3489,MADS domain

SEQ ID NO: 3545 - protein, 61 aa, Zea mays
  G3490,HB domain
PHRAKKLRLSKEQSRLLEESFRLNHTLTPKQKEALAVKLKLRPRQVEVWFQNRRARTKLKQ

SEQ ID NO: 3546 - protein, 103 aa, Oryza sativa
  G3503,MYB-(R1)R2R3 domain
KGAWTKEEDDRLIAYIKAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 3547 - protein, 103 aa, Oryza sativa
  G3504,MYB-(R1)R2R3 domain
KGAWTKEEDERLVAYIRAHGEGCWRSLPKAAGLLRCGKSCRLRWINYLRPDLKRGNFTADEDDLIIKLHSLLGNKWSLIAARLPGRTDNEIKNYWNTHIRRKL

SEQ ID NO: 3548 - protein, 103 aa, Oryza sativa
  G3505,MYB-(R1)R2R3 domain
KGAWTKEEDQRLIAYIRAHGEGCWRSLPKAAGLLRCGKSCRLRWMNYLRPDLKRGNFTDDEDELIIRLHSLLGNKWSLIAGQLPGRTDNEIKNYWNTHIKRKL

SEQ ID NO: 3549 - protein, 103 aa, Oryza sativa
  G3506,MYB-(R1)R2R3 domain
KGAWTKEEDQRLIAYIKAHGEGCWRSLPKAAGLLRCGKSCRLRWMNYLRPDLKRGNFTDDDDELIIKLHALLGNKWSLIAGQLPGRTDNEIKNYWNTHIKRKL

SEQ ID NO: 3550 - protein, 103 aa, Oryza sativa
  G3507,MYB-(R1)R2R3 domain
KGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHIKRKL

SEQ ID NO: 3551 - protein, 103 aa, Oryza sativa
  G3508,MYB-(R1)R2R3 domain
KGAWTKEEDQRLIAYIKANGEGCWRSLPKAAGLLRCGKSCRLRWINYLRPDLKRGNFTEEEDEFIIKLHELLGNKWSLIAGRLPGRTDNEIKNYWNTHIKRKL

SEQ ID NO: 3552 - protein, 103 aa, Solanum lycopersicum
  G3509,MYB-(R1)R2R3 domain
KGAWTKEEDERLISYIRAHGEGCWRSLPKAAGLLRCGKSCRLRWINYLRPDLKRGNFTEEEDELIIKLHSLLGNKWSLIAGRLPGRTDNEIKNYWNTHIRRKL

SEQ ID NO: 3553 - protein, 61 aa, Oryza sativa
  G3510,HB domain
PHRPKKLRLSKEQSRLLEESFRLNHTLTPKQKEALAIKLKLRPRQVEVWFQNRRARTKLKQ

SEQ ID NO: 3554 - protein, 65 aa, Oryza sativa
  G3515,AP2 domain
SSSSYRGVRKRPWGKFAAEIRDPERGGARVWLGTFDTAEEAARAYDRAAFAMKGATAMLNFPGDH

SEQ ID NO: 3555 - protein, 65 aa, Zea mays
  G3516,AP2 domain
KEGKYRGVRKRPWGKFAAEIRDPERGGSRVWLGTFDTAEEAARAYDRAAFAMKGATAVLNFPASG

SEQ ID NO: 3556 - protein, 65 aa, Zea mays
  G3517,AP2 domain
EPTKYRGVRRRPWGKYAAEIRDSSRHGVRIWLGTFDTAEEAARAYDRSANSMRGANAVLNFPEDA

SEQ ID NO: 3557 - protein, 65 aa, Glycine max
  G3518,AP2 domain
VEVRYRGIRRRPWGKFAAEIRDPTRKGTRIWLGTFDTAEQAARAYDAAAFHFRGHRAILNFPNEY

SEQ ID NO: 3558 - protein, 65 aa, Glycine max
  G3519,AP2 domain
CEVRYRGIRRRPWGKFAAEIRDPTRKGTRIWLGTFDTAEQAARAYDAAAFHFRGHRAILNFPNEY

SEQ ID NO: 3559 - protein, 65 aa, Glycine max
  G3520,AP2 domain
EEPRYRGVRRRPWGKFAAEIRDPARHGARVWLGTFLTAEEAARAYDRAAYEMRGALAVLNFPNEY

SEQ ID NO: 3560 - protein, 61 aa, Glycine max
  G3524,HB domain
GEPPRKKLRLTKEQSRLLEESFRQNHTLNPKQKESLAMQLKLRPRQVEVWFQNRRARSKLK

SEQ ID NO: 3561 - protein, 105 aa, Glycine max
  G3527,MYB-(R1)R2R3 domain
NKGAWTKEEDDRLISYIRAHGEGCWRSLPKAAGLLRCGKSCRLRWINYLRPDLKRGNFTEEEDELIIKLHSLLGNKWSLIAGRLPGRTDNEIKNYWNTHIRRKLL

SEQ ID NO: 3562 - protein, 105 aa, Glycine max; identical to SEQ ID NO: 3561
  G3528,MYB-(R1)R2R3 domain

SEQ ID NO: 3563 - protein, 103 aa, Glycine max
  G3529,MYB-(R1)R2R3 domain
KGAWTKEEDHRLISYIRAHGEGCWRSLPKAAGLLRCGKSCRLRWINYLRPDLKRGNFSLEEDQLIIKLHSLLGNKWSLIAGRLPGRTDNEIKNYWNTHIRRKL

SEQ ID NO: 3564 - protein, 103 aa, Zea mays
  G3531,MYB-(R1)R2R3 domain
KGAWTKEEDDRLVAYIKAHGEGCWRSLPKAAGLVRCGKSCRLRWINYLRPDLKRGNFTEEEDELIIKLHSLLGNKWSLIAGRLPGRTDNEIKNYWNTHIRRKL

SEQ ID NO: 3565 - protein, 103 aa, Zea mays
  G3532,MYB-(R1)R2R3 domain
KGAWTKEEDERLVAHIRAHGEGCWRSLPKAAGLLRCGKSCRLRWINYLRPDLKRGNFTEEEDELIVKLHSVLGNKWSLIAGRLPGRTDNEIKNYWNTHIRRKL

SEQ ID NO: 3566 - protein, 103 aa, Zea mays; identical to SEQ ID NO: 3565
  G3533,MYB-(R1)R2R3 domain

SEQ ID NO: 3567 - protein, 103 aa, Zea mays
  G3534,MYB-(R1)R2R3 domain
RGAWTKEEDERLVAYVRAHGEGCWRSLPRAAGLLRCGKSCRLRWINYLRPDLKRGNFTADEDDLIVKLHSLLGNKWSLIAARLPGRTDNEIKNYWNTHVRRKL

SEQ ID NO: 3568 - protein, 97 aa, Oryza sativa
  G3542,CAAT domain
EEIEQTTDFKNHSLPLARIKKIMKADEDVRMISAEAPVVFAKACEVFILELTLRSWMHTEENKRRTLQKNDIAAAITRTDIYDFLVDIVPRDEMKEE

SEQ ID NO: 3569 - protein, 99 aa, Oryza sativa
  G3543,CAAT domain
QEAERASASDFKNHQLPLARIKKIMKADEDVRMISAEAPVLFAKACELFILELTIRSWLHAEENKRRTLQRNDVAAAIARTDVFDFLVDIVPREEAKEE

SEQ ID NO: 3570 - protein, 97 aa, Oryza sativa
  G3544,CAAT domain
VDIEQTTDFKNHSLPLARIKKIMKADEDVRMISAEAPVIFAKACEIFILELTLRSWMHTEENKRRTLQKNDIAAAITRTDMYDFLVDIVPRDDLKEE

SEQ ID NO: 3571 - protein, 101 aa, Oryza sativa
  G3545,CAAT domain
EVEQMTEFKLPNLPLARIKKIMKADEDVKMIAGEAPALFAKACEMFILDMTLRSWQHTEEGRRRTLQRSDVEAVIKKTDIFDFLVDIITDDKMKDDGMGSQ

SEQ ID NO: 3572 - protein, 98 aa, Oryza sativa
  G3546,CAAT domain
REIEHTTDFKNHNLPLARIKKIMKADEDVRMIAAEAPVVFARACEMFILELTHRGWAHAEENKRRTLQKSDIAAAIARTEVFDFLVDIVPRDEAKDAE

SEQ ID NO: 3573 - protein, 97 aa, Glycine max
  G3547,CAAT domain
QEIEKVTDFKNHSLPLARIKKIMKADEDVRMISAEAPVIFARACEMFILELTLRSWNHTEENKRRTLQKNDIAAAITRTDIFDFLVDIVPREDLKDE

SEQ ID NO: 3574 - protein, 97 aa, Glycine max; identical to SEQ ID NO: 3573
  G3547,CAAT domain

SEQ ID NO: 3575 - protein, 97 aa, Glycine max
  G3548,CAAT domain
QEIEQTIDFKNHSLPLARIKKIMKADEDVRMISAEAPVIFAKACEMFILELTLRSWIHTEENKRRTLQKNDIAAAISRNDVFDFLVDIIPRDELKEE

SEQ ID NO: 3576 - protein, 97 aa, Glycine max; identical to SEQ ID NO: 3575
  G3549,CAAT domain

SEQ ID NO: 3577 - protein, 97 aa, Glycine max; identical to SEQ ID NO: 3575
  G3550,CAAT domain

SEQ ID NO: 3578 - protein, 101 aa, Zea mays
  G3551,CAAT domain
TEIEATTDFKNHNLPLARIKKIMKADEDVRMISAEAPVVFAKACEIFILELTLRSWMHTEVNKRRTLQKNDIAAAITRTDIYDFLVDIVPRDEMKEDGIGL

SEQ ID NO: 3579 - protein, 97 aa, Zea mays
  G3552,CAAT domain
TEIEATTDFKNHNLPLARIKKIMKADEDVRMISAEAPVVFAKACEIFILELTLRSWMHTEENKRRTLQKNDIAAAITRTDIYDFLVDIVPRDEMKED

SEQ ID NO: 3580 - protein, 97 aa, Solanum lycopersicum
  G3553,CAAT domain
QEIEHVTDFKNHSLPLARIKKIMKADEDVRMISAEAPVVFARACEMFILELTLRAWNHTEENKRRTLQKNDIAAAITRTDIFDFLVDIVPREDLKDE

SEQ ID NO: 3581 - protein, 97 aa, Solanum lycopersicum; identical to SEQ ID NO: 3580
  G3554,CAAT domain

SEQ ID NO: 3582 - protein, 97 aa, Solanum lycopersicum
  G3555,CAAT domain
QEIEQVNDFKNHQLPLARIKKIMKADEDVRMISAEAPVLFAKACELFILELTIRSWLHAEENKRRTLQKNDIAAAITRTDIFDFLVDIVPRDEIKDE

SEQ ID NO: 3583 - protein, 9 aa, Oryza sativa
  G3556 AT-hook domain
RRPRGRPPG

SEQ ID NO: 3584 - protein, 144 aa, Oryza sativa
  G3556 2nd conserved domain
GSKNKPKPPVVVTRESPNAMRSHVLEIASGADIVEAIAGFSRRRQRGVSVLSGSGAVTNVTLRQPAGTGAAAVALRGRFEILSMSGAFLPAPAPPGATGLAVYLAGGQGQVVGGSVMGELIASGPVMVIAATFGNATYERLPLD

SEQ ID NO: 3585 - protein, 66 aa, Glycine max
  G3643,AP2 domain
TNNKLKGVRRRKWGKWVSEIRVPGTQERLWLGTYATPEAAAVAHDVAVYCLSRPSSLDKLNFPETL

SEQ ID NO: 3586 - protein, 71 aa, Oryza sativa
  G3644,AP2 domain
ERCRYRGVRRRRWGKWVSEIRVPGTRERLWLGSYATPEAAAVAHDTAVYFLRGGAGDGGGGGATLNFPERA

SEQ ID NO: 3587 - protein, 66 aa, Brassica rapa subsp. Pekinensis
  G3645,AP2 domain
TQSKYKGIRRRKWGKWVSEIRVPGTRDRLWLGSFSTAEGAAVAHDVAFYCLHQPNSLESLNFPHLL

SEQ ID NO: 3588 - protein, 68 aa, Brassica oleracea
  G3646,AP2 domain
HQAKYKGIRRRKWGKWVSEIRVPATRERLWLGSFSTAEGAAVAHDVAFYCLHRPSSLDNEAFNFPHLL

SEQ ID NO: 3589 - protein, 66 aa, Zinnia elegans
  G3647,AP2 domain
SQKTYKGVRCRRWGKWVSEIRVPGSRERLWLGTYSTPEGAAVAHDVASYCLKGNTSFHKLNIPSML

SEQ ID NO: 3590 - protein, 73 aa, Oryza sativa
  G3649,AP2 domain
EMMRYRGVRRRRWGKWVSEIRVPGTRERLWLGSYATAEAAAVAHDAAVCLLRLGGGRRAAAGGGGGLNFPARA

SEQ ID NO: 3591 - protein, 65 aa, Zea mays
  G3650,AP2 domain
RRCRYRGVRRRAWGKWVSEIRVPGTRERLWLGSYAAPEAAAVAHDAAACLLRGCAGRRLNFPGRA

SEQ ID NO: 3592 - protein, 71 aa, Oryza sativa
  G3651,AP2 domain
ERCRYRGVRRRRWGKWVSEIRVPGTRERLWLGSYATPEAAAVAHDTAVYFLRGGAGDGGGGGATAQLPGAR

SEQ ID NO: 3593 - protein, 63 aa, Oryza sativa
  G3657,AP2 domain
VRPYKGVRMRSWGSWVSEIRAPHQKRRIWLGSYATPEAAARAYDAALLCLKGSDAVLNFPSSA

SEQ ID NO: 3594 - protein, 65 aa, Brassica oleracea
  G3659,AP2 domain
KGKHYRGVRQRPWGKFAAEIRDPAKNGARVWLGTFETAEDAALAYDRAAFRMRGSRALLNFPLRV

SEQ ID NO: 3595 - protein, 65 aa, Brassica oleracea
  G3660,AP2 domain
KGKHYRGVRQRPWGKFAAEIRDPAKKGAREWLGTFETAEDAALAYDRAAFRMRGSRALLNFPLRV

SEQ ID NO: 3596 - protein, 65 aa, Zea mays
  G3661,AP2 domain
RGKHYRGVRQRPWGKFAAEIRDPARNGARVWLGTYDTAEDAALAYDRAAYRMRGSRALLNFPLRI

SEQ ID NO: 3597 - protein, 54 aa, Oryza sativa
  G3674 ZF domain
ARYRECLKNHAVGIGGHAVDGCGEFMASGEEGSIDALRCAACGCHRNFHRKESE

SEQ ID NO: 3598 - protein, 64 aa, Oryza sativa
  G3674 HB domain
KKRFRTKFTQEQKDKMLAFAERLGWRIQKHDEAAVQQFCEEVCVKRHVLKVWMHNNKHTLGKKA

SEQ ID NO: 3599 - protein, 50 aa, Zea mays
  G3676 ZF domain
ARYHECLRNHAAALGGHVVDGCGEFMPGDGDSLKCAACGCHRSFHRKDDA

SEQ ID NO: 3600 - protein, 64 aa, Zea mays
  G3676 HB domain
RKRFRTKFTPEQKEQMLAFAERLGWRLQKQDDALVQHFCDQVGVRRQVFKVWMHNNKHTGRRQQ

SEQ ID NO: 3601 - protein, 56 aa, Zea mays
  G3680 ZF domain
PLYRECLKNHAASLGGHAVDGCGEFMPSPGANPADPTSLKCAACGCHRNFHRRTLE

SEQ ID NO: 3602 - protein, 64 aa, Zea mays
  G3680 HB domain
RKRFRTKFTAEQKQRMQELSERLGWRLQKRDEAIVDEWCRDIGVGKGVFKVWMHNNKHNFLGGH

SEQ ID NO: 3603 - protein, 56 aa, Zea mays
  G3681 ZF domain
PLYRECLKNHAASLGGHAVDGCGEFMPSPGANPADPTSLKCAACGCHRNFHRRTVE

SEQ ID NO: 3604 - protein, 64 aa, Zea mays
  G3681 HB domain
RKRFRTKFTAEQKQRMQELSERLGWRLQKRDEAVVDEWCRDMGVGKGVFKVWMHNNKHNFLGGH

SEQ ID NO: 3605 - protein, 54 aa, Oryza sativa
  G3683 ZF domain
ARYRECLKNHAAAIGGSATDGCGEFMPGGEEGSLDALRCSACGCHRNFHRKELD

SEQ ID NO: 3606 - protein, 64 aa, Oryza sativa
  G3683 HB domain
RKRFRTKFTAEQKARMLGFAEEVGWRLQKLEDAVVQRFCQEVGVKRRVLKVWMHNNKHTLARRH

SEQ ID NO: 3607 - protein, 53 aa, Oryza sativa
  G3685 ZF domain
VRYHECLRNHAAAMGGHVVDGCREFMPMPGDAADALKCAACGCHRSFHRKDDG

SEQ ID NO: 3608 - protein, 64 aa, Oryza sativa
  G3685 HB domain
RKRFRTKFTPEQKEQMLAFAERVGWRMQKQDEALVEQFCAQVGVRRQVFKVWMHNNKSSIGSSS

SEQ ID NO: 3609 - protein, 51 aa, Oryza sativa
  G3686 ZF domain
CRYHECLRNHAAASGGHVVDGCGEFMPASTEEPLACAACGCHRSFHRRDPS

SEQ ID NO: 3610 - protein, 64 aa, Oryza sativa
  G3686 HB domain
RRRSRTTFTREQKEQMLAFAERVGWRIQRQEEATVEHFCAQVGVRRQALKVWMHNNKHSFKQKQ

SEQ ID NO: 3611 - protein, 53 aa, Oryza sativa
  G3690 ZF domain
WRYRECLKNHAARMGAHVLDGCGEFMSSPGDGAAALACAACGCHRSFHRREPA

SEQ ID NO: 3612 - protein, 64 aa, Oryza sativa
  G3690 HB domain
KKRFRTKFTAEQKERMREFAHRVGWRIHKPDAAAVDAFCAQVGVSRRVLKVWMHNNKHLAKTPP

SEQ ID NO: 3613 - protein, 65 aa, Glycine max
  G3717,AP2 domain
KGKHYRGVRQRPWGKFAAEIRDPAKNGARVWLGTFETAEDAALAYDRAAYRMRGSRALLNFPLRV

SEQ ID NO: 3614 - protein, 65 aa, Glycine max
  G3718,AP2 domain
KGKHYRGVRQRPWGKFAAEIRDPAKNGARVWLGTFETAEDAALAYDRAAYRMRGSRALLNFPLRI

SEQ ID NO: 3615 - protein, 57 aa, Zea mays
  G3719,WRKY domain
DDGFKWRKYGKKTVKSSPNPRNYYRCSAEGCGVKKRVERDSDDPRYVVTTYDGVHNH

SEQ ID NO: 3616 - protein, 57 aa, Zea mays
  G3720,WRKY domain
DDGYKWRKYGKKSVKNSPNPRNYYRCSTEGCNVKKRVERDKDDPSYVVTTYEGMHNH

SEQ ID NO: 3617 - protein, 57 aa, Oryza sativa
  G3721,WRKY domain
DDGFKWRKYGKKAVKNSPNPRNYYRCSTEGCNVKKRVERDREDHRYVITTYDGVHNH

SEQ ID NO: 3618 - protein, 57 aa, Zea mays
  G3722,WRKY domain
DDGYKWRKYGKKSVKNSPNPRNYYRCSTEGCNVKKRVERDRDDPRYVVTMYEGVHNH

SEQ ID NO: 3619 - protein, 57 aa, Glycine max
  G3723,WRKY domain
DDGYKWRKYGKKTVKSSPNPRNYYKCSGEGCDVKKRVERDRDDSNYVLTTYDGVHNH

SEQ ID NO: 3620 - protein, 57 aa, Glycine max
  G3724,WRKY domain
DDGYKWRKYGKKSVKSSPNLRNYYKCSSGGCSVKKRVERDRDDYSYVITTYEGVHNH

SEQ ID NO: 3621 - protein, 57 aa, Oryza sativa
  G3725,WRKY domain
DDGYKWRKYGKKSVKNSPNPRNYYRCSTEGCNVKKRVERDKNDPRYVVTMYEGIHNH

SEQ ID NO: 3622 - protein, 57 aa, Oryza sativa
  G3726,WRKY domain
DDGYKWRKYGKKSVKNSPNPRNYYRCSTEGCNVKKRVERDKDDPSYVVTTYEGTHNH

SEQ ID NO: 3623 - protein, 57 aa, Zea mays
  G3727,WRKY domain
DDGFKWRKYGKKAVKSSPNPRNYYRCSSEGCGVKKRVERDRDDPRYVITTYDGVHNH

SEQ ID NO: 3624 - protein, 57 aa, Zea mays
  G3728,WRKY domain
DDGFKWRKYGKKAVKNSPNPRNYYRCSSEGCGVKKRVERDRDDPRYVITTYDGVHNH

SEQ ID NO: 3625 - protein, 57 aa, Oryza sativa
  G3729,WRKY domain
DDGYRWRKYGKKMVKNSPNPRNYYRCSSEGCRVKKRVERARDDARFVVTTYDGVHNH

SEQ ID NO: 3626 - protein, 57 aa, Oryza sativa
  G3730,WRKY domain
DDGFKWRKYGKKAVKSSPNPRNYYRCSAAGCGVKKRVERDGDDPRYVVTTYDGVHNH

SEQ ID NO: 3627 - protein, 65 aa, Oryza sativa
  G3737,AP2 domain
AASKYRGVRRRPWGKFAAEIRDPERGGSRVWLGTFDTAEEAARAYDRAAFAMKGAMAVLNFPGRT

SEQ ID NO: 3628 - protein, 65 aa, Zea mays
  G3739,AP2 domain
EPTKYRGVRRRPWGKYAAEIRDSSRHGVRIWLGTFDTAEEAARAYDRSAYSMRGANAVLNFPEDA

SEQ ID NO: 3629 - protein, 59 aa, Oryza sativa
  G3742,HLH/MYC domain
KRGCATHPRSIAERVRRTRISERIRKLQELVPNMEKQTNTADMLDLAVDYIKELQKQVK

SEQ ID NO: 3630 - protein, 59 aa, Oryza sativa
  G3744,HLH/MYC domain
KRGCATHPRSIAERVRRTRISERIRKLQELVPNMDKQTNTADMLDLAVDYIKDLQKQVK

SEQ ID NO: 3631 - protein, 59 aa, Oryza sativa
  G3746,HLH/MYC domain
KRGCATHPRSIAERERRTRISKRLKKLQDLVPNMDKQTNTSDMLDIAVTYIKELQGQVE

SEQ ID NO: 3632 - protein, 58 aa, Oryza sativa
  G3750,HLH/MYC domain
RRGQATDPHSIAERLRRERIAERMRALQELVPNTNKTDRAAMLDEILDYVKFLRLQVK

SEQ ID NO: 3633 - protein, 59 aa, Zea mays
  G3755,HLH/MYC domain
KRGCATHPRSIAERVRRTKISERIRKLQELVPNMDKQTNTSDMLDLAVDYIKDLQKQVK

SEQ ID NO: 3634 - protein, 58 aa, Zea mays
  G3760,HLH/MYC domain
RRGQATDPHSIAERLRRERIAERMKALQELVPNANKTDKASMLDEIVDYVKFLQLQVK

SEQ ID NO: 3635 - protein, 59 aa, Glycine max
  G3765,HLH/MYC domain
KRGFATHPRSIAERVRRTRISERIRKLQELVPTMDKQTSTAEMLDLALDYIKDLQKQFK

SEQ ID NO: 3636 - protein, 59 aa, Glycine max
  G3766,HLH/MYC domain
KRGCATHPRSIAERVRRTRISERMRKLQELVPHMDKQTNTADMLDLAVEYIKDLQKQFK

SEQ ID NO: 3637 - protein, 59 aa, Glycine max
  G3767,HLH/MYC domain
KRGCATHPRSIAERVRRTKISERMRKLQDLVPNMDKQTNTADMLDLAVDYIKDLQKQVQ

SEQ ID NO: 3638 - protein, 59 aa, Glycine max; identical to SEQ ID NO: 3637
  G3768,HLH/MYC domain

SEQ ID NO: 3639 - protein, 59 aa, Glycine max
  G3769,HLH/MYC domain
KRGCATHPRSIAERVRRTKISERMRKLQDLVPNMDKQTNTADMLDLAVEYIKDLQNQVQ

SEQ ID NO: 3640 - protein, 59 aa, Glycine max
  G3771,HLH/MYC domain
KRGCATHPRSIAERVRRTRISDRIRKLQELVPNMDKQTNTADMLDEAVAYVKFLQKQIE

SEQ ID NO: 3641 - protein, 65 aa, Zea mays
  G3794,AP2 domain
EPTKYRGVRRRPSGKFAAEIRDSSRQSVRMWLGTFDTAEEAARAYDRAAYAMRGQIAVLNFPAEA

SEQ ID NO: 3642 - protein, 57 aa, Glycine max
  G3803,WRKY domain
DDGYKWRKYGKKTVKNNPNPRNYYKCSGEGCNVKKRVERDRDDSNYVLTTYDGVHNH

SEQ ID NO: 3643 - protein, 57 aa, Zea mays; identical to SEQ ID NO: 3624
  G3804,WRKY domain

SEQ ID NO: 3644 - protein, 66 aa, Glycine max
  G3810,1st SCR domain
QKLFFELFPFLKVAFVLTNQAIIEAMEGEKVIHIIDLNAAEAAQWIALLRVLSAHPEGPPHLRITG

SEQ ID NO: 3645 - protein, 70 aa, Glycine max
  G3810,2nd SCR domain
FLNALWGLSPKVMVVTEQDCNHNGPTLMDRLLEALYSYAALFDCLESTVSRTSLERLRVEKMLFGEEIKN

SEQ ID NO: 3646 - protein, 74 aa, Glycine max
  G3810,3rd SCR domain
CEGSERKERHEKLEKWFQRFDLAGFGNVPLSYFGMVQARRFLQSYGCEGYRMRDENGCVLICWEDRPMYSISAW

SEQ ID NO: 3647 - protein, 66 aa, Glycine max
  G3811,1st SCR domain
QKLFFELLPFLKFSYILTNQAIVEAMEGEKMVHIVDLYGAGPAQWISLLQVLSARPEGPPHLRITG

SEQ ID NO: 3648 - protein, 70 aa, Glycine max
  G3811,2nd SCR domain
FLNALWGLSPKVMVVTEQDFNHNCLTMMERLAEALFSYAAYFDCLESTVSRASMDRLKLEKMLFGEEIKN

SEQ ID NO: 3649 - protein, 74 aa, Glycine max
  G3811,3rd SCR domain
CEGCERKERHEKMDRWIQRLDLSGFANVPISYYGMLQGRRFLQTYGCEGYKMREECGRVMICWQERSLFSITAW

SEQ ID NO: 3650 - protein, 66 aa, Oryza sativa
  G3813,1st SCR domain
RRHFLDLCPFLRLAGAAANQSILEAMESEKIVHVIDLGGADATQWLELLHLLAARPEGPPHLRLTS

SEQ ID NO: 3651 - protein, 70 aa, Oryza sativa
  G3813,2nd SCR domain
FLGALWGLSPKVMVVAEQEASHNAAGLTERFVEALNYYAALFDCLEVGAARGSVERARVERWLLGEEIKN

SEQ ID NO: 3652 - protein, 74 aa, Oryza sativa
  G3813,3rd SCR domain
CDGGERRERHERLERWARRLEGAGFGRVPLSYYALLQARRVAQGLGCDGFKVREEKGNFFLCWQDRALFSVSAW

SEQ ID NO: 3653 - protein, 68 aa, Oryza sativa
  G3814,1st SCR domain
RRHMFDVLPFLKLAYLTTNHAILEAMEGERFVHVVDFSGPAANPVQWIALFHAFRGRREGPPHLRITA

SEQ ID NO: 3654 - protein, 69 aa, Oryza sativa
  G3814,2nd SCR domain
FLSAVRSLSPKIMVMTEQEANHNGGAFQERFDEALNYYASLFDCLQRSAAAAAERARVERVLLGEEIRG

SEQ ID NO: 3655 - protein, 77 aa, Oryza sativa
  G3814,3rd SCR domain
CEGAERVERHERARQWAARMEAAGMERVGLSYSGAMEARKLLQSCGWAGPYEVRHDAGGHGFFFCWHKRPLYAVTAW

SEQ ID NO: 3656 - protein, 66 aa, Solanum lycopersicum
  G3824,1st SCR domain
RKMFFEIFPFLKVAFVVTNQAIIEAMEGEKMVHIVDLNAAEPLQWRALLQDLSARPEGPPHLRITG

SEQ ID NO: 3657 - protein, 70 aa, Solanum lycopersicum
  G3824,2nd SCR domain
FLNALWGLSPKVMVVTEQDANHNGTTLMERLSESLHFYAALFDCLESTLPRTSLERLKVEKMLLGEEIRN

SEQ ID NO: 3658 - protein, 74 aa, Solanum lycopersicum
  G3824,3rd SCR domain
CEGIERKERHEKLEKWFQRFDTSGFGNVPLSYYAMLQARRLLQSYSCEGYKIKEDNGCVVICWQDRPLFSVSSW

SEQ ID NO: 3659 - protein, 70 aa, Oryza sativa
  G3827,1st SCR domain
DVESLRGLSLKVMVVTEQEVSHNAAGLTERFVEALNYYAALFDCLEVGGARGSVERTRVERWLLGEEIKN

SEQ ID NO: 3660 - protein, 67 aa, Oryza sativa
  G3827,2nd SCR domain
CDGGERRERHERLEGAGFGRVPLSYYALLQARRVAQGLGCDGFKVREEKGNFFLCWQDRALFSVSAW

SEQ ID NO: 3661 - protein, 90 aa, Oryza sativa
  G3835,CAAT domain
NGQDNLLPIANVGRIMKDGLPPQAKISKRAKETIQECATEFISFVTGEASERCRRERRKTVNGDDVCHAMRSLGLDHYADAMHRYLQRYR

SEQ ID NO: 3662 - protein, 90 aa, Glycine max
  G3837,CAAT domain
KEQDRLLPIANVGRIMKQILPPNAKISKEAKETMQECVSEFISFVTGEASDKCHKEKRKTVNGDDICWALATLGFDDYSEPLKRYLHKYR

SEQ ID NO: 3663 - protein, 90 aa, Zea mays
  G3839,CAAT domain
REQDRLMPVANVSRIMRQVLPPYAKISDDAKEVIQECVSEFISFVTGEANERCHTERRKTVTSEDIVWAMSRLGFDDYVAPLGAFLQRMR

SEQ ID NO: 3664 - protein, 90 aa, Zea mays; identical to SEQ ID NO: 3663
  G3839,CAAT domain

SEQ ID NO: 3665 - protein, 65 aa, Solanum lycopersicum
  G3841,AP2 domain
KGRHYRGVRQRPWGKFAAEIRDPAKNGARVWLGTYETAEEAAIAYDKAAYRMRGSKAHLNFPHRI

SEQ ID NO: 3666 - protein, 65 aa, Solanum lycopersicum
  G3843,AP2 domain
KAKHYRGVRVRPWGKFAAEIRDPAKNGARVWLGTYETAEDAALAYDKAAFRMRGSRALLNFPLRI

SEQ ID NO: 3667 - protein, 65 aa, Medicago truncatula; identical to SEQ ID NO: 3613
  G3844,AP2 domain

SEQ ID NO: 3668 - protein, 65 aa, Nicotiana tabacum
  G3845,AP2 domain
RGRHYRGVRRRPWGKFAAEIRDPAKNGARVWLGTYETDEEAAIAYDKAAYRMRGSKAHLNFPHRI

SEQ ID NO: 3669 - protein, 65 aa, Nicotiana tabacum
  G3846,AP2 domain
KGRHYRGVRQRPWGKFAAEIRDPAKNGARVWLGTYETAEEAALAYDKAAYRMRGSKALLNFPHRI

SEQ ID NO: 3670 - protein, 65 aa, Oryza sativa
  G3848,AP2 domain
RGKHYRGVRQRPWGKFAAEIRDPAKNGARVWLGTFDTAEDAALAYDRAAYRMRGSRALLNFPLRI

SEQ ID NO: 3671 - protein, 66 aa, Solanum lycopersicum
  G3852,AP2 domain
PKGRHYRGVRQRPWGKFAAEIRDPAKNGARVWLGTYESAEEAALAYGKAAFRMRGTKALLNFPHRI

SEQ ID NO: 3672 - protein, 65 aa, Zea mays
  G3856,AP2 domain
RGKHYRGVRQRPWGKFAAEIRDPAKNGARVWLGTYDSAEDAAVAYDRAAYRMRGSRALLNFPLRI

SEQ ID NO: 3673 - protein, 65 aa, Solanum tuberosum; identical to SEQ ID NO: 3665
  G3857,AP2 domain

SEQ ID NO: 3674 - protein, 65 aa, Solanum tuberosum
  G3858,AP2 domain
KGRHYRGVRQRPWGKFAAEIRDPAKNGARVWLGTYESAEEAALAYDIAAFRMRGTKALLNFPHRI

SEQ ID NO: 3675 - protein, 65 aa, Triticum aestivum
  G3864,AP2 domain
RGKHFRGVRQRPWGKFAAEIRDPAKNGARVWLGTFDSAEDAAVAYDRAAYRMRGSRALLNFPLRI

SEQ ID NO: 3676 - protein, 65 aa, Triticum aestivum; identical to SEQ ID NO: 3675
  G3865,AP2 domain

SEQ ID NO: 3677 - protein, 97 aa, Zea mays
  G3866,CAAT domain
REQDRFLPIANISRIMKKAIPANGKTIPANGKIAKDAKETVQECVSEFISFITSEASDKCQREKRKTINGDDLLWAMATLGFEDYIEPLKVYLQKYR

SEQ ID NO: 3678 - protein, 90 aa, Glycine max
  G3873,CAAT domain
REQDRFLPIANISRIMKKALPPNGKIAKDAKETVQECVSEFISFVTSEASDKCQREKRKTINGDDLLWAMTTLGFEEYIDPLKVYLAAYR

SEQ ID NO: 3679 - protein, 90 aa, Glycine max
  G3874,CAAT domain
REQDRYLPIANISRIMKKALPANGKIAKDAKETVQECVSEFISFITSEASDKCQREKRKTINGDDLLWAMATLGFEDYMDPLKIYLTRYR

SEQ ID NO: 3680 - protein, 90 aa, Glycine max
  G3875,CAAT domain
REQDRYLPIANISRIMKKALPANGKIAKDAKETVQECVSEFISFITSEASDKCQREKRKTINGDDLLWAMATLGFEDYIDPLKIYLTRYR

SEQ ID NO: 3681 - protein, 90 aa, Zea mays
  G3876,CAAT domain
REQDRFLPIANISRIMKKAIPANGKIAKDAKETVQECVSEFISFITSEASDKCQREKRKTINGDDLLWAMATLGFEDYIEPLKVYLQKYR

SEQ ID NO: 3682 - protein, 97 aa, Gossypium raimondii; identical to SEQ ID NO: 2706
  G3883,CAAT domain

SEQ ID NO: 3683 - protein, 97 aa, Nicotiana benthamiana
  G3884,CAAT domain
QEIEQVNDFKNHQLPLARIKKIMKADEDVRMISAEAPILFAKACELFILELTIRSWLHAEENKRRTLQKNDIAAAITRTDIFDFLVDIVPRDEIKEE

SEQ ID NO: 3684 - protein, 97 aa, Solanum tuberosum; identical to SEQ ID NO: 3582
  G3885,CAAT domain

SEQ ID NO: 3685 - protein, 97 aa, Glycine max
  G3886,CAAT domain
QEIEHVNDFKNHQLPLARIKKIMKADEDVRMISAEAPILFAKACELFILELTIRSWLHAEENKRRTLQKNDIAAAITRTDIFDFLVDIVPRDEIKDD

SEQ ID NO: 3686 - protein, 99 aa, Zea mays; identical to SEQ ID NO: 3569
  G3889,CAAT domain

SEQ ID NO: 3687 - protein, 97 aa, Solanum tuberosum; identical to SEQ ID NO: 3580
  G3892,CAAT domain

SEQ ID NO: 3688 - protein, 97 aa, Solanum tuberosum; identical to SEQ ID NO: 3580
  G3893,CAAT domain

SEQ ID NO: 3689 - protein, 97 aa, Solanum lycopersicum; identical to SEQ ID NO: 3580
  G3894,CAAT domain

SEQ ID NO: 3690 - protein, 97 aa, Medicago truncatula; identical to SEQ ID NO: 3573
  G3896,CAAT domain

SEQ ID NO: 3691 - protein, 97 aa, Daucus carota
  G3899,CAAT domain
QEIGQTPDFKNHSLPLARIKKIMKADEDVRMISSEAPVIFAKACEMFILELTMRSWLLTEENKRRTLQKNDIAAAISRTDIFDFLVDIIPRDELKEE

SEQ ID NO: 3692 - protein, 97 aa, Daucus carota
  G3900,CAAT domain
QEIEQTTDFKNHSLPLARIKKIMKADEDVRMISSEAPVVFAKACEMFIMDLTMRSWSHTEENKRRTLQKNDIAAAVSRTDVFDFLVDIIPKDEMKED

SEQ ID NO: 3693 - protein, 93 aa, Gossypium arboreum
  G3907,CAAT domain
HEIEQTTDFKNHSLPLARIKKIMKADEDVRMISAEAPVIFAKACEMFVLELTLRSWIHTEENKRRTLQKNDIAAAISRTDVFDFLVDIIPGTE

SEQ ID NO: 3694 - protein, 98 aa, Zea mays
  G3909,CAAT domain
REIEATTDFKNHNLPLARIKKIMKADEDVRMIAAEAPVVFSRACEMFILELTHRGWAHAEENKRRTLQKSDIAAAVARTEVFDFLVDIVPRDEAKDAD

SEQ ID NO: 3695 - protein, 98 aa, Zea mays
  G3911,CAAT domain
REIEATTDFKNHNLPLARIKKIMKADEDVRMIAAEAPVVFARACEMFILELTHRGWAHAEENKRRTLQKSDIAAAIARTEVFDFLVDIVPRDDGKDAD

SEQ ID NO: 3696 - protein, 91 aa, Oryza sativa
  G3917,1st TH domain
GAGGNRWPRQETLALLKIRSDMDAAFRDATLKGPLWEEVSRKLAEEGYRRSAKKCKEKFENVHKYYKRTKESRAGRNDGKTYRFFTQLEAL

SEQ ID NO: 3697 - protein, 94 aa, Oryza sativa
  G3917,2nd TH domain
SSRWPKAEVHALIQLRSNLDNRYQEAGPKGPLWEEISAGMRRLGYSRSSKRCKEKWENINKYFKKVKESNKKRPEDSKTCPYFHQLDALYRNKA

SEQ ID NO: 3698 - protein, 60 aa, Glycine max
  G3920,CAAT domain
EPVYVNAKQYHGILRRRQSRAKAEIEKKVIKNRKPYLHESRHLHAMRRARGNGGRFLNTK

SEQ ID NO: 3699 - protein, 60 aa, Zea mays
  G3921,CAAT domain
EPIYVNAKQYHAILRRRQTRAKLEAQNKMVKGRKPYLHESRHRHAMKRARGSGGRFLNTK

SEQ ID NO: 3700 - protein, 60 aa, Oryza sativa
  G3924,CAAT domain
EPVYVNAKQYHGILRRRQSRAKAELEKKVVKSRKPYLHESRHQHAMRRARGTGGRFLNTK

SEQ ID NO: 3701 - protein, 60 aa, Oryza sativa
  G3925,CAAT domain
EPIYVNAKQYHAILRRRQLRAKLEAENKLVKNRKPYLHESRHQHAMKRARGTGGRFLNTK

SEQ ID NO: 3702 - protein, 59 aa, Oryza sativa
  G3926,CAAT domain
EPIFVNAKQYNAILRRRQTRAKLEAQNKAVKGRKPYLHESRHHHAMKRARGSGGRFLTK

SEQ ID NO: 3703 - protein, 45 aa, Arabidopsis thaliana
  G3930,MYB-related domain
INMTEQEEDLIFRMYRLVGDRWDLIARRVVGREAKEIERYWIMRN

SEQ ID NO: 3704 - protein, 89 aa, Zea mays
  G3931,CAAT domain
EQDRLLPIANVGRIMKQILPPNAKISKEAKETMQECVSEFIGFVTGEASDKCHKEKRKTVNGDDLCWAFGALGFDDYVDPMRGYLHKYR

SEQ ID NO: 3705 - protein, 90 aa, Zea mays
  G3937,CAAT domain
REQDRLMPIANVIRIMRRVLPAHAKISDDAKETIQECVSEYISFITGEANERCQREQRKTITAEDVLWAMSRLGFDDYVEPLGAYLHRYR

SEQ ID NO: 3706 - protein, 90 aa, Oryza sativa
  G3939,CAAT domain
REQDRLMPIANVIRIMRRVLPAHAKISDDAKETIQECVSEYISFITGEANERCQREQRKTITAEDVLWAMSRLGFDDYVEPLGVYLHRYR

SEQ ID NO: 3707 - protein, 89 aa, Oryza sativa
  G3940,CAAT domain
KEDVSLPKSTMFKIIKEMLPPDVRVARDAQDLLVECCVEFINLLSSESNEVCSREDKKTIAPEHVLRALQDLGFREYIEEVQAAYEHHK

SEQ ID NO: 3708 - protein, 1173 aa, Arabidopsis thaliana; identical to SEQ ID NO: 2242
  G3967,VAR domain

SEQ ID NO: 3709 - protein, 90 aa, Saccharomyces cerevisiae
  G3969,CAAT domain
REQDRWLPINNVARLMKNTLPPSAKVSKDAKECMQECVSELISFVTSEASDRCAADKRKTINGEDILISLHALGFENYAEVLKIYLAKYR

SEQ ID NO: 3710 - protein, 56 aa, Glycine max; identical to SEQ ID NO: 3541
  G3980,MADS domain

SEQ ID NO: 3711 - protein, 56 aa, Glycine max; identical to SEQ ID NO: 3541
  G3981,MADS domain

SEQ ID NO: 3712 - protein, 42 aa, Zea mays
  G4000,Z-CO-like domain
CELCGGAAAVHCAADSAFLCLRCDAKVHGANFLASRHVRRRL

SEQ ID NO: 3713 - protein, 46 aa, Glycine max
  G4004,Z-CO-like domain
CELCHQLASLYCPSDSAFLCFHCDAAVHAANFLVARHLRRLLCSKC

SEQ ID NO: 3714 - protein, 46 aa, Glycine max
  G4005,Z-CO-like domain
CELCDQQASLYCPSDSAFLCSDCDAAVHAANFLVARHLRRLLCSKC

SEQ ID NO: 3715 - protein, 46 aa, Citrus sinensis
  G4007,Z-CO-like domain
CELCSQEAALHCASDEAFLCFDCDDRVHKANFLVARHVRQTLCSQC

SEQ ID NO: 3716 - protein, 46 aa, Populus trichocarpa
  G4009,Z-CO-like domain
CELCKGEAGVYCDSDAAYLCFDCDSNVHNANFLVARHIRRVICSGC

SEQ ID NO: 3717 - protein, 42 aa, Oryza sativa
  G4011,Z-CO-like domain
CALCGAAAAVHCEADAAFLCAACDAKVHGANFLASRHHRRRV

SEQ ID NO: 3718 - protein, 42 aa, Oryza sativa
  G4012,Z-CO-like domain
CELCGGVAAVHCAADSAFLCLVCDDKVHGANFLASRHRRRRL

SEQ ID NO: 3719 - protein, 101 aa, Glycine max
  G4218,MYB-(R1)R2R3 domain
KGPWSAEEDRILTGLVERYGPRNWSLISRYIKGRSGKSCRLRWCNQLSPAVEHRPFSAQEDDTIIAAHAQYGNRWATIARLLPGRTDNAVKNHWNSTLKRR

SEQ ID NO: 3720 - protein, 101 aa, Glycine max
  G4219,MYB-(R1)R2R3 domain
KGPWSAQEDRILTRLVEQYGPRNWSLISRYIKGRSGKSCRLRWCNQLSPTVEHRPFSTQEDETIIAAHARYGNRWATIARLLPGRTDNAVKNHWNSTLKRR

SEQ ID NO: 3721 - protein, 101 aa, Glycine max
  G4220,MYB-(R1)R2R3 domain
KGPWSPEEDEALRALVQAHGPRNWSVISKSIPGRSGKSCRLRWCNQLSPQVAHRPFSQEEDEAIIMAHAKFGNKWATIARLLNGRTDNAVKNHWNSTLKRK

SEQ ID NO: 3722 - protein, 102 aa, Glycine max
  G4221,MYB-(R1)R2R3 domain
KGPWSPEEDEALRRLVQAHGPRNWSVISKSVPGRSGKSCRLRWCNQLSPQVAHRPFSPDEDEAIVRAHARFGNKWATIARLLNNGRTDNAVKNHWNSTLKRK

SEQ ID NO: 3723 - protein, 101 aa, Glycine max
  G4222,MYB-(R1)R2R3 domain
KGPWSPEEDEALQKLVEKHGPRNWSLISKSIPGRSGKSCRLRWCNQLSPQVEHRAFTAEEDDTIIRAHARFGNKWATIARLLHGRTDNAIKNHWNSTLKRK

SEQ ID NO: 3724 - protein, 101 aa, Glycine max
  G4223,MYB-(R1)R2R3 domain
KGPWSPEEDEALQKLVEKHGPRNWSLISKSIPGRSGKSCRLRWCNQLSPQVEHRAFTHEEDDTIIRAHARFGNKWATIARLLHGRTDNAIKNHWNSTLKRK

SEQ ID NO: 3725 - protein, 101 aa, Glycine max
  G4224,MYB-(R1)R2R3 domain
KGPWSPEEDEALRRLVQTYGPRNWSVISKSIPGRSGKSCRLRWCNQLSPEVERRPFTAEEDEAILKAHARFGNKWATIARFLNGRTDNAIKNHWNSTLKRK

SEQ ID NO: 3726 - protein, 101 aa, Glycine max
  G4225,MYB-(R1)R2R3 domain
KGPWSAKEDRILTGLVEAHGPRNWASISRHIKGRSGKSCRLRWCNQLSPTVEHRPFSTREDEVILHAHARFGNKWATIARMLPGRTDNAVKNHWNATLKRR

SEQ ID NO: 3727 - protein, 101 aa, Zea mays
  G4226,MYB-(R1)R2R3 domain
KGPWSPEEDEALRRLVERHGARNWTAIGRGIPGRSGKSCRLRWCNQLSPQVERRPFTPEEDAAILAAHARLGNRWAAIARLLPGRTDNAVKNHWNSSLKRK

SEQ ID NO: 3728 - protein, 101 aa, Zea mays
  G4227,MYB-(R1)R2R3 domain
KGSWSPEEDALLTRLVEQHGPHRWSLISAPIPGRSGKSCRLRWCNQLSPDVHHRPFTPHEDALILAAHARYGNKWATIARLLPGRTDNSIKNHWNSNLRRC

SEQ ID NO: 3729 - protein, 101 aa, Zea mays
  G4228,MYB-(R1)R2R3 domain
KGPWSPEEDEALQRLVARHGARNWSLISRSIPGRSGKSCRLRWCNQLSPQVEHRPFTAEEDDTILRAHARFGNKWATIARLLSGRTDNAIKNHWNSTLKRK

SEQ ID NO: 3730 - protein, 101 aa, Zea mays
  G4229,MYB-(R1)R2R3 domain
KGPWSPEEDEALQRLVRRHGARNWSLISRSVPGRSGKSCRLRWCNQLSPRVEHRPFTPDEDDAILRAHARFGNKWATIARLLSGRTDNAIKNHWNSTLKRE

SEQ ID NO: 3731 - protein, 101 aa, Zea mays
  G4230,MYB-(R1)R2R3 domain
RGPWSPEEDDALRRLVERHGARNWTAIGREIPGRSGKSCRLRWCNQLSPQVERRPFTAEEDAAIVRAHARLGNRWAAIARLLPGRTDNAVKNHWNCSLKRK

SEQ ID NO: 3732 - protein, 101 aa, Zea mays
  G4231,MYB-(R1)R2R3 domain
RGPWSPEEDEALRRLVERHGARNWTAIGRGVPGRSGKSCRLRWCNQLGRGGARRPFTADEDAAIARAHARLGNRWAAIARLLPGRTDNAVKNHWNCSLKRK

SEQ ID NO: 3733 - protein, 93 aa, Zea mays
  G4232,MYB-(R1)R2R3 domain
RGPWSPEEDDALRRLVERHGARNWTAIGREIPGRSGKSCPLRWCNQLSPQVERPPFTPEEDAAILAAHARLGNRWAAIARLLPGRTDNAVKNH

SEQ ID NO: 3734 - protein, 101 aa, Oryza sativa
  G4234,MYB-(R1)R2R3 domain
KGPWSPEEDEALQRLVGRHGARNWSLISKSIPGRSGKSCRLRWCNQLSPQVEHRPFTPEEDDTILRAHARFGNKWATIARLLAGRTDNAIKNHWNSTLKRK

SEQ ID NO: 3735 - protein, 101 aa, Oryza sativa
  G4235,MYB-(R1)R2R3 domain
RGPWSPEEDEALRRLVERHGARNWTAIGREIPGRSGKSCRLRWCNQLSPQVERRPFTAEEDATILRAHARLGNRWAAIARLLQGRTDNAVKNHWNCSLKRK

SEQ ID NO: 3736 - protein, 101 aa, Oryza sativa
  G4236,MYB-(R1)R2R3 domain
KGSWSPEEDEQLRGAVARHGPRNWTAISEEVPGRSGKSCRLRWCNQLSPGVHRRPFTPDEDALIVAAHAKYGNKWATIARLLDGRTDNSVKNHWNSSLRRN

SEQ ID NO: 3737 - protein, 101 aa, Oryza sativa
  G4237,MYB-(R1)R2R3 domain
KGSWRAEEDALLTRLVAQHGPHRWSIISGAIPGRSGKSCRLRWCNQLSPAVQHRPFTPQEDALLAAAHARHGNKWATIARLLPGRTDNSVKNHWNSNLRRC

SEQ ID NO: 3738 - protein, 101 aa, Oryza sativa
  G4238,MYB-(R1)R2R3 domain
KGPWSPEEDEALRRLVERHGARNWTAIGRGIPGRSGKSCRLRWCNQLSPQVERRPFTAEEDAAILRAHARLGNRWAAIARLLPGRTDNAVKNHWNSSLKRK

SEQ ID NO: 3739 - protein, 77 aa, Zea mays
  G4253,CAAT domain
PAARIKKIMQADEDVGKIALAVPVLVSRSLELFLQDLIDRTYEITLQSGAKTLNSFHLKQCVKRYSSFDFLTEVVSK

SEQ ID NO: 3740 - protein, 77 aa, Zea mays
  G4254,CAAT domain
PAARIKKIMQADEDVGKIALAVPVLVSRALELFLQDLIDRTYEITLQSGAKTLNSFHLKQCVKRYSSFDFLTEVVSK

SEQ ID NO: 3741 - protein, 77 aa, Zea mays
  G4255,CAAT domain
PAPRIKKIMQTDEDVGKIAQAVPVLVSKALELFLQDLCDRTYDITIRKGVKTVGSSHLKQCIQTYNVYDFLREVVSK

SEQ ID NO: 3742 - protein, 97 aa, Zea mays
  G4256,CAAT domain
DEIKQANDFKIHTLPLARIKKIMKADEDVRMISAEAPVVFAKACEVFILELTLRSWMHTEENKRRTLQKNDIAAAITRTDIYDFLVDIIPRDEMKEE

SEQ ID NO: 3743 - protein, 97 aa, Zea mays
  G4257,CAAT domain
TEIEATADFRNHNLPLARIKKIMKADEDVRMISAEAPVVFAKACEIFILELTLRSWMHTEENKRRTLQKNDIAAAITRTDIYDFLVDIVPRDEMKDD

SEQ ID NO: 3744 - protein, 98 aa, Zea mays
  G4258,CAAT domain
REIEATTDFKNHNLPLARIKKIMKADEDVRMIAAEAPVVFARACEMFILELTHRGWAHAEENKRRTLQKSDIAAAVARTEVFDFLVDIVPRDEARDAD

SEQ ID NO: 3745 - protein, 98 aa, Zea mays; identical to SEQ ID NO: 3744
  G4258,CAAT domain

SEQ ID NO: 3746 - protein, 99 aa, Zea mays; identical to SEQ ID NO: 3569
  G4259,CAAT domain

SEQ ID NO: 3747 - protein, 60 aa, Zea mays
  G4261,CAAT domain
EPVYVNAKQYHGILRRRQSRAKAELEKKVVKARKPYLHESRHQHAMRRARGNGGRFLNTK

SEQ ID NO: 3748 - protein, 60 aa, Zea mays
  G4262,CAAT domain
EPIYVNAKQYHAILRRRQLRAKLEAENKLVKSRKPYLHESRHLHAMKRARGTGGRFLNTK

SEQ ID NO: 3749 - protein, 60 aa, Zea mays; identical to SEQ ID NO: 3748
  G4263,CAAT domain

SEQ ID NO: 3750 - protein, 60 aa, Zea mays
  G4264,CAAT domain
EPIYVNAKQYHAILRRRQTRAKLEAQNKMVKNRKPYLHESRHRHAMKRARGSGGRFLNTK

SEQ ID NO: 3751 - protein, 60 aa, Zea mays
  G4265,CAAT domain
EPIYVNAKQYHAILRRRQTRAKLEAQNKMVKGRKPYLHESRHRHAMKRARGSGGRFPHTK

SEQ ID NO: 3752 - protein, 60 aa, Zea mays
  G4267,CAAT domain
EPVYVNAKQYNAILRRRQSRAKAESERKLVKGRKPYLHESRHQHALKRARGAGGRFLNSK

SEQ ID NO: 3753 - protein, 60 aa, Zea mays
  G4268,CAAT domain
EPVYVNAKQYNAILRRRQSRAKAESERKLIKGRKPYLHESRHQHALKRARGAGGRFLNSK

SEQ ID NO: 3754 - protein, 60 aa, Zea mays
  G4269,CAAT domain
EPIYVNPKQYHGILRRRQLRAKLEAQNKLVRARKPYLHESRHLHAMKRARGSGGRFLNTK

SEQ ID NO: 3755 - protein, 61 aa, Zea mays
  G4270,CAAT domain
EAPIYVNAKQYDAIMRRRCARAKAERENRLVKGRKPYLHESRHQHALRRPRGSGGRFLNTK

SEQ ID NO: 3756 - protein, 97 aa, Zea mays
  G4272,CAAT domain
REQDRFLPIANVSRIMKKALPANAKISKDAKETVQECVSEFISFITGEASDKCQREKRKTINGDDLLWAMTTLGFEDYVEPLKHYLHKFREIEGERA

SEQ ID NO: 3757 - protein, 90 aa, Zea mays
  G4273,CAAT domain
KEQDRLLPIANVGRIMKQILPPNAKISKEAKETMQECVSEFISFVTGEASDKCHKEKRKTVNGDDVCCAFGALGFDDYVDPMRRYLHKYR

SEQ ID NO: 3758 - protein, 89 aa, Zea mays
  G4275,CAAT domain
KEDVSLPKSTMVKIIKEMLPPDVRVARDAQDLLVECCVEFINLLSSESNEVCSREEKKTIAPEHVIKALSDLGFREYIEEVYAAYEQHK

SEQ ID NO: 3759 - protein, 90 aa, Zea mays
  G4276,CAAT domain
REQDMFLPITNITRIMKKAVPANAKITKDAKEIMQYCVSEFIFFVTSEAREKSKKEERKRINVDDLLWSVDTAGFEYVELLRICLQKYRE

SEQ ID NO: 3760 - protein, 68 aa, Oryza sativa
  G4294,AP2 domain
KKKFRGVRQRHWGSWVSEIRHPLLKRRVWLGTFETAEEAARAYDEAAILMSGRNAKTNFPVARNATGE

SEQ ID NO: 3761 - protein, 42 aa, Zea mays
  G4297,Z-CO-like domain
CELCGGAAAVHCAADSAFLCPRCDAKVHGANFLASRHVRRRL

SEQ ID NO: 3762 - protein, 42 aa, Oryza sativa
  G4298,Z-CO-like domain
CELCGGVAAVHCAADSAFLCLVCDDKVHGANFLASRHPRRRW

SEQ ID NO: 3763 - protein, 46 aa, Solanum lycopersicum
  G4299,Z-CO-like domain
CELCNDQAALFCPSDSAFLCFHCDAKVHQANFLVARHLRLTLCSHC

SEQ ID NO: 3764 - protein, 9 aa, Glycine max
  G4340,1st IAA domain
TELRLGLPD

SEQ ID NO: 3765 - protein, 13 aa, Glycine max
  G4340,2nd IAA domain
QVVGWPPVCSYRK

SEQ ID NO: 3766 - protein, 17 aa, Glycine max
  G4340,3rd IAA domain
YVKVSMDGAPFLRKIDL

SEQ ID NO: 3767 - protein, 34 aa, Glycine max
  G4340,4th IAA domain
YEDKDGDWMLVGDVPWEMFMESCKRLRIMKRSDA

SEQ ID NO: 3768 - protein, 9 aa, Glycine max
  G4346,1st IAA domain
TELRLGLPG

SEQ ID NO: 3769 - protein, 13 aa, Glycine max
  G4346,2nd IAA domain
QVVGWPPVCSYRK

SEQ ID NO: 3770 - protein, 17 aa, Glycine max
  G4346,3rd IAA domain
YVKVSMDGAPFLRKIDL

SEQ ID NO: 3771 - protein, 34 aa, Glycine max
  G4346,4th IAA domain
YEDKDGDWMLVGDVPWEMFIESCKRLRIMKRSDA

SEQ ID NO: 3772 - protein, 9 aa, Populus trichocarpa
  G4347,1st IAA domain
TELRLGLPG

SEQ ID NO: 3773 - protein, 13 aa, Populus trichocarpa
  G4347,2nd IAA domain
QVVGWPPVCSYRK

SEQ ID NO: 3774 - protein, 16 aa, Populus trichocarpa
  G4347,3rd IAA domain
YVKVSMDGAPFLRKID

SEQ ID NO: 3775 - protein, 35 aa, Populus trichocarpa
  G4347,4th IAA domain
YEDKDGDWMLVGDVPWEMFFESCKRLRIMKSSEAK

SEQ ID NO: 3776 - protein, 10 aa, Populus trichocarpa
  G4348,1st IAA domain
ITELRLGPPG

SEQ ID NO: 3777 - protein, 13 aa, Populus trichocarpa
  G4348,2nd IAA domain
QVVGWPPVCSYRK

SEQ ID NO: 3778 - protein, 17 aa, Populus trichocarpa
  G4348,3rd IAA domain
YVKVSMDGAPFLRKVDL

SEQ ID NO: 3779 - protein, 34 aa, Populus trichocarpa
  G4348,4th IAA domain
YEDKDGDWMLVGDVPWEMFIESCKRLRIMKRSEA

SEQ ID NO: 3780 - protein, 9 aa, Vitis vinifera
  G4349,1st IAA domain
TELRLGLPG

SEQ ID NO: 3781 - protein, 13 aa, Vitis vinifera
  G4349,2nd IAA domain
QVVGWPPVCSYRR

SEQ ID NO: 3782 - protein, 17 aa, Vitis vinifera
  G4349,3rd IAA domain
YVKVSMDGAPFLRKIDL

SEQ ID NO: 3783 - protein, 34 aa, Vitis vinifera
  G4349,4th IAA domain
YEDKDGDWMLVGDVPWEMFIESCKRLRIKKKSET

SEQ ID NO: 3784 - protein, 9 aa, Gossypium hirsutum
  G4350,1st IAA domain
TELRLGLPG

SEQ ID NO: 3785 - protein, 13 aa, Gossypium hirsutum
  G4350,2nd IAA domain
QVVGWPPVCSYRK

SEQ ID NO: 3786 - protein, 17 aa, Gossypium hirsutum
  G4350,3rd IAA domain
YVKVSMDGAPFLRKIDL

SEQ ID NO: 3787 - protein, 34 aa, Gossypium hirsutum
  G4350,4th IAA domain
YEDKDGDWMLAGDVPWEMFIESCKRLRIMKKADA

SEQ ID NO: 3788 - protein, 103 aa, Zea mays
  G4637,MYB-(R1)R2R3 domain
KGAWTKEEDQRLVAYIKAHGEGCWRSLPKAAGLLRCGKSCRLRWINYLRPDLKRGNFTEEEDDLIIKFHELFGNKWSLIAGRLPGRTDNEIKNYWNTHIKRKL

SEQ ID NO: 3789 - protein, 103 aa, Zea mays
  G4638,MYB-(R1)R2R3 domain
KGAWTKEEDQRLVAYIKAHGEGCWRSLPKAAGLLRCGKSCRLRWINYLRPDLKRGNFTQEEDDVIIKLHQVLGNKWSLIAAQLPGRTDNEIKNYWNTHIKRKL

SEQ ID NO: 3790 - protein, 103 aa, Glycine max
  G4639,MYB-(R1)R2R3 domain
KGAWTKEEDHRLISYIRAHGEGCWRSLPKAAGLLRCGKSCRLRWINYLRPDLKRGNFTLEEDQLIIKLHSLLGNKWSLIARRLPGRTDNEIKNYWNTHIRRKL

SEQ ID NO: 3791 - protein, 103 aa, Zea mays
  G4640,MYB-(R1)R2R3 domain
KGAWTKEEDQRLIAYIRAHGEGSWRSLPKAAGLLRCGKSCRLRWMNYLRPDLKRGNFTGDDDELIIKLHALLGNKWSLIAGQLPGRTDNEIKNYWNTHIKRKL

SEQ ID NO: 3792 - DNA, 1055 bp, Artificial Sequence; identical to SEQ ID NO: 49
  P1 (35S::G19)

SEQ ID NO: 3793 - DNA, 1438 bp, Artificial Sequence
  P3 (35S::G201)
atcctacaacggtcgtctaccacagtttctcagtcagtttcatattcagatgcatcagagttctcatcaagagatctatcagtctattgccttaaactcgacgacattctgttttttttttcttttcttattttttctttttcttatttcttacctataggttgtatgtaaatctatatcaaaaaaagaagaaaaacaagatgtcaagaaagccatgttgtgtgggagaaggactgaagaaaggagcatggactgccgaagaagacaagaaactcatctcttacattcatgaacacggtgaaggaggctggcgtgacattccccaaaaagctggtatatatgtgctttattattatgtatatattttaaaacactttttacatatatataactataattgttgtttttatgacaaatgatggtgtttaggactaaaacgatgtggaaagagttgtagattgcgatgggctaactatttgaaacctgacatcaagagaggagagtttagctatgaggaggaacagattatcatcatgctacacgcttctcgcggcaacaagtaaaatcctagcttgccgaaatccatataaataagggtatatataattaacacattattaaagtttatatatatgttttacttaaaaggtggtcagtcatagcgagacatttgcccaaaagaacagataacgagattaagaactactggaacacgcatctcaaaaagctcctgatcgataagggaatcgatcccgtgacccacaagccacttgcctatgactcaaacccggatgagcaatcgcaatcgggttccatctctccaaagtctcttcctccttcaagctccaaaaatgtaccggagataaccagcagtgacgagacaccgaaatatgatgcttccttgagctccaagaaacgttgttttaagagatcgagttctacatcaaaactgttaaacaaagttgcagctagggcttcttccatgggaactatactaggcgcctccatcgaaggaaccttgatcagctctacaccgttgtcttcatgtctaaatgatgacttttctgaaacaagtcaatttcagatggaagaatttgatccattctatcagtcatctgaacacataattgatcatatgaaagaagatatcagcatcaacaattccgaatacgatttctcgcagtttctcgagcagtttagtaacaacgaaggggaagaagctgacaatactggaggaggatataaccaagatcttcttatgtctgatgtctcatcaacaagcgttgatgaagacgagatgatgcaaaacataactggttggtcaaattatctccttgaccattccgatttcaattatgacacgagccaagattacgacgacaagaacttcatatgatccgttgattgcttaccggactagagttgaccggttaatgtc

SEQ ID NO: 3794 - DNA, 1472 bp, Artificial Sequence
  P4 (35S::G202)
cctatatcttgagttttgtgagaggttaattatatgaaattttacgcattattgttcatctatatcgaaaaacaatgtcaagaaagccatgttgcgtcggagaaggcttgaagaaaggagcatggaccaccgaggaggacaagaaactcatctcttacatccacgaccacggcgagggaggctggcgcgacattccccaaaaagctggtttatacaaatctatacatacactcatttttgtacttgttgtagaaaattgttctgataaacatattgtgtctgattagggttgaaacggtgtggaaagagttgtagactgcgatggaccaactaccttaaacctgagatcaaaagaggcgagtttagttcagaggaagagcagattatcatcatgcttcatgcttctcgtggcaacaagtacgtttctatgtttctatgtgtgtgcgtggaccctcgaatgtgaaatgaatttcatgaaaaagttttcatataatatttattatgtagacataatcatcattttaatcttggtctccgatctatcttattttctttaggtggtcggtcatagcgagacatttacctagaagaacagacaacgagatcaagaactactggaacacgcatctcaaaaaacgtttgatggaacagggtattgatcccgtgactcacaagccactggcttctagttccaaccctacggtcgatgagaatttgaattccccaaatgcctctagttccgacaagcaatactcccgatcgagctcaatgccttttctgtctcgtcctcctccatccagttgcaacatggtttccaaggtctccgagcttagcagcaatgatgggacaccgattcaaggcagttccttgagttgcaagaaacgtttcaagaaatcaagttctacatcaaggctcttgaacaaagttgcggctaaggccacttccatcaaagatatattgtcggcttccatggaaggtagcttgagtgctactacaatatcacatgcaagcttttttaatggcttcactgagcagattcgcaatgaagaggatagttctaacacatccctgacaaatactcttgctgaatttgatcccttctccccatcatcgttgtaccccgaacatgagatcaatgctacttctgatctcaacatggaccaagattacgatttttcacaatttttcgaaaaattcggaggagataaccacaatgaggagaacagtatgaatgatctccttatgtccgatgtttcccaagaagtctcatcaactagcgttgatgatcaagacaatatggtaggaaacttcgagggatggtcaaattatcttcttgaccataccaattttatgtatgacaccgactcagactcgcttgaaaagcatttcatatgagtcttcatatccaaacagaaaggtttcaaactattcgacgacttaaaataatggttctgtacccaaggttagtcgat

SEQ ID NO: 3795 - DNA, 1828 bp, Artificial Sequence
  P10 (35S::G214)
gtgatggagacaaattcgtctggagaagatctggttattaagactcggaagccatatacgataacaaagcaacgtgaaaggtggactgaggaagaacataatagattcattgaagctttgaggctttatggtagagcatggcagaagattgaagaacatgtagcaacaaaaactgctgtccagataagaagtcacgctcagaaatttttctccaaggtagagaaagaggctgaagctaaaggtgtagctatgggtcaagcgctagacatagctattcctcctccacggcctaagcgtaaaccaaacaatccttatcctcgaaagacgggaagtggaacgatccttatgtcaaaaacgggtgtgaatgatggaaaagagtcccttggatcagaaaaagtgtcgcatcctgagatggccaatgaagatcgacaacaatcaaagcctgaagagaaaactctgcaggaagacaactgttcagattgtttcactcatcagtatctctctgctgcatcctccatgaataaaagttgtatagagacatcaaacgcaagcactttccgcgagttcttgccttcacgggaagagggaagtcagaataacagggtaagaaaggagtcaaactcagatttgaatgcaaaatctctggaaaacggtaatgagcaaggacctcagacttatccgatgcatatccctgtgctagtgccattggggagctcaataacaagttctctatcacatcctccttcagagccagatagtcatccccacacagttgcaggagattatcagtcgtttcctaatcatataatgtcaacccttttacaaacaccggctctttatactgccgcaactttcgcctcatcattttggcctcccgattctagtggtggctcacctgttccagggaactcacctccgaatctggctgccatggccgcagccactgttgcagctgctagtgcttggtgggctgccaatggattattacctttatgtgctcctcttagttcaggtggtttcactagtcatcctccatctacttttggaccatcatgtgatgtagagtacacaaaagcaagcactttacaacatggttctgtgcagagccgagagcaagaacactccgaggcatcaaaggctcgatcttcactggactcagaggatgttgaaaataagagtaaaccagtttgtcatgagcagccttctgcaacacctgagagtgatgcaaagggttcagatggagcaggagacagaaaacaagttgaccggtcctcgtgtggctcaaacactccgtcgagtagtgatgatgttgaggcggatgcatcagaaaggcaagaggatggcaccaatggtgaggtgaaagaaacgaatgaagacactaataaacctcaaacttcagagtccaatgcacgccgcagtagaatcagctccaatataaccgatccatggaagtctgtgtctgacgagggtcgaattgccttccaagctctcttctccagagaggtattgccgcaaagttttacatatcgagaagaacacagagaggaagaacaacaacaacaagaacaaagatatccaatggcacttgatcttaacttcacagctcagttaacaccagttgatgatcaagaggagaagagaaacacaggatttcttggaatcggattagatgcttcaaagctaatgagtagaggaagaacaggttttaaaccatacaaaagatgttccatggaagccaaagaaagtagaatcctcaacaacaatcctatcattcatgtggaacagaaagatcccaaacggatgcggttggaaactcaagcttccacat

SEQ ID NO: 3796 - DNA, 1209 bp, Artificial Sequence; identical to SEQ ID NO: 199
  P14 (35S::G229)

SEQ ID NO: 3797 - DNA, 916 bp, Artificial Sequence; identical to SEQ ID NO: 203
  P15 (35S::G231)

SEQ ID NO: 3798 - DNA, 845 bp, Artificial Sequence
  P16 (35S::G233)
cagcaatcacaaatcaaagagatgggaagagctccatgctgtgagaagatggggttgaagagaggaccatggacacctgaagaagatcaaatcttggtctcttttatcctcaaccatggacatagtaactggcgagccctccctaagcaagctggtcttttgagatgtggaaaaagctgtagacttaggtggatgaactatttaaagcctgatattaaacgtggcaatttcaccaaagaagaggaagatgctatcatcagcttacaccaaatacttggcaatagatggtcagcgattgcagcaaaactgcctggaagaaccgataacgagatcaagaacgtatggcacactcacttgaagaagagactcgaagattatcaaccagctaaacctaagaccagcaacaaagagaagggtactaaaccaaaatctgaatccgtaataacgagctcgaacagtactagaagcgaatcggagctatcagattcatcaaacccttctggagaaagcttattttcgacatcgccttcgacaagtgaggtttcttcgatgacactcataagccacgacggctatagcaacgagattaatatggataacaaaccgggagatatcagtactatcgatcaagaatgtgtttctttcgaaacttttggtgcggatatcgatgaaagcttctggaaagagacactgtatagccaagatgaacacaactacgtatcgaatgacctagaagtggctggtttagttgagatacaacaagagtttcaaaacttgggctccgctaataatgagatgatttttgacagtgagatggacttctggttcgatgtattggctagaac

SEQ ID NO: 3799 - DNA, 1125 bp, Artificial Sequence
  P17 (35S::G237)
agagaaatggcgaagacgaaatatggagagagacataggaaagggttatggtcacctgaagaagacgagaagctaaggagcttcatcctctcttatggccattcttgctggaccactgttcccatcaaagctggtctctctttcatcttcttctttattagtttttagtttctcaaactgagtcaactttgataattgttgttgggatttaatttgatagggttacaaaggaatgggaagagctgcagattaagatggattaattacctaagaccagggttaaagagggatatgattagtgcagaagaagaagagactatcttgacgtttcattcttccttgggtaacaagtaagtgtatctctaagacctaaccctattgttttagcagatgctagttatagagagactaatgatttaggtgtaattaggtggtcgcaaatagctaaattcttaccgggaagaacagacaatgagataaagaactattggcactctcatttgaaaaagaaatggctcaagtctcagagcttacaagatgcaaaatctatttcccctccttcgtcttcatcatcatcacttgttgcttgtggaaaaagaaatccggaaaccttgatctcgaatcacgtgttctccttccagagacttctagagaacaaatcttcatctccctcacaagaaagcaacggaaataacagccatcaatgttcttctgctcctgagattccaaggcttttcttctctgaatggctttcttcttcatatccccacaccgattattcctctgagtttaccgactctaagcacagtcaagctccaaatgtcgaagagactctctcagcttatgaagaaatgggtgatgttgatcagttccattacaacgaaatgatgatcaacaacagcaactggactcttaacgacattgtgtttggttccaaatgtaagaagcaggagcatcatatttatagagaggcttcagattgtaattcttctgctgaattcttttctccatcaacaacgacgtaaattgcgtttattgtaatgtaaatcaaatttctaaggcaaaaccggaaaaaaaatgttttgttttttgttttgtcttaaatgctttgacaccaataaggca

SEQ ID NO: 3800 - DNA, 795 bp, Artificial Sequence; identical to SEQ ID NO: 281
  Artificial sequence
  P22 (35S::G343)

SEQ ID NO: 3801 - DNA, 825 bp, Artificial Sequence; identical to SEQ ID NO: 285
  P23 (35S::G346)

SEQ ID NO: 3802 - DNA, 922 bp, Artificial Sequence; identical to SEQ ID NO: 299
  P25 (35S::G361)

SEQ ID NO: 3803 - DNA, 2372 bp, Artificial Sequence
  P27 (35S::G384)
cttctccacaagtaagggaaccagaaaaccagggaagaatccgagcaagctagggtttcattgtgtgcacaaaatgggatatacaggcagaagaaaatcgagataaatcaactaaatgatttggataatcatcttgaagatttgaaggatttcgagactaagtccggcgcagaagtcaccatggagaatcctttagaagaagagcttcaagatcctaatcagcgtcccaacaaaaagaagcgttaccaccgtcacacacaacgccagattcaagagctagagtcgttcttcaaggaatgtcctcatccagacgataagcaaagaaaggagctgagtcgcgagctaagcttagaacctcttcaagtcaagttctggttccaaaacaaacgcactcaaatgaaggcacaacatgagaggcacgagaaccagatactgaagtcagaaaatgacaagctccgagcagagaacaataggtacaaggatgctctaagcaacgcaacatgcccaaactgtggtggtccggcagctataggagaaatgtccttcgacgaacagcatttaaggatcgaaaatgctcgtttacgcgaagagattgacagaatctctgccatagctgctaaatacgtagggaagcctttaatggctaattcctcttctttccctcagctctcttcttcacaccacattccctcgcgctcgcttgatcttgaagttgggaactttgggaacaataacaatagccacactggtttcgttggggaaatgtttggaagcagcgacattttgaggtcggtttcgataccttctgaggctgataagcctatgattgttgagttagctgttgcagcaatggaagagcttgtgagaatggctcaaactggtgatcccttatgggtttcaagcgataattctgttgagattctcaatgaagaagagtattttaggacgtttcctagaggaattggaccgaaacctatcggtttgagatcagaagcttcaagagagtctactgttgttatcatgaatcatatcaatctcattgagattctaatggatgtgaatcaatggtctagtgtgttctgcgggattgtatcaagagcattgactctagaagttctctcaactggcgtacgagggaactacaatggggcattgcaagtgatgacagcagagttccaagtcccatcgccgcttgtccctactcgtgagaactactttgtaaggtactgtaaacagcacagtgacggtatttgggcggttgtggatgtctctttggacagcctaagaccaagtccgatcactagaagcagaagaagaccctctggttgtctgattcaagaattgcagaatggttactccaaggtgacatgggtagagcatattgaggtggatgatagatcggttcacaacatgtataaaccgttggttaataccggtttagctttcggtgcaaaacgttgggtggctacacttgaccgccaatgtgagcggctcgccagttccatggccagcaacattccggcttgtgatctttccgtgataacgagtcctgaggggagaaagagcatgctgaaactagcggagagaatggtgatgagcttctgtaccggagtcggcgcgtcaaccgccgatgcctggactacattgtcgaccacaggatccgacgacgttcgggtcatgacccgaaagagcatggatgatccgggaagacctccaggcatcgttctcagcgccgctacttctttctggatccctgtagctccaaaacgagtgttcgattttctcagagatgaaaactcaagaagcgagtgggatatactttccaatggaggcttggttcaagaaatggctcatatcgcaaatggtcgtgatcctgggaatagtgtctccttgcttcgagtcaatagtgggaactcagggcagagcaacatgttgatcttacaagaaagttgtacggacgcatcagggtcctatgtgatatacgcaccagttgatataatagctatgaacgttgtcctgagtggtggtgatccggattatgtcgctttgttaccatccggattcgctattttgccggatggctctgctagaggaggaggaggtagtgctaatgccagtgctggagccggagttgaaggaggaggagaggggaataatcttgaagtggttactactactgggagttgtggcggttcactactcacagttgcgtttcagatacttgttgactctgttcctaccgctaaactctctctcggttcagttgctacagtcaatagtctgatcaaatgcactgtcgagcggattaaagccgctctggcctgcgacggagcctaatcgatgttttcggaaggtaagagtgaaaggggagg

SEQ ID NO: 3804 - DNA, 1379 bp, Artificial Sequence; identical to SEQ ID NO: 349
  P29 (35S::G428)

SEQ ID NO: 3805 - DNA, 716 bp, Artificial Sequence
  P30 (35S::G435)
gatgtcattgtatgtcttctatagtatatgttaaacttatatcactagaaacttatcttagttatgaatacaaagtttgtgttaattttgtttgcttatcttttacatagaacaccatcaatgttttaagtatgagtgcgtgtgtgtatatatacacatccttagccacaacgttgtacatagctcacaacaaaagaaaaaacaaaaaagaagagaaaaatggagaattctcagagtcagggtaaaaacaagaagaagaggctaacacaagatcaagttagacaactggagaagtgcttcactatgaacaagaagcttgagccagatctgaaacttcaactgtcgaaccagcttggtctacctcaaagacaagtcgctgtctggttccaaaacaagcgagccaggttcaagactcagtctcttgaggtccaacactgcactcttcagtccaagcacgaagcagctctctccgacaaggcaaagttagagcatcaagtgcagtttctccaagatgagctgaagagagcaaggaatcagcttgctctgttcacaaatcaagattctcctgttgataattctaatcttggttcttgtgatgaagatcatgatgatcaagtggtggtattcgacgagctttacgcttgctttgttagcaatggacatggatcttcatcaacctcatgggtctgattctgtttcgacgcagacaagattcc

SEQ ID NO: 3806 - DNA, 1169 bp, Artificial Sequence; identical to SEQ ID NO: 371
  P39 (35S::G456)

SEQ ID NO: 3807 - DNA, 732 bp, Artificial Sequence
  P40 (35S::G461)
atggcaaaggaaggtctagcactcgagatcacagagcttcgattgggtcttccaggagataattatagcgaaatatcagtatgcggatcgagtaagaagaataagagggtgctctcggatatgatgacctcatcagcgttagatactgagaatgaaaacagcgtcgtttcatcagttgaagatgaatcactgccggttgtgaagagtcaagcggtgggatggccacctgtgtgttcttacaggagaaagaagaacaatgaggaagcatcgaaagctataggctacgtgaaagtgagcatggatggtgtgccatacatgaggaagattgaccttggttcgagcaacagttatattaatctagtcacggttcttgagaatctcttcggctgtcttggcataggagtggcgaaggagggtaagaagtgtgaatacattattatatacgaagacaaggatagagactggatgctcgtcggagatgtaccttggcagatgtttaaagaatcatgcaagaggctgaggatcgtgaagagatcagatgcaactggttttggtctccagcaagattaatcatactagctagtgttgatcatctttaattaaccataaagtttgaaaaccgttgagtaattttttttcattataatcatttttcaaattgtaaaatttatatgataatgatgatatatacgttttcttcaaatgtatttccttactggtcgtatcatactt

SEQ ID NO: 3808 - DNA, 989 bp, Artificial Sequence
  P42 (35S::G464)
ctctgctggtatcattggagtctagggttttgttattgacatgcgtggtgtgtcagaattggaggtggggaagagtaatcttccggcggagagtgagctggaattgggattagggctcagcctcggtggtggcgcgtggaaagagcgtgggaggattcttactgctaaggattttccttccgttgggtctaaacgctctgctgaatcttcctctcaccaaggagcttctcctcctcgttcaagtcaagtggtaggatggccaccaattgggttacacaggatgaacagtttggttaataaccaagctatgaaggcagcaagagcggaagaaggagacggggagaagaaagttgtgaagaatggtgagctcaaagatgtgtcaatgaaggtgaatccgaaagttcagggcttagggtttgttaaggtgaatatggatggagttggtataggcagaaaagtggatatgagagctcattcgtcttacgaaaacttggctcagacgcttgaggaaatgttctttggaatgacaggtactacttgtcgagaaacggttaaacctttaaggcttttagatggatcatcagactttgtactcacttatgaagataaggggattggatgcttgttggagatgttccatggagaatgtttatcaactcggtgaaaaggcttcggatcatgggaacctcagaagctagtggactagctccaagacgtcaagagcagaaggatagacaaagaaacaaccctgtttagcttcccttccaaagctggcattgtttatgtattgtttgaggtttgcaatttactcgatactttttgaagaaagtattttggagaatatggataaaagcatgcagaagcttagatatgatttgaatccggttttcggatatggttttgcttaggtcattcaattcgtagttttccagtttgtttcttctttggctgtgtaccaattatctatgttctgtgagagaaagctcttg

SEQ ID NO: 3809 - DNA, 2580 bp, Artificial Sequence; identical to SEQ ID NO: 381
  P44 (35S::G470)

SEQ ID NO: 3810 - DNA, 624 bp, Artificial Sequence; identical to SEQ ID NO: 383
  Artificial sequence
  P45 (35S::G475)

SEQ ID NO: 3811 - DNA, 831 bp, Artificial Sequence
  P46 (35S::G481)
agcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 3812 - DNA, 1034 bp, Artificial Sequence
  P47 (35S::G482)
acacttaacaattcacaccttctctttttactcttcctaaaaccctaaatttcctcgcttcagtcttcccactcaagtcaaccaccaattgaattcgatttcgaatcattgatggaaatgatttgaaaaaagagtaaagtttatttttttattccttgtaattttcagaaatgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggacttaacaaagattggtgaagtggatctctctctgtatatagatacataaatacatgtatacacatgcctatttttacgacccatataaggtatctatcatgtgatagaacgaacattggtgttggtgatgtaaaatcagatgtgcattaagggtttagattttgaggctgtgtaaaagaagatcaagtgtgctttgttggacaataggattcactaacgaatctgcttcattggatcttgtatgtaactaaagccattgtattgaatgcaaatgttttcatttgggatgctttaaa

SEQ ID NO: 3813 - DNA, 553 bp, Artificial Sequence
  P48 (35S::G483)
tgggctaaccaaatgcaagagatcgagcataccactgatttcaagaaccacacccttcccctagcccgcatcaagaagatcatgaaagctgatgaagatgtgaggatgatctctgcggaggctcctgtgatttttgccaaggcctgtgagatgttcattttggagctcactctacgtgcttggatccacaccgaggagaacaagaggaggaccttgcagaagaacgacatcgccgctgccatttccaggaccgacgtgtttgatttccttgtggacataatcccgagggacgagctgaaagaagaaggtttaggcgtgaccaaagggaccataccatcggtggtgggttccccgccatactattacttgcaacaacaggggatgatgcaacactggccccaggagtaacaccctgatgagtcttaaaacttttcccctttcgtttgtttggttgtatcgtagtaaggtagctctgctctgctgggaaccatttctattgtgttctgtaatgacatgttagtatatccccagtctatatctatggcaatgcagt

SEQ ID NO: 3814 - DNA, 991 bp, Artificial Sequence
  P49 (35S::G484)
cgactctgctagagaagacgaaggagagagaaaatccctccgattatattccgtacaatccgatcgatttcccggcgccagatctcaccgcgactcgtctactttccgatttggttcgtgttgactcagttacgattaaactatggatccaatggatatagtcggcaaatccaaggaagacgcttctcttccaaaagctacgatgactaaaattataaaggagatgttaccaccagatgttcgtgttgcaagagatgctcaagatcttctcattgaatgttgtgtagagtttataaatcttgtatcttcagaatctaatgatgtttgtaacaaagaggataaacggacgattgctcctgagcatgttctcaaggcattacaggttcttggttttggagaatacattgaagaagtctatgctgcgtatgagcaacataagtatgaaacaatgcaggacacacagaggagcgtgaaatggaaccctggagctcaaatgactgaggaggaagcagcagctgagcaacaacgtatgtttgcagaagcacgtgcaagaatgaatggaggtgtttcggttcctcaacctgaacatccagaaactgaccagagaagtccgcaaagctaactgaaaccgtaagggtaagtgttaggcaagaaaaaacaacatccttttaacattcccttgtaagttgcaaatgcgtatgttctctgtttatatgctcttagtatgatatatgttagttagtgtttcacgatctaaaaacacttgtgattcagatgtaattagtaagcattccttgttttgtgtttactttgtgtcttgactaagcatggtgggtcaggtctacacaaagcatctgattcgatgacttacaggaatcttaatgtttgtagattggataaatttggtgattggtgtaattgtttttccataaacacaatgcaatcattgtttagtgttgttaacatttgccctgtgattctgacgcgaacc

SEQ ID NO: 3815 - DNA, 479 bp, Artificial Sequence
  P50 (35S::G486)
agcgagagctgatagattcactgaaacaaaagagaaaaatgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgtgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgttgaactagacatctaagttctggc

SEQ ID NO: 3816 - DNA, 732 bp, Artificial Sequence
  P51 (35S::G489)
ctggtagtgaatggatcaacaagaccatggacagtctggagctatgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgccggtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaattagcaagaaactgtgagtcttccagcttc

SEQ ID NO: 3817 - DNA, 1179 bp, Artificial Sequence; identical to SEQ ID NO: 421
  P56 (35S::G525)

SEQ ID NO: 3818 - DNA, 890 bp, Artificial Sequence; identical to SEQ ID NO: 427
  P59 (35S::G545)

SEQ ID NO: 3819 - DNA, 2012 bp, Artificial Sequence
  P73 (35S::G578)
atgcatagtttgaatgaaacagtaattcctgatgttgattacatgcagtctgatagagggcatatgcatgctgctgcctctgattccagtgatcgatcaaaggataagttggatcaaaaggtgatagattcatctctgtggatcaactagcatctgtgtatattacgcatatgcataatctgttttgtttccttttcgttttgatccatagacccttcgtaggcttgctcaaaatcgtgaggcagcaagaaaaagcagattgaggaagaaggtatgtatattttgcttttgttcttgttttgatttttcttatatattcctcttatttccttgtaatatctctagaagaatatctatctgtcattaccttaagcatgttattgtttcctccataggcgtatgttcagcagctggagaatagtcgattaaagctgactcaacttgagcaggagctgcaaagagcaagacagcaggtttattaactttcttatttgttttgattctgatatgtatgtctttataaagaagataaaaggctgaagctacttcaacttataactaacagtcagttacgagttagtactagtcttgggttagctgaagtagaggaggtaacagaattatgggtcatccatagtttagttgggtaaaagtagctggtaactctctcgaaataggtccttctggtctgtttattcggatgttgatggcatacagagaatttctattctggttcttatcagattctttgtcatgactcatgacagtgtatttgtcacttaaggatatatatttttcaattttagggagttttcatctcaagttcaggagaccaagctcattctactggtggcaatggtgggttgtttcttctctgttagttttgagattgatccttttgatttgaaatttctatgtgagataagtgcatatatacatatatgttgatgaattggtgatagcataagtcatctcatggcaatatgcttacacttgttagagttaatggtttcaagagtcagtgatgatctggatgggaaattaaagtcatggtgatgtcaaaactgaagtttcttatagtttgcgctggtgttagcttaggtctgcaagggtttgttcttgatctagtatacttgcctttctgcaggggctttggcatttgatgcagaacactcacgatggcttgaagaaaagaacaggcaaatgaacgagctgagatctgccctgaatgctcatgcaggtgatactgagctccggataattgtggatggagtgatggctcactatgaggagcttttcaggattaagagcaatgcagctaagaatgatgtcttccacttgttatctggaatgtggaaaacaccagctgagcgatgtttcttgtggcttggcgggttccgctcatccgaacttctcaaggtaagctctttccaagtccatagagagattttgatgaacagccaacttaatgagtcgcagtgttttcacaacagcttcttgcgaatcagctagagcccatgacagaacgacaggtaatgggcatcaatagcttgcagcagacgtcgcagcaggcagaagatgctttatctcaagggatggagagtttacagcaatccctagctgatactttatccagtggaactcttggttccagttcatcggataatgtcgcgagctacatgggtcagatggccatggcaatggggcagttaggcaccctcgaaggattcatacgccaggtactttagaaatgtggatgttatcgagatataccatatcttttcatcgtcacaaagagataaatattttattttatatatgaatccgtctgttatggagttcatagggcatttcttggtggcaggctgataacttgaggctgcaaacactacaacagatgcttcgagtattaacaacacgtcagtcagctcgtgctcttcttgctatacacgattattcatctcgattacgtgctcttagttccttgtggcttgcccggccaagagagtgaa

SEQ ID NO: 3820 - DNA, 1240 bp, Artificial Sequence; identical to SEQ ID NO: 469
  P77 (35S::G591)

SEQ ID NO: 3821 - DNA, 720 bp, Artificial Sequence; identical to SEQ ID NO: 481
  P79 (35S::G602)

SEQ ID NO: 3822 - DNA, 1263 bp, Artificial Sequence; identical to SEQ ID NO: 483
  P80 (35S::G605)

SEQ ID NO: 3823 - DNA, 1358 bp, Artificial Sequence
  P83 (35S::G629)
ttaactcttcagctctcaaattcttcatgaatatctctgcttatcggatcaagtgagagcaaatgcaatttttaagagccagctattggatctataactgaagaggatatatatagagatgatgagttcttcttctccaacacaacttgcatctttaagagacatgggaatctatgagccatttcaacaaattgtcggttggggaaatgttttcaaatctgatatcaatgatcatagtcccaatactgctacttcctctattattcaggttgatcctagaattgatgatcacaacaacaacatcaagataaattatgattcttctcataaccagatcgaagcagaacaaccttctagtaatgataatcaagatgatgatggcaggattcatgataagatgaaacggcgtttagcgcagaaccgagaagcggctcgcaaaagtcgtttgagaaagaaggcttatgttcagcagttagaggaaagccggttaaagttatcgcagttagagcaagaactcgaaaaggttaagcagcagggccatttaggaccatctgggagtattaacacagggattgcatcatttgagatggaatattcacactggctacaagaacaaagcagaagagttagcgaactacgaacagcgcttcaatctcatataagcgacatagaactcaagatgctagtagagagttgcttgaaccattacgctaatcttttccgaatgaaatccgatgcagcaaaagccgatgttttctacttgatatcgggaatgtggcgaacttcaaccgaaagattcttccaatggattggagggtttcgtccatccgaacttttaaacgttgtgatgccttatcttcaaccattaacggatcaacaaatcttggaagtgagaaacctccaacaatcatcacaacaagcagaggatgctctgtctcaagggattgataaacttcaacagagtttagctgaaagcattgtgattgatgcggttatcgagtccacgcattatcccactcacatggctgcagctatagagaatcttcaagcattagaaggatttgtgaatcaagcagatcatctgaggcaacaaactttgcaacaaatggcgaagatcttaacgacaagacaatcggctcgaggtttactagctttaggagagtatcttcatagacttcgtgctcttagttctctttgggcagctcgtccacaagaaccaacttaaaagaggaacttattaaaactttaaaaacaagaaacagcagaatcaaaagtcttgaagaagcatactcatcacaaagcttggaaggatgttttaaaaaagatctttgttaattaagtagagtgagattctcttg

SEQ ID NO: 3824 - DNA, 631 bp, Artificial Sequence
  Artificial sequence
  P84 (35S::G630)
gagagaaattgaccatgcagccaaattatgatagctcaagtcttaacaacatgcaacaacaagactacttcaacttgaacaactactacaacaacttaaacccttcaaccaataacaacaacctcaatatcctccaataccctcaaattcaagaactcaacctacaatctccggtaagcaacaactccacaacttccgatgacgcaactgaagaaatcttcgtcatcaacgagaggaagcaaagacgtatggtatctaacagagagtcagcaagaagatcaagaatgagaaagcaaagacacttagatgagcttctctcacaggttgcttggcttcgaagcgagaaccaccagcttttagataagcttaaccaagtctccgacaacaatgatcttgttattcaagagaactcgagtcttaaagaagaaaacttggagcttcgtcaggttatcacatccatgaagaagcttggaggaggcatacatgacaaatattcttctccgtcgtctatggatgaattggatcaagacttttcttctatcacagatgatccaagaactcatcatccatcatgagttgttctgatcgagaaaaacattacttcaagtttctgcctctaatcttatctatt

SEQ ID NO: 3825 - DNA, 928 bp, Artificial Sequence; identical to SEQ ID NO: 521
  P91 (35S::G653)

SEQ ID NO: 3826 - DNA, 1033 bp, Artificial Sequence; identical to SEQ ID NO: 525
  P97 (35S::G663)

SEQ ID NO: 3827 - DNA, 1087 bp, Artificial Sequence; identical to SEQ ID NO: 527
  P98 (35S::G664)

SEQ ID NO: 3828 - DNA, 1209 bp, Artificial Sequence
  P100 (35S::G666)
gtgtactaagggtagtgtgactcattaccacctaaagtagtttcaattttcttctatttttcttggcaaagagttatagtgggaaacaaagggagtggttaataaagaattaattagttaattaagggagttcaagatcataatggtgaggcctccttgttgtgacaaaggaggagtgaagaaagggccatggactcctgaagaagatatcattttagtcacttacatccaagaacatggtcctggtaattggagagctgttcctaccaatactgggctgcttagatgcagtaagagttgtagacttagatggacaaactatttaaggccaggaatcaaaagaggcaatttcacagaacatgaagaaaagatgattgttcatctccaagccctcttaggaaatagatgggctgcaattgcgtcatatcttccacaaaggacagacaatgacattaagaactattggaacactcatttgaagaagaaactcaacaaagtcaatcaagattctcatcaagaacttgaccgttcctcgctctcatcttcaccatcgtcttcttctgctaattccaactcaaacatctcaagaggccaatgggaaaggcgacttcaaaccgatatccacttggcgaaaaaggctctctctgaggctttatctcctgccgttgcaccaatcattacatctacagtgacaacaacgtcttcctctgctgaatcaagacgctctacttcctcagctagcgggtttcttaggacgcaagaaacatctacaacttatgcctcaagcaccgaaaatatcgcgaaattgctcaaagggtgggtgaaaaactcgccgaagactcaaaactccgcggatcaaatcgcttctacagaggtaaaagaagtgatcaagagtgatgatgggaaggagtgtgcaggggcatttcagtcattttctgagtttgatcactcatatcaacaggctggtgtttcacctgatcatgagaccaaaccagacataactggatgctgcagtaaccaaagtcaatggtctttgtttgagaagtggttgtttgaggattctggtggacagattggtgatattctattggatgaaaacactaatttcttctgaagagtttgctttaatcacatggttctaattttaggatcctcatctctattttttttttgggttttccaaattaactcgcttagattatcgtgaga

SEQ ID NO: 3829 - DNA, 1247 bp, Artificial Sequence
  P101 (35S::G668)
ccaacatctctcctccacttcttcagacaaaaccaaacccatttggactttctttgtcttaaccctaagatttccaaaggttttccaacaaacccgcaacgattagcttttgttctaatatctcatcaaaaccctttcaaaaggtgaaaacagaatgggaagaccaccttgctgtgaaaagattggagtgaagaaagggccatggacaccagaggaagacatcatcttggtttcttacatccaagaacatggtcctggaaactggagatctgtcccaacacacacaggtttaagatgtagcaagagctgcagattgagatggactaattatcttcgacccggtattaagcgtggaaattttactgagcatgaagagaagacaattgttcatcttcaagcccttttaggcaacagatgggcagccatagcatcataccttccagaaaggacagacaatgatataaagaactattggaacactcacttgaagaagaagctcaaaaagattaatgaatctggtgaagaagataatgatggtgtctcttcatcaaacactagttcacaaaagaaccatcaaagcactaacaaaggtcaatgggaaagaagacttcagacagacattaacatggcaaaacaagctctttgtgaggccttgtctttagacaaaccatcatccactctttcatcatcttcatcattaccgacaccagtaatcacacaacaaaacatccgtaacttctcatcagctttgcttgaccgttgttatgatccatcctcttcttcttcatctaccacaaccaccactacaagcaacactactaatccatacccatcaggggtatatgcgtcaagtgctgagaacatcgcccggttgcttcaagatttcatgaaagacacacccaaggctttaactttatcatcttcatctccggtttcagagactggaccactcactgctgcagtctcggaagaaggtggagaagggtttgaacaatctttcttcagcttcaattcaatggacgaaactcaaaacttgactcaggagacaagcttcttccatgatcaagtgatcaaaccggaaataacaatggaccaagatcatggtctaatatcacaagggtctctgtctttgtttgagaaatggttatttgatgagcaaagccacgagatggttggtatggcactagcaggacaagaagggatgttctagttctagaagactgtctagaactaacaaagtgggatct

SEQ ID NO: 3830 - DNA, 891 bp, Artificial Sequence
  P102 (35S::G669)
gtaccaaccacacaaccacaagagagagaaaagtgagaatgggaaagagagcaactactagtgtgaggagagaagagttaaacagaggagcttggactgatcatgaagacaagatccttagagattacatcaccactcacggcgaaggcaaatggagcactctccctaaccaagctggtctcaagaggtgtggcaaaagctgtagacttcggtggaagaactacctaagaccggggataaagcgcggtaacatctcatctgatgaagaagaactcataatccgtctccataatcttcttggaaacagatggtcgttgatagctgggaggcttccaggccgaacagacaatgaaataaagaatcattggaactcaaacctccgcaaaagacttcccaaaactcaaaccaagcaaccaaaacgtataaaacattcgacgaacaacgagaataatgtatgtgttatacgtacaaaggcgattaggtgctcaaagactcttctcttctcggatctctctcttcagaagaagagtagtactagtccactacctctgaaagaacaagagatggatcaaggtggatcttcgttgatgggagatctcgaattcgatttcgataggatccattcggagtttcacttcccggatttgatggattttgatggtttggactgtggaaacgttacatctcttgtttcatctaacgagattttgggagagttggttcctgctcaaggtaatctcgatctcaatagacctttcacttcttgtcatcatcgtggcgacgatgaagattggctccgagacttcacttgttgagcctatattgcaaaaacctacgttaatacatatttctctatacggacaaaagtatatctgtatttgtctgaacgct

SEQ ID NO: 3831 - DNA, 1228 bp, Artificial Sequence
  P105 (35S::G676)
cgtctatcattcaaagaaacaaaaagaatgagaaagaaagtaagtagtagtggtgacgaaggaaacaatgagtacaagaaaggtttgtggacagtagaagaagacaaaatcctcatggattatgtcaaagctcatggcaaaggtcactggaatcgtattgccaaaaagactggtctctttcctctctatctctctctctaatcgtattgacataatttatgaattctttgtcacatgattttcttttacgaatggtttaaagttaaggttctatatattatatatgttattttagatttaacttttaatctatgttaatagagtccatatatcgcaaaagcaacttgaatcaggatatttatctagggtcacctttttgttgtttttatttttatgaattaaggtcctcagttaaataattgtatatgtgtgttaggtttaaagagatgtggaaagagttgtagattgaggtggatgaattatctcagccctaatgtgaaaagaggcaatttcaccgagcaagaagaggatcttatcattaggctccacaagttgcttggtaataggtataacttcatttgctcaaaattagtttctctactcaattaatcataaaaacagctatttctatccattttgtatcaagttaaataatcataaatattcgtgattgtcttcacaaacttgcttggtaacacatgtttttattctcaaaatttcaatacattatatttcacatgataattatattgtttatctgtgtgtttaattaggtggtctttaattgctaaaagagtgccgggtcgaacggataatcaagtgaagaactattggaacacgcatcttagtaagaaactcggaatcaaagatcagaaaaccaaacagagcaatggtgatattgtttatcaaatcaatctcccgaatcctaccgaaacatcagaagaaacgaaaatctcgaatattgtcgataacaataatatcctcggagatgaaattcaagaagatcatcaaggaagtaactacttgagttcactttgggttcatgaggatgagtttgagcttagcacactcaccaacatgatggactttatagatggacactgtttttgatgtgttttctgcttttgttattttagtattcgtttatgttttgttattttcaaagctgatcaaacactaatacatcaacagtcttagattaaaagttgttgatgtggtagtgtatgat

SEQ ID NO: 3832 - DNA, 649 bp, Artificial Sequence
  P108 (35S::G682)
tcgacccacgcgtccgctctctcagagtactctcttagtttctttcttcttcttctttgtaatacggtgccgtttgacatggataaccatcgcaggactaagcaacccaagaccaactccatcgttacttcttcttctgaaggtaagctgaaaacttaaacaccttcgttttctcatttttccatgtttttttatacttatctatatataatgagaaatctgaattttggtgatgacaaggaacagaagtgagtagtcttgagtgggaagttgtgaacatgagtcaagaagaagaagatttggtctctcgaatgcataagcttgtcggtgacaggtttgatcttttaactaataatgaatactatttcgtaggaaaataatttaattgtaacaccatagtaaaagctgaattttgtgtgttattatttgatgaaaggtgggaactgatagctgggaggatcccaggaagaaccgctggagaaattgagaggttttgggtcatgaaaaattgaaaagtgatcaatatatctctatagtttcactgattgtttcgattatattccgttgtattttaaatttaccaactctgttataagaagaaaactttcttaaatcccaaaccatttaactaaaaaaaaaaaaaaagggc

SEQ ID NO: 3833 - DNA, 925 bp, Artificial Sequence; identical to SEQ ID NO: 553
  P111 (35S::G714)

SEQ ID NO: 3834 - DNA, 834 bp, Artificial Sequence; identical to SEQ ID NO: 567
  P120 (35S::G732)

SEQ ID NO: 3835 - DNA, 1003 bp, Artificial Sequence
  P121 (35S::G735)
caaaagagaaaagatggaaaaagttttctccgacgaagaaatctccggtaaccatcactggtcggttaatggaatgacgtcgttgaatcgcagtgcttccgaatgggcattcaatcgtttcatacaagaatcctccgccgctgcagacgacggagaatctacgacggcgtgtggtgtttccgtctcctctcctcctaatgttcctgtagattcagaggaatacagagcatttctcaagagtaaacttaatcttgcttgtgctgctgtcgccatgaaaaggggaactttcatcaaacctcaggatacttctggtagatctgacaatggtggagccaatgaatcagaacaagcctctcttgcttcttccaaagctacaccaatgatgagcagtgctataacaagtggatctgagctctctggtgatgaagaagaagctgatggtgaaactaatatgaaccctactaatgttaaacgcgttaaaaggatgctctctaatagagaatcagctagacggtccagaagaagaaagcaagcacacttgagtgagctagagacacaagtttcacagcttcgtgtagagaattcaaaactcatgaagggtctcactgatgtaactcaaacattcaatgatgcatctgtagaaaacagagttttaaaagccaatattgagacactacgagcaaaggtgaaaatggctgaagagacagtgaagagactcactggctttaacccaatgttccacaatatgcctcagattgtttcaactgtctctcttccttcagagacatcaaattctccagacactacaagcagccaagtgactacaccagagatcattagctcggggaacaaaggcaaggccttgatagggtgcaagatgaacagaacagcttcgatgcgtagtgttgagagcttggaacatctgcagaaacgtattcgaagcgttggggatcagtagctgttaaagaagaatcttgatttgtaacattaatcttaagacata

SEQ ID NO: 3836 - DNA, 1283 bp, Artificial Sequence; identical to SEQ ID NO: 597
  P128 (35S::G782)

SEQ ID NO: 3837 - DNA, 1027 bp, Artificial Sequence; identical to SEQ ID NO: 599
  P129 (35S::G783)

SEQ ID NO: 3838 - DNA, 1420 bp, Artificial Sequence; identical to SEQ ID NO: 605
  P131 (35S::G793)

SEQ ID NO: 3839 - DNA, 923 bp, Artificial Sequence; identical to SEQ ID NO: 607
  P132 (35S::G798)

SEQ ID NO: 3840 - DNA, 1673 bp, Artificial Sequence; identical to SEQ ID NO: 669
  P138 (35S::G903)

SEQ ID NO: 3841 - DNA, 480 bp, Artificial Sequence; identical to SEQ ID NO: 677
  P141 (35S::G911)

SEQ ID NO: 3842 - DNA, 1486 bp, Artificial Sequence
  P143 (35S::G928)
cccaggaaaggtaaaagagacggagacgaaccaaaacaaggaagaaagaagaagatcttacatacgaagatcactctctgattcactctgagagacaaactggtttactttggttctgtttgacaaaaggagacatgcaaaaataaatctctatcccttgtttttcttcttcgcttcatcgattactcaaagaggttgttggttgtgagaataattagcttgttaaggaagacgttatgatgcatcagatgttgaataagaaagattcagctactcattccactttgccataccttaatactagcatctcttggggagtggttccaactgattccgttgctaatcgtcgcggtcctgctgaatcactaagcttgaaggttgattcaagacctgggcatatacaaactacaaagcaaatcagttttcaggaccaagattcatcttcaacacagtccactggtcaatcttatactgaagttgctagtagtggtgatgataatccttccagacaaatctccttttcggctaaatcaggatctgaaataactcaacggaaggggtttgcaagtaatcctaaacaaggctcgatgactggatttccgaatattcactttgctcctgcacaggctaatttctcatttcactatgctgatccacattatggtggtttattagctgcaacttacctaccacaggcaccaacatgcaatcctcaaatggtgagtatgattcctggtcgtgttcctttaccagcagagctcacagaaactgatccagtctttgtcaatgcgaagcaataccacgcaattatgaggaggagacagcaacgtgctaagcttgaggctcaaaacaaactaatcagagcccgtaagccctatcttcatgagtctcgacatgttcatgctcttaaaaggccaagaggatctggtggaagattcctaaacaccaaaaaacttcttcaagaatccgaacaggctgctgctagagaacaagaacaggacaagttaggccaacaggtaaacagaaagaccaacatgtctagattcgaagctcatatgctgcagaacaacaaagaccgcagctcaaccacttctggctcagacatcacctctgtttccgacggtgctgatatctttggacacactgaattccagttttcaggtttcccaactccgataaaccgagccatgcttgttcatggtcagtctaatgacatgcatggaggtggagacatgcaccatttctctgtccatatctgagacagtggatcttggtgctgtgttcatgttcccaccaagaaggggaagtcatccttggctactactagttctttcgcttgttgtaacttcagtgtttttatttcatattatgtctgtgttagacatcacaagaacgaccaagatcttcactttgaaacactctattaccttttcatcttctgttaccatggatctcttgtctaaactagtgatatgattcttctgat

SEQ ID NO: 3843 - DNA, 1221 bp, Artificial Sequence; identical to SEQ ID NO: 721
  P144 (35S::G964)

SEQ ID NO: 3844 - DNA, 1073 bp, Artificial Sequence
  P145 (35S::G994)
tgggtgtagctaattactttcacgattttcaaatccaataaagttttaatttgatgaagctttttttaaaccatataatataaataatgggtggtcgtaaaccatgttgtgatgaggttggattaagaaagggtccatggacagtggaagaagatgggaaactagttgatttcttaagggcacgtggcaactgcggtggtggtggaggaggatggtgctggagagacgtgccaaaactggcggggctaaggaggtgtggcaaaagttgccgtctccggtggactaattatctccggccagatctcaagagaggtctttttactgaagaagaaatccaactagtcattgatcttcatgctcgccttggcaataggtttttatattttcaattttgttaccaatttcattatataaaaacgagctattacactactttgacaattatgaccctcctagttaaaccaatatgttagatttgatgatttctatttctaatgttgaaaatattctaatgcattatatataatttggttatagatggtcgaagattgcagtggagttaccaggaagaacagacaacgatatcaaaaattattggaacactcatataaagaggaagcttataagaatgggtattgatccaaacacacatcgtcgatttgaccaacaaaaagtcaacgaggaggaaacgatattggtcaacgatccaaagcctctgtctgagaccgaggtatctgttgctttgaagaatgacacgtcagcagtgttatcaggaaatctaaaccaattggctgacgtggacggtgatgatcagccgtggagctttctaatggaaaatgacgaaggaggaggtggcgacgccgccggagagcttacgatgctattgtccggtgacattacgtcatcatgttcttcttcgtcatctttgtggatgaagtatggagaattcggatacgaagatttagaacttggatgtttcgatgtttagagattcaagtatgtttaattaggccgtaggttgattaatcataaggttcattgacttcattctagaattgtgtagttggaccagt

SEQ ID NO: 3845 - DNA, 1082 bp, Artificial Sequence; identical to SEQ ID NO: 749
  P146 (35S::G996)

SEQ ID NO: 3846 - DNA, 2185 bp, Artificial Sequence
  P148 (35S::G1038)
gtgtcgtcgtttcataataaaacgcaaacaaaaacccactcccactttctcctttccaaaaaaagaactctcgccactttctctgctctttttctttctctctctctttcttgttttcgccggcgatcatggagaaaagcggcttctctcccgtcggtctaagggttcttgtcgtagacgatgatccaacttggctcaagattctcgagaaaatgctcaagaagtgttcttacgaaggtctctttcttcttcttctatcttatgttttccccaacagttggatttactaaaatatctccttactttcctatgttgcagtaacgacctgtggattagctagagaggctttgaggttgctgagggagcgtaaagatggatatgatatcgtgatcagcgatgtgaacatgcctgacatggatggtttcaagcttcttgagcatgttggtcttgaattagacctccctgtaataagtgagaagaaagatcttgacttgttgtgtaataaatgaaaaaggttattgatttttgtgtgttttgcgttgtagtgatgtcggtggacggcgaaacaagccgagtgatgaagggagtgcaacacggagcttgtgattacctcttgaagccgataagaatgaaggagttaaagattatatggcaacatgttctgagaaagaagcttcaagaagtgagagatatcgaaggctgtggatacgaaggaggagcggattggatcactcgatacgatgaagcacattttcttggaggtggtgaagatgtttcttttgggaaaaagagaaaagactttgactttgagaagaagcttcttcaagatgagagtgatccatcatcttcttcttccaagaaagctagagttgtttggtcttttgagcttcatcataagtttgtcaacgccgttaaccaaatcggatgcgatcacagtaagtacgttggcgactttggtttcttatcatgtccccttgcctccctttattatcatgtcttcatagagccgtgaaattttttccggtctcttgtttggcagaagctggtcccaagaagatattggatctcatgaatgttccatggctcactagagaaaatgttgcaagccaccttcaggtaaaaactttaccttgtcatcatcattattcagaacaagtgttagattaagcttttcgtcactttttttttgttctgtttttgtagaaatatagactttacctgagcagattagagaaaggaaaggagctcaagtgttattcaggtggcgtgaagaatgcggattcatctccaaaagatgtcgaagtgaattcaggctaccaaagccctgggaggagcagctatgtattctctggaggaaattctctgatccaaaaagcaacagagattgatccaaagccacttgcttcagcttctttgtctgacctcaacaccgatgtgatcatgcctccgaaaacaaaaaagacgcgtataggatttgatcctcccatttcctcctctgcgtttgactctctgcttccttggaatgatgttccagaggtccttgaatcgaagccggttctgtatgagaatagctttctccagcaacaaccattgccaagtcaaagttcctatgttgcaaattctgcaccatctctcatggaggaggaaatgaagcctccttatgagacaccagcaggaggcagtagtgtgaatgcagatgagtttctcatgccacaagacaagatccctactgtaacccttcaagatttggatccctctgccatgaagctgcaggagttcaacacagaggcgattctgagaagcttgaactgggaacttccagaatcacatcattctgtttctttagacactgacttagacttgacttggcttcaaggcgagcgttttcttgcaaacaccggactccagtttcaagattacagtagtagcccatcactcctatctgagctcccagcccaccttaattggtatggaaatgagcggctgcctgaccctgacgagtattccttcatggtagaccaaggtttattcatatcttaaccttgttccaataacttcttttcgtatattggttggtgtaatgcagaaagattttgtgggtatacctgaaaataatcttgctttcccaagaaccttccatgatcggatgcattgtacaataatccacgagtgtcgtaggctaatt

SEQ ID NO: 3847 - DNA, 958 bp, Artificial Sequence
  P149 (35S::G1048)
gaccatggcggaggaatttggaagcatagatttactcggagatgaagatttcttcttcgatttcgatccttcaatcgtaattgattctcttccggcggaggattttcttcagtcttcaccggattcatggatcggagaaatcgagaatcaattgatgaacgatgagaatcatcaagaggagagttttgtggaattggatcagcaatcggtttcagatttcatagcggatctactcgttgattatccaactagcgattctggctccgttgatttggcggctgataaagttctaaccgtcgattctcccgccgccgctgatgattccgggaaggagaattcggatttggttgttgagaagaagtctaatgattctggtagcgagattcatgatgatgatgacgaagaaggagacgatgatgctgtggctaaaaaacgaagaaggagagtaagaaatagagatgcggcggttagatcgagagagaggaagaaggaatatgtacaagatttagagaagaagagtaagtatctcgaaagagaatgcttgagactaggacgtatgcttgagtgcttcgttgctgaaaaccagtctctacgttactgtttgcaaaagggtaatggcaataatactaccatgatgtcgaagcaggagtctgctgtgctcttgttggaatccctgctgttgggttccctgctttggcttctgggagtaaacttcatttgcctattcccttatatgtcccacacaaagtgttgcctcctacgtccagaaccagaaaagctggttctaaacgggctcgggagtagtagcaaaccgtcttataccggcgttagtcggagatgtaagggttcgaggcctaggatgaaataccaaatcttaacccttgcggcgtgacaacgccttttttaactgcttcttttgcgcattttgagttgtagatgagtgtcttttagttttctc

SEQ ID NO: 3848 - DNA, 1305 bp, Artificial Sequence
  P163 (35S::G4)
aaagaatcgaatatttattatttcgccccgaagattctatttctgatcatttacacccctaaaaagagtagagctttcgtgaagccaccatgtgtggaggagctataatctccgatttcatacctccgccgaggtccctccgcgtcactaacgagtttatctggccggatctgaaaaacaaagtgaaagcttcaaagaagagatcgaataagcgatccgatttcttcgatcttgacgatgatttcgaagctgatttccaagggtttaaggatgactcggcttttgactgcgaagacgatgatgatgtcttcgtcaatgttaagcctttcgtcttcaccgcaactactaagcccgtagcttccgctttcgtctccactgtaggttcagcatatgccaagaaaactgtagagtccgctgagcaagctgagaaatcttctaagaggaagaggaagaatcaataccgagggattaggcagcgtccttggggaaaatgggctgcggagatccgtgatccgagaaaaggctcccgagaatggcttggaacattcgacactgctgaggaagcagcaagagcttatgatgctgcagcacgcagaatccgtggcacgaaagctaaggtgaattttcccgaggagaagaaccctagcgtcgtatcccagaaacgtcctagtgctaagactaataatcttcagaaatcagtggctaaaccaaacaaaagcgtaactttggttcagcagccaacacatctgagtcagcagtactgcaacaactcctttgacaactcttttggtgatatgagtttcatggaagagaagcctcagatgtacaacaatcagtttgggttaacaaactcgttcgatgctggaggtaacaatggataccagtatttcagttccgatcagggcagtaactccttcgactgttctgagttcgggtggagtgatcacggccctaaaacacccgagatctcttcaatgcttgtcaataacaacgaagcatcatttgttgaagaaaccaatgcagccaagaagctcaaaccaaactctgatgagtcagacgatctgatggcataccttgacaacgccttgtgggacaccccactagaagtggaagccatgcttggcgcagatgctggtgctgtgactcaggaagaggaaaacccagtggagctatggagcttagatgagatcaatttcatgctggaaggagacttttgaagtgatcgatggttccttagtttgtaaataaagctgtgttggattttgctgttgggggatggtacaagtcacacctcaagctctatgc

SEQ ID NO: 3849 - DNA, 1228 bp, Artificial Sequence
  P164 (35S::G5)
cttagattttagtgaatcgagggtgaaatttttgattccctcttttcggatctacacagaggttgcttatttcaaaccttttagatccatttttttttaattttctcggaaaaatccctgtttctttacttttttataagtctcaggttcaattttttcggattcaaatttttattttaaatggcagctgctatgaatttgtacacttgtagcagatcgtttcaagactctggtggtgaactcatggacgcgcttgtaccttttatcaaaagcgtttccgattctccttcttcttcttctgcagcgtctgcgtctgcgtttcttcacccctctgcgttttctctccctcctctccccggttattacccggattcaacgttcttgacccaaccgttttcatacgggtcggatcttcaacaaaccgggtcattaatcggactcaacaacctctcttcttctcagatccaccagatccagtctcagatccatcatcctcttcctccgacgcatcacaacaacaacaactctttctcgaatcttctcagcccaaagccgttactgatgaagcaatctggagtcgctggatcttgtttcgcttacggttcaggtgttccttcgaagccgacgaagctttacagaggtgtgaggcaacgtcactggggaaaatgggtggctgagatccgtttgccgagaaatcggactcgtctctggcttgggacttttgacacggcggaggaagctgcgttggcctatgataaggcggcgtacaagctgcgcggcgatttcgcccggcttaacttccctaacctacgtcataacggatttcacatcggaggcgatttcggtgaatataaacctcttcactcctcagtcgacgctaagcttgaagctatttgtaaaagcatggcggagactcagaaacaggacaaatcgacgaaatcatcgaagaaacgtgagaagaaggtttcgtcgccagatctatcggagaaagtgaaggcggaggagaattcggtttcgatcggtggatctccaccggtgacggagtttgaagagtccaccgctggatcttcgccgttgtcggacttgacgttcgctgacccggaggagccgccgcagtggaacgagacgttctcgttggagaagtatccgtcgtacgagatcgattgggattcgattctagcttaggggcaaaataggaaattcagccgcttgcaatggagtttttgtg

SEQ ID NO: 3850 - DNA, 684 bp, Artificial Sequence
  P165 (35S::G7)
gaatcataaacgagccagaatattatcccccgggttacaacttgtctaccaccgcaatttcaaacatggtgtctatgctgactaatgttgtctctggtgagaccgaaccctcggcatctgcgacatggacgatgggtcataagagagaaagagaagagttttctttgcctcctcaaccattgattaccggttcagctgtgactaaagaatgtgaaagctcaatgtccttggagaggccaaaaaaatatagaggagtaaggcaacgaccatggggaaaatgggcggcggagattcgagacccacacaaggcgacacgtgtatggcttgggacattcgagacagccgaggccgccgcaagagcctatgatgcggcagcacttcgctttagaggaagcaaagcaaagcttaatttccccgaaaatgttggaactcagacgattcaacgaaattctcatttcttgcaaaactcaatgcaaccttctctaacatacatcgatcaatgtccaactctattatcttactctcgatgtatggagcaacaacaaccattagtaggcatgttgcagccaacagaagaggaaaatcactttttcgaaaaaccatggaccgaatatgatcaatacaattactcctcttttggttaactaacatatcgtcaacgctttgtatttctacttattcgat

SEQ ID NO: 3851 - DNA, 1246 bp, Artificial Sequence
  P167 (35S::G9)
gtgtttcttctttctgctaaaaggttataatttttgtttcttggtttggtgagaatcttcaagaaactgaaacaaagaaaatggattctagttgcatagacgagataagttcctccacttcagaatctttctccgccaccaccgccaagaagctctctcctcctcccgcggcggcgttacgcctctaccggatgggaagcggcgggagcagcgtcgtgttggatcccgagaacggcctagagacggagtcacgaaagctaccatcttcaaaatacaaaggtgttgttcctcagcctaacggaagatggggagctcagatctacgagaagcaccaacgagtatggctcgggactttcaacgagcaagaagaagctgctcgttcctacgacatcgcagcttgtagattccgtggccgcgacgccgtcgtcaacttcaagaacgttctggaagacggcgatttagcttttcttgaagctcactcaaaggccgagatcgtcgacatgttgagaaaacacacttacgccgacgagcttgaacagaacaataaacggcagttgtttctctccgtcgacgctaacggaaaacgtaacggatcgagtactactcaaaacgacaaagttttaaagacgtgtgaagttcttttcgagaaggctgttacacctagcgacgttgggaagctaaaccgtctcgtgatacctaaacaacacgccgagaaacactttccgttaccgtcaccgtcaccggcagtgactaaaggagttttgatcaacttcgaagacgttaacggtaaagtgtggaggttccgttactcatactggaacagtagtcaaagttacgtgttgaccaagggatggagtcgattcgtcaaggagaagaatcttcgagccggtgatgttgttactttcgagagatcgaccggactagagcggcagttatatattgattggaaagttcggtctggtccgagagaaaacccggttcaggtggtggttcggcttttcggagttgatatctttaatgtgaccaccgtgaagccaaacgacgtcgtggccgtttgcggtggaaagagatctcgagatgttgatgatatgtttgcgttacggtgttccaagaagcaggcgataatcaatgctttgtgacatatttccttttccgattttatgctttcgttttttaatttttttttttgtcaagttgtgtaggttgtgattcatgctaggttgtatttaggaaaagagataagacc

SEQ ID NO: 3852 - DNA, 1650 bp, Artificial Sequence; identical to SEQ ID NO: 51
  P171 (35S::G20)

SEQ ID NO: 3853 - DNA, 881 bp, Artificial Sequence; identical to SEQ ID NO: 63
  P173 (35S::G27)

SEQ ID NO: 3854 - DNA, 964 bp, Artificial Sequence; identical to SEQ ID NO: 1
  P174 (35S::G28)

SEQ ID NO: 3855 - DNA, 1440 bp, Artificial Sequence; identical to SEQ ID NO: 69
  Artificial sequence
  P179 (35S::G38)

SEQ ID NO: 3856 - DNA, 909 bp, Artificial Sequence; identical to SEQ ID NO: 71
  P181 (35S::G43)

SEQ ID NO: 3857 - DNA, 997 bp, Artificial Sequence; identical to SEQ ID NO: 73
  P182 (35S::G44)

SEQ ID NO: 3858 - DNA, 780 bp, Artificial Sequence
  P183 (35S::G156)
aggaagagggagccactcataagaggaagaagagagagatgggtagagggaagatagagataaagaagatagagaatcagacggcgaggcaagtgaccttctccaagagaagaactggtcttataaagaagactcgtgagctctctattctctgtgacgctcacatcggtctcatcgtcttctcagccaccggaaagctttccgagttctgctccgaacagaacaggatgcctcaactcattgaccgatacttgcataccaacggattgcgacttcctgatcatcatgacgaccaggagcaattgcaccatgagatggaactactaagaagagagacatgtaaccttgagcttcgtctgcgtccattccatggacatgacttagcctccattcctcctaatgagcttgacggactcgagagacagctagaacattctgtcctcaaagtccgtgagcgtaagaggaggatgctagaagaagataacaacaacatgtaccgttggcttcatgagcatcgtgcagcgatggagtttcaacaagctgggatagataccaaaccaggggagtatcaacagtttatagagcagcttcagtgctataaaccaggggagtatcagcagtttctagagcagcagcaacaacaaccaaacagcgttcttcagcttgctacacttccttctgagattgatcctacttacaatctccagcttgctcagcctaatcttcaaaacgatccaacggcccagaatgattaatacaattctcaatagatatctactc

SEQ ID NO: 3859 - DNA, 883 bp, Artificial Sequence; identical to SEQ ID NO: 119
  P184 (35S::G157)

SEQ ID NO: 3860 - DNA, 808 bp, Artificial Sequence
  P191 (35S::G180)
gtaattacgatctacaacaagtgacatcgtcgtcgacgacgattcaagagaatatgaacttcctcgttccttttgaagaaaccaatgtcttaacctttttctcttcttcttcttcctcttctctttcttctccttctttccccattcacaactcttcctccactactactactcatgcacctctagggttttctaataatcttcagggtggaggacccttgggatcaaaggtggttaatgatgatcaggagaattttggaggtggaactaacaatgatgctcattctaattcttggtggagatcaaatagtggaagtggagatatgaagaacaaagtgaagataaggaggaaactaagagagccaagattctgtttccaaaccaaaagcgatgttgatgttcttgacgatggctacaaatggcgtaaatatggtcagaaagtcgtcaagaacagccttcaccccaggagttattacagatgcacacacaacaactgtagggtgaaaaagagagtggagcgactatcggaagattgtagaatggtgattactacttacgaaggtcgtcacaaccacattccctctgatgactccacttctcctgaccatgattgtctctcttccttttaacatctctttctatatatctatatatagacagttatatgtgcacatatagatgtgtgatatattgcatatttgatattgcatgtgtttttcaagagtatgtcatcagatgttatgcatatattcttgacttgttgcttatagtatacatatgtaataatatatattgacattggtagttc

SEQ ID NO: 3861 - DNA, 1191 bp, Artificial Sequence; identical to SEQ ID NO: 153
  P194 (35S::G188)

SEQ ID NO: 3862 - DNA, 1171 bp, Artificial Sequence; identical to SEQ ID NO: 159
  P196 (35S::G192)

SEQ ID NO: 3863 - DNA, 1099 bp, Artificial Sequence
  P197 (35S::G194)
gccatttgatagattgtttccggtaaagctcagcgagagaagaagaagaacaacaatggagtttacagatttctcaaagacgagtttttactacccgtcgtcacaaagcgtttgggatttcggagatttagcggcggcggagaggcattctttagggttcatggagttattaagttctcagcagcatcaagactttgctactgtttctcctcattccttccttctccaaacgtctcaaccgcaaacgcaaacgcaaccatcggcgaagctgtcttcaagtatcattcaagctccaccgtcagagcaattagtgacgtcaaaggtggagtctttgtgttcggatcatttgttgataaacccaccggcgactcctaactcgtcatcgatttcgtctgcttcaagcgaggctctaaatgaagagaaaccgaaaacagaagacaatgaagaagaaggaggtgaagatcaacaagagaagagtcatactaagaaacagttgaaagcaaagaagaataatcagaagagacagagagaggcaagagtcgcattcatgacaaagagtgaagttgatcatctcgaagatggttatcgctggcgaaaatatggtcaaaaagctgtcaaaaacagtccttttcccaggagttactaccgttgcacaacggcttcatgtaacgtgaagaagagagtggagagatcattcagagatccaagcactgtggttacaacctacgaaggtcaacacactcacattagtccactcacgtctcgtcctatttccactggaggtttcttcggatcgtcaggagctgcttcgagtctcggtaatggttgctttgggtttcctattgatggctccacgttaatctctcctcagttccaacagcttgtccaataccatcaccaacagcagcaacaagaactcatgtcttgttttggaggagtcaacgagtaccttaatagccacgctaatgagtatggtgatgataatcgtgtgaagaagagtcgagttttggttaaagataatggacttctgcaagatgttgttccgtctcatatgttgaaggaagagtagtagtatatatatagtcttatagttttaatc

SEQ ID NO: 3864 - DNA, 1061 bp, Artificial Sequence
  P201 (35S::G234)
acagaggccgctatcaagaacaagactaagaacaagacttcactaggagtacaagtatgggaagagcaccgtgttgtgacaaagcaaacgtgaagaaagggccttggtctcctgaggaagatgcaaaactcaaatcttacattgaaaatagtggcaccggaggcaattggatcgctttgcctcaaaagattggtttaaagagatgtggaaagagttgcaggctgaggtggcttaactatcttagaccaaacatcaaacatggtggcttctctgaggaagaagaaaacatcatttgtagcctttaccttacaattggtagcaggtggtctataatcgctgctcaattgccgggacgaacagacaacgatataaaaaactattggaacacgaggctcaagaagaaactcattaacaaacaacgcaaggagcttcaagaagcttgtatggagcagcaagagatgatggtgatgatgaagagacaacaccaacaacaacaaatccaaacttcttttatgatgagacaagaccaaacaatgttcacatggccactacatcatcataatgttcaagttccagctcttttcagaatcaaaccaactcgttttgcgaccaagaagatgttaagccagtgctcatcaagaacatggtcaagatcgaagatcaagaactggagaaaacaaacctcatcatcatcaagattcaatgacaacgcttttgatcatctctctttctctcaactcttgttagatcctaatcataaccacttaggatcaggagagggtttctccatgaactctatcttgagcgccaacacaaactctccattgcttaacacaagtaatgataatcagtggttcgggaatttccaggccgaaaccgtaaacttgttctcaggagcctccacaagtacttcggcagatcaaagcactataagttgggaagacataagctctcttgtttattctgattcaaagcaatttttttaattataataatatattattcttaagatgaaacgtacatcattattattaattgggggtacgtaacgtatatatgga

SEQ ID NO: 3865 - DNA, 727 bp, Artificial Sequence
  P204 (35S::G249)
cgacatggagaaaagagaaagtagtggtgggtctggatcaggagatgcagaggtgagaaaagggccatggacgatggaagaagatttgattctcatcaattatatcgccaatcatggtgaaggtgtttggaactctctcgccaaatctgcaggactaaaacgcaccgggaaaagttgccggctccggtggctgaactacctccgacctgatgcgcgacggggaaatatcacaccagaagaacagctcaccatcatggaacttcatgcaaaatggggaaataggtggtcaaaaattgcaaagcatttaccaggaagaaccgacaatgagataaagaatttttggaggactaagatccagaaatacatcatcaagagcggagaaacgacgaccgttggatcacaaagctccgagtttataaaccatcatgcgacaacgagccatgtcatgaatgatactcaagaaaccatggatatgtattctccaacgacgtcgtatcaacatgccagcaatattaatcagcagcttaattatggtaattatgtgcctgaatccggttcgatcatgatgccattatctgttgatcagtccgaacaaaactattggagcgtcgatgatctttggcccatgaatatatataatggtaattaataaataagttcgttaaaacttatatatatttacggtccaaagagggttctatataaacagagtactgtatgggattgc

SEQ ID NO: 3866 - DNA, 1391 bp, Artificial Sequence; identical to SEQ ID NO: 225
  P205 (35S::G254)

SEQ ID NO: 3867 - DNA, 1749 bp, Artificial Sequence
  P206 (35S::G261)
attttgggcttctgattttgatcgaaacttactgatagtaagttctttgagtcctccttaactgtagtttctgtgtactgaagttattgaattgaaagtttttatcttttttggttattgaaactttcatagtttgatcaaaagagtctcttgctctgtttttggctctgtttttgtgagtgtgattgtaagctttgttgtgagtagattgaatcaaggagtgtgagagttgttaaaagtgttttcagagatggatgagaataatcatggagtttcatcaagctcacttccacctttcctcaccaaaacatatgagatggttgatgattcttcatccgattctatcgtctcttggagtcagagcaataagagtttcatcgtttggaatccgccggagttttctagagatcttcttccgagattcttcaagcacaataacttctctagctttatccgccagcttaacacatatgtaagtgttttcatgctttgtttaaaagtattgactaaatcaatcatcttcttagtggaatttgtttttgtgtgtagggttttagaaaagctgatcctgagcaatgggaatttgcggaatgatgattttgtgagaggtcaacctcatcttatgaagaacattcatagacgcaaaccagttcatagccactctttaccgaatcttcaagctcagttaaacccgttgacggattcagaacgagtgagaatgaataatcagattgagagattgacaaaagagaaagaaggattgcttgaagagttacataaacaagacgaggaacgagaagtgtttgagatgcaagtgaaagaacttaaagaacgattacaacacatggagaagcgtcagaaaacaatggtttcgtttgtttctcaagtattggaaaagccagggcttgctttgaacctatcgccgtgtgttcccgaaacaaacgagaggaaaagaaggttccctaggatcgagttctttcccgatgaaccgatgttggaagagaacaaaacttgtgttgttgtgagagaggaaggttctacaagcccttcttcacacacaagagagcatcaagtggaacagttagagtcatcgatagcgatttgggagaatcttgtatcggattcttgtgagagtatgttacaatcaagaagtatgatgacacttgatgtggatgaatcatctacttttccagagagccctcctctttcttgcatacagttaagtgtcgattcacgtctcaaatctcctccttctccaaggatcatcgatatgaactgtgagcccgatggttcgaaagaacagaacactgttgctgctcctcctcctcctccagtagcaggagcgaatgatggcttctggcagcagtttttctcagagaatcctggctcaaccgagcaacgggaagttcaattagagaggaaagacgataaagataaagccggagtacgtactgagaaatgttggtggaattcgagaaatgttaatgcaattacagaacagcttggacatctgacttcttcagagagaagttgatatgtcaaagattaaatttctagtctgttttagttacttgtaaaatagggtttctcagttttattgttttcgattacagtacttaggtatggttcagctgtttatttatcacttgtatgatctttcacagttcattgtagcagacttcaatggtaatgataagctagagcttatggatagtattcataaaatgagattgaccttcaacaaaaaaa

SEQ ID NO: 3868 - DNA, 1104 bp, Artificial Sequence; identical to SEQ ID NO: 237
  P207 (35S::G263)

SEQ ID NO: 3869 - DNA, 1379 bp, Artificial Sequence; identical to SEQ ID NO: 245
  P209 (35S::G271)

SEQ ID NO: 3870 - DNA, 2330 bp, Artificial Sequence; identical to SEQ ID NO: 247
  P211 (35S::G274)

SEQ ID NO: 3871 - DNA, 1350 bp, Artificial Sequence; identical to SEQ ID NO: 257
  P219 (35S::G291)

SEQ ID NO: 3872 - DNA, 1764 bp, Artificial Sequence; identical to SEQ ID NO: 261
  P224 (35S::G307)

SEQ ID NO: 3873 - DNA, 1951 bp, Artificial Sequence; identical to SEQ ID NO: 263
  P225 (35S::G308)

SEQ ID NO: 3874 - DNA, 1558 bp, Artificial Sequence; identical to SEQ ID NO: 277
  P229 (35S::G326)

SEQ ID NO: 3875 - DNA, 927 bp, Artificial Sequence
  P245 (35S::G371)
ttttttgggtagtgtaagttttaaattcaagatcgatcatgctaagtatatacacaacaattctgttataatctatattgatcttcatattttgatgatatttcttgtttctatgaagtatcattgattttataaatctctaattggaattagactttagtatttactatttacttatttaggtgaaatctcattaaataaacaacgactggtcaagtgaatggttgtttgtcttgtatgttttagtaaaatggagattgagaaggatgaggacgacacaacattggttgattctggaggagacttcgactgcaacatatgtttggatcaggttcgagacccggtcgtgactttatgtggccacctgttttgttggccctgcattcacaagtggacttatgcgtccaacaattcaagacaacgagtcgatcaatacgatcataagagggaaccaccaaaatgtccggtatgcaaatctgatgtctccgaggctacgcttgtcccgatctacggacgaggacagaaagctccccagtccggttcaaatgtaccgagcagaccaactggtccggtttatgacttaagaggagttggtcaacgtttaggagaaggggagagtcaacgttacatgtatagaatgcctgatccggtgatgggtgtggtatgcgaaatggtataccggagactatttggagagtcttcgagcaacatggcaccttaccgcgatatgaatgtccggtctaggcgacgggcaatgcaggctgaggagtcattaagcagagtctacttgtttctactttgcttcatgtttatgtgtctatttctcttctaattataatatatatgtgtatataatataccaattggaatgagtatgcatatatgtaataacaatttgtatatttttaagagtcttgaatcgttgaa

SEQ ID NO: 3876 - DNA, 726 bp, Artificial Sequence; identical to SEQ ID NO: 319
  P247 (35S::G378)

SEQ ID NO: 3877 - DNA, 2216 bp, Artificial Sequence
  P248 (35S::G385)
tagggtttgctttcagtttccggagtataagaaaagatgttcgagccaaatatgctgcttgcggctatgaacaacgcagacagcaataaccacaactacaaccacgaagacaacaataatgaaggatttcttcgggacgatgaattcgacagtccgaatactaaatcgggaagtgagaatcaagaaggaggatcaggaaacgaccaagatcctcttcatcctaacaagaagaaacgatatcatcgacacacccaacttcagatccaggagatggaagcgttcttcaaagagtgtcctcacccagatgacaagcaaaggaaacagctaagccgtgaattgaatttggaacctcttcaggtcaaattctggttccaaaacaaacgtacccaaatgaagaatcatcacgagcggcatgagaactcacatcttcgggcggagaacgaaaagcttcgaaacgacaacctaagatatcgagaggctcttgcaaatgcttcgtgtcctaattgtggtggtccaacagctatcggagaaatgtcattcgacgaacaccaactccgtctcgaaaatgctcgattaagggaagagatcgaccgtatatccgcaatcgcagctaaatacgtaggcaagccagtctcaaactatccacttatgtctcctcctcctcttcctccacgtccactagaactcgccatgggaaatattggaggagaagcttatggaaacaatccaaacgatctccttaagtccatcactgcaccaacagaatctgacaaacctgtcatcatcgacttatccgtggctgcaatggaagagctcatgaggatggttcaagtagacgagcctctgtggaagagtttggctttagacgaagaagaatatgcaaggacctttcctagagggatcggacctagaccggctggatatagatcagaagcttcgcgagaaagcgcggttgtgatcatgaatcatgttaacatcgttgagattctcatggatgtgaatcaatggtcgacgattttcgcggggatggtttctagagcaatgacattagcggttttatcgacaggagttgcaggaaactataatggagctcttcaagtgatgagcgcagagtttcaagttccatctccattagtcccaacacgtgaaacctatttcgcacgttactgtaaacaacaaggagatggttcgtgggcggttgtcgatatttcgttggatagtctccaaccaaatcccccggctagatgcaggcggcgagcttcaggatgtttgattcaagaattgccaaatggatattctaaggtgacttgggtggagcatgtggaagttgatgacagaggagttcataacttatacaaacacatggttagtactggtcatgccttcggtgctaaacgctgggtagccattcttgaccgccaatgcgagcggttagctagtgtcatggctacaaacatttcctctggagaagttggcgtgataaccaaccaagaagggaggaggagtatgctgaaattggcagagcggatggttataagcttttgtgcaggagtgagtgcttcaaccgctcacacgtggactacattgtccggtacaggagctgaagatgttagagtgatgactaggaagagtgtggatgatccaggaaggtctcctggtattgttcttagtgcagccacttctttttggatccctgttcctccaaagcgagtctttgacttcctcagagacgagaattcaagaaatgagtgggatattctgtctaatggaggagttgtgcaagaaatggcacatattgctaacgggagggataccggaaactgtgtttctcttcttcgggtaaatagtgcaaactctagccagagcaatatgctgatcctacaagagagctgcattgatcctacagcttcctttgtgatctatgctccagtcgatattgtagctatgaacatagtgcttaatggaggtgatccagactatgtggctctgcttccatcaggttttgctattcttcctgatggtaatgccaatagtggagcccctggaggagatggagggtcgctcttgactgttgcttttcagattctggttgactcagttcctacggctaagctgtctcttggctctgttgcaactgtcaataatctaatagcttgcactgttgagagaatcaaagcttcaatgtcttgtgagactgcttgaaaaccatccattag

SEQ ID NO: 3878 - DNA, 2987 bp, Artificial Sequence
  P249 (35S::G391)
ctcctctctcgccattgccctctggcgttttctgtcttgagctaaagaaataacaaataaaccgaaaaaaataaaaatagaaacttttttttttgtttatttgttctttctccaaaactccttttttttctcaccattatctcatgaacgtgagtggaggctctctgagtagagagagcctacccttgaaaataacctagggatttctccaattttcaagctttacccattcaaaagaatcgtccttttttcctatttctgactttgagctatgatgatggtccattcgatgagcagagatatgatgaacagagagtcgccggataaagggttagattccggcaagtatgtgaggtacacgccggagcaagtggaagctctcgagagagtttacactgagtgtcctaagccaagttctctaagaagacaacaactcatacgtgaatgtccgattctctctaacatcgagcctaagcagatcaaagtttggtttcagaaccgcagatgtcgtgagaagcagaggaaagaagctgctcgtcttcaaacagtgaacagaaaactcaatgccatgaacaaactcttgatggaagagaatgatcgtttgcagaagcaagtttctaacttggtctatgagaatggccacatgaaacatcaacttcacactgcttctgggacgaccacagacaacagctgtgagtctgtggtcgtgagtggtcagcaacatcaacagcaaaacccaaatcctcagcatcagcaacgtgatgctaacaacccagcaggactcctttctatagcagaggaggccctagcagagttcctttccaaggctacaggaactgctgttgactgggttcagatgattgggatgaagcctggtccggattctattggcatagtcgctatttcgcgcaactgcagcggaattgcagcacgtgcctgcggcctcgtgagtttagaacccatgaaggttgctgaaattctcaaagatcgtccatcttggctccgagattgtcgaagtgtggatactctgagtgtgatacctgctggaaacggtgggacgatcgagcttatttacacgcagatgtatgctcctacgactttagcagcagctcgtgacttttggacgctgagatatagcacatgtttggaagatggaagctatgtggtttgtgaaaggtcgcttacttctgcaactggtggccccactgggccaccttcttcaaactttgtgagagctgaaatgaaaccaagcgggtttctcatccgtccttgcgatggtggtggttccattctccacattgttgatcatgttgatctggatgcctggagtgtccctgaagtcatgaggcctctctatgaatcatcgaagattcttgctcagaaaatgactgttgctgctttgagacatgtaagacaaattgcacaagaaacaagtggagaagttcagtatggtggagggcgccaacctgcggttttaagaaccttcagtcaaagactctgtcggggtttcaatgatgctgttaatggttttgtggatgatggatggtcaccaatgggtagcgatggtgcagaggatgttactgtaatgataaacttgtcccctgggaagtttggtgggtctcagtacggtaattcattccttccaagctttggtagtggcgtgctttgtgccaaggcatctatgttgcttcagaacgttccacccgctgtgctggttcgattccttagagaacaccgatctgaatgggctgattatggcgtggatgcttatgctgctgcatcgctcagagcaagtccttttgctgttccttgtgctagagctggggggttcccaagtaaccaagtcattcttcctcttgcgcagacagttgaacatgaagagtcacttgaggtggttagacttgaaggtcacgcttactcacccgaagacatgggtttagctcgggatatgtatttgctacagctttgtagcggtgttgatgaaaatgtggttggaggttgtgcacagcttgtatttgcccctatcgatgaatcatttgctgatgatgcacctttgcttccttccggtttccgcatcatacctcttgaacagaaatctactccgaacggtgcatctgcaaaccgtaccctggatttagcctcagctttagaaggatccacacgtcaagctggtgaagccgacccaaatggctgtaactttaggtcggtactaaccatagcattccagttcacatttgataaccattcaagagacagtgttgcttcaatggcacgtcagtacgtgcgaagcatagtaggatcgattcagagggttgctctagccattgctcctcgtcctggctccaatatcagtccaatatctgttcccacttcccctgaagctctcactctggtccgttggatctcccggagttacagccttcacactggtgcagatctctttggatctgattctcaaaccagtggtgacacgttgctgcatcaactctggaatcactctgatgcaatcttgtgctgctccctcaaaacaaacgcttcaccggttttcacattcgcaaaccaaaccggtttagacatgctggaaacgactcttgtagcccttcaagacataatgctagacaagacccttgacgaacctggtcgtaaagctctttgctctgagttccccaagatcatgcaacagggctatgctcatctgccggcaggagtatgtgcgtcaagcatgggaaggatggtatcttacgagcaggcaacggtgtggaaagttcttgaagacgatgaatcaaaccactgcttagctttcatgttcgtgaattggtcgttcgtttgaagaataataagaaataagaagaccagattttactccatttttcccttggtagggaggttatttatgtaagatattaaagttaggtgccactatgctccaaagtcttttgaaattcgaggaccaatatgtaatatgacgaatgtctgatcttgtatgg

SEQ ID NO: 3879 - DNA, 1507 bp, Artificial Sequence; identical to SEQ ID NO: 359
  P258 (35S::G440)

SEQ ID NO: 3880 - DNA, 1218 bp, Artificial Sequence; identical to SEQ ID NO: 385
  P268 (35S::G477)

SEQ ID NO: 3881 - DNA, 2073 bp, Artificial Sequence
  P273 (35S::G505)
ccatccattatattaacctatttatcttcttcttcaaaacatttgagtctccttagggttttttctctctcaaacaaaagctttagatctttcttcttaatggacattccgtattaccactacgaccatggcggagacagccaatatcttccaccgggtttcaggtttcatcccacggacgaagagctcatcactcattaccttctccgcaaagtcctcgacggttgcttctcaagccgtgccatcgcagaagttgatctcaacaagtgtgagccttggcaacttcccggtaagaaaatacaaaactaacttacttgtagttcttttgtaattaaggtttctgaaatctttactctcaatgttacttagggagagctaagatgggagagaaagaatggtacttctttagcctccgtgaccggaagtatccgacgggactgagaactaacagagcaactgaggctggttactggaaagctaccggaaaagacagagagatctttagttcaaagacttgtgcacttgttgggatgaagaagactcttgtcttttacaaaggaagagctccgaaaggagagaagagtaattgggttatgcatgaatatcgtcttgaaggcaaattctcttaccatttcatctcaagaagctccaaggtacttcgatttaacctttcattagttattttgttgataaagtaaagccttaattttctttgattaataaatttacaatctattatttggaaaaaaaattcgagagtgtgacatagtcggtgacgttgatttttttctcttttgctttattgcatttaattttgatggctgaaaaggcatggttctttactgtggttatctgagagcattatggaacatgaaatagaaaagatctgctgtttttatgtattgggatttcaatcataatggtgttttcctaaagtaagaaaacattcaatagctctgataaaataaaatattaatacatcctacttttggaaagcttaatgcaaaaaaccagaaccaatgcaaatcttcaggatttttttctgacctagatatattaaaaagaaatttaattaaattaattttacttaattagtgttccatatccattgtagacttgtagtgtccaatgtacattccctctgtgcacgcttttactctatggtttttcttaatcttcactctcttttatttccaagatctaacattgactttctcatcaaacatatattatataaaatatttgacttttcaaaactctaatttattccttcaggatgaatgggtgatctctagggttttccagaaaaccactttagctagcaccggagccgtctccgaaggaggaggaggaggaggagcaactgtgagcgtaagcagcggtactggtccatctaaaaagacgaaagtaccctcaacaatctcaagaaactatcaagaacaaccaagctctccttcctccgtctcactcccacctctcctggatccgaccactaccctcggctacaccgacagcagttgctcctacgacagccgtagcaccaacacaaccgtcacagccagcgcaataaccgagcacgtgtcctgtttctccactgtccctactactactacggccttgggcttagacgttaactcattcagccgtcttccaccgccgctagggtttgactttgacccttttcctcgtttcgtttctagaaacgtctcgactcaatctaacttcagatcgttccaagaaaacttcaatcaatttccttactttggatcgtcttctgcatcgactatgacctccgccgttaatctgccttctttccaaggcggcggaggcgtctccgggatgaattactggctaccggcgactgccgaagagaatgagtcaaaggtcggtgtgcttcatgctggacttgactgtatttggaactactgatcacaaaagaggtgacttataattgttcccgttagggttttatttatgtatttctaggatgattatggtattatgaaatgtgtgtaccgaggagcttaatattgcacttagcttgatgttccgcttaattctctagttttaagt

SEQ ID NO: 3882 - DNA, 1723 bp, Artificial Sequence
  P279 (35S::G516)
ccctctcttagttttgatctgaacctttttgtagctgttgaaaaatggcgaatccggtgggttttagattccgtccgactgacggggagatcgtcgacatttacctccgaccgaaaaatctcgaaagtaacacgagccatgtcgatgaagtcattagcacagttgatatttgtagcttcgacccttgggacttaccttgtaagtctttctaacgcgagtgtttgtttttctttggttcccaactgttgtatcatcccggtaatttctgatcatgttctgtctttcccagcccattctaggatgaaaacaagagatcaggtttggtatttcttcggccgtaaggagaacaaatatggtaaaggtgatcgacagataagaaaaaccaagtctggtttttggaagaaaactggcgttaccatggatataatgcgcaaaacgggagatcgtgagaagatcggtgagaaaagggttttggtgtttaagaatcacggtggttccaagtccgattgggctatgcatgagtatcacgctacgttctcgtctcctaatcaggtcatttttcgattctcttgtttaggcttctttaacttgttgttgttgttttcttaccgtgattttatttctcgtaaacgggaaaaatctgagtttatggtaatcatttatgctgagttgatctgtagataatgacatacacactctgcaaagttaagtttaagggtgaaaggagagaattttcagttgctactggtagtggaattaagcatactcactctttaatccctcctaccaacaattctggagttttgagtgtagagacagaggtgagtcaatctcaaaaactttccctgtttctcttttaaatcttcaaaatcatatctcgtacacatagttttttcatctgtgttacgttgttccttttttcagggatcgttgtttcacagccaagaatcacagaatccaagtcagttttctggctttcttgatgtggatgcactagatagggacttctgcaatattttgagtgatgatttcaaaggcttctttaatgatgacgatgagcagagtaagattgtttctatgcaagatgatcgcaacaaccacacacctcaaaagccattgaccggtgtcttcagtgatcatagcaccgatggtagtgattctgatccgatttctgcaacaactgtaagcaaaattttcctattttacctttactatctcctctgttttcagttttttctcacaaagctatagttttgtttaatacgacagatttccattcaaactttaagcacttgtcctagttttggtagctcaaatcctctataccaaatcactgacttgcaggaatctcctaactcaatcaagttagtgtcattagctcaagaggtgagctttatcatctccttttcttaaagaccaaccattctaaactgctaattaaccaagctactttgtgccagtactcacagcattttgggttctatgatgtgatttaaggtgagcaaaacaccgggaaccggtattgataatgatgcacaagggactgagattggtgagcataaattgggtcaagagacgatcaagaacaaaagagctggtttctttcacaggatgatacaaaaattcgtcaagaaaattcacctaagaacatgatatcaattttgtactttccaaaatctgtagtagtatgtaatatgtgtctatctggttttgtaacttttac

SEQ ID NO: 3883 - DNA, 1254 bp, Artificial Sequence; identical to SEQ ID NO: 415
  P281 (35S::G519)

SEQ ID NO: 3884 - DNA, 1641 bp, Artificial Sequence
  P282 (35S::G521)
gtctctgctagatcttgttattgtgagttttttgctttactggtgagggaagttacttagtgtagtgaaagttttccccttgtcttccaatggggaaaactaacttggcacctggttttcggtttcatccgactgatgttgaacttgtgagatactacttgaagaggaaagttatgggaaaaaagttccaagttgatgccattgctgaggtcgacatttacaagttcgaacctcctgatttacccggtaactaactcattctttcagaaatctttgttctgtttcatgctttcttatttatttcctgattactaacagaggtttctttacattgtacagacaaatcatgtctagggactggagatcttaagtggtacttcttctgtccaagagaaaagaagtatcccaaaggcggtaaggcaaaccgctctactgaatgtggttactggaagaccacagggagagacagagatgtttcttataatgacgaagtcactgggaagataagaactctgatttatcactacgggaaaatacctcgcggtgatcggactgattgggtcatacatgaatatagacttgaagacaaagtactggctcaaaagaatgttcctcaggtaatgacgattcgttcttgtctttttttaacgttttgattccttgcaagtttactaaacatgcttgttgtgccctgcaggatacttatgtgctttgcgttctctttaagaaaaatggacttggaccaagacatggatctcaatatggtgctccatttaaggaagaggattggagtgataaggaagaagaatatactcagaatcatcttgtagctggtcctagtaaagaaaccagtctagctgctaaggcctcacactcgtacgctcctaaggatggtttgacaggagtgatctcagaatcttgcgtctctgatgtgccgccactaactgccacagtgcttccacctctaacaagtgatgttatagcttacaatcccttttcttcttcacctcttcttgaggttcctcaagtatctctcgatggtggcgagttaaattcgatgcttgatctcttttctgttgacaatgacgactgtttacttttcgacgatttcgactaccataatgaggtaagtctgtctctgcatcatcatgcttttgatgaatcagatttcagtgttcctgaaaagaaacttgttttgattgcttctgaaactacaggtaagacatcctgatggttttgtaaacaaggaagctccggtgttcttaggagatggcaatttcagtggaatgtttgacctgagcaatgaccaagtcgtagagctacaggatctgatacagtcacccactcctcatcctccttctcctccagctcaagctagtattcctgatgactcaagaagcaacggtcagactaaggacgattaagtattttgtgctgacttatgctctttcttgctttggtctgatgctccatggaaacagagaccaaacatgtgaagctttagccagaacgtttctattgttgccatctctgtctgcacgaaagaagagacaaaaccatgaatcagtaacttgaaaccgtccagtagtggagccagctttctatgttatgtttctgcaactgcgttgtctgtagtcttag

SEQ ID NO: 3885 - DNA, 1481 bp, Artificial Sequence; identical to SEQ ID NO: 423
  P285 (35S::G526)

SEQ ID NO: 3886 - DNA, 768 bp, Artificial Sequence; identical to SEQ ID NO: 425
  P292 (35S::G536)

SEQ ID NO: 3887 - DNA, 1771 bp, Artificial Sequence
  P295 (35S::G559)
aataatcgtttgcagggtcgttgatttggtgataagtcagtagaaatggataaggagaaatctccagcacctccttgtggaggtcttcctcctccatctccatcaggtcgatgctctgcattctcagaagctggtcccattggtcatggttcagatgctaatcgaatgagtcatgatattagccgtatgcttgataacccacctaagaagattggacatcggcgagctcattctgaaatacttactctccctgatgatttgagctttgatagtgatcttggtgtggttggtaatgctgctgatggagcttctttctctgatgagactgaagaagatttgctctctatgtatcttgatatggataagtttaattcttctgctacatcttctgcccaagttggtgagccatcaggaactgcttggaaaaatgagacaatgatgcagacaggcacaggctcaacttccaatcctcagaatacggttaatagtcttggcgaaaggccaagaatcaggcatcaacatagccaatctatggatggttcaatgaatatcaatgagatgcttatgtcgggaaatgaagatgattctgctattgatgctaagaagtctatgtctgctactaaacttgctgagcttgctctcattgatcctaaacgtgctaagaggtaattggttttcgtttttcttctgtgattctctggtttcttaaatcctgtttatagtgtggatggacacggtgactatttgtgtgcttttggtttgaaccttaatgccaccagtcatttagttgcttcagctgttcccacataacttcagctttttaatgagtggagcaagtgtataatttgtttttgtttcatacaataggatatgggcaaacaggcagtccgcagcacgatcaaaagaaaggaagacgagatacatatttgagcttgagagaaaagtacagactttgcaaacagaggctacaactctctcagcccagttgaccctcttacaggttagttttgactcattgtacggttgttctttcttcatgctaaatgaaactaaatctagccttacaacgtttgttcgtgcattgtgattttttatgggttgaaaacttgtgctcttttcttcctgtttgtatagagagacacaaatggcttgactgttgaaaacaatgagctgaagctgcggttacaaacaatggagcagcaggttcacttgcaggatggtgagtctctcttttatcacaaacaatatccctctgtgccaagactgctatagttggttcatatcatcgaattgaatcttctctattaacagaactaaacgaagcactaaaggaggaaatccagcatctgaaggtgttgactggccaagttgctccatcagcgttgaactatgggtcgtttggatcaaaccagcagcaattctattccaacaatcagtcaatgcaaacaatcttagctgcaaaacagttccagcaacttcagattcattcacagaagcagcaacaacaacaacaacaacaacaacagcaacaccaacagcagcagcagcaacagcaacagtatcagtttcaacagcaacagatgcaacagcttatgcagcagcggcttcaacagcaagaacaacaaaatggagtaagactcaagccttcacaagcccagaaagagaactgaggaatatgaatatgtcccacgtaagtgagaggttctccttctgaacaattcctttctcattcataaattgttgttcatccatcacttgcagtctcttggat

SEQ ID NO: 3888 - DNA, 1405 bp, Artificial Sequence
  P297 (35S::G562)
gattcttgtagaaagagtcattgttctcttgagtgggaaaccttgaaaccattcctatgggaaatagcagcgaggaaccaaagcctcctaccaaatcagataaaccatcttcacccccggtggatcaaacaaatgttcatgtctaccctgattgggcagctatgcaggcatattatggtccaagagtagcaatgcctccttattacaattcagctatggctgcatctggtcatcctcctcctccttacatgtggaatcctcagcatatgatgtcaccatctggagcaccctatgctgctgtttatcctcatggaggaggagtttacgctcatcccggtattcccatgggatcactgcctcaaggtcaaaaggatccacctttaacaactccggggacgcttttgagcatcgacactcctactaaatctacagggaacacagacaatggattgatgaagaagctgaaagagtttgatgggcttgctatgtctctaggaaatgggaatcctgaaaatggtgcagatgaacataaacgatcacggaacagctcagaaactgatggttctactgatggaagtgatgggaatacaactggggcagatgaaccgaaacttaaaagaagtcgagagggaactccaacaaaagatgggaaacaattggttcaagctagctcatttcattctgtttctccgtcaagtggtgataccggcgtaaaactcattcaaggatctggagctatactctctcctggtgtaagtgcaaattccaaccccttcatgtcacaatctttagccatggttcctcctgaaacttggcttcagaacgagagagaactgaaacgggagcgaaggaaacagtctaatagagaatctgctagaaggtcaagattaaggaaacaggccgagacagaagaacttgctaggaaagtggaagccttgacagccgaaaacatggcattaagatctgaactaaaccaacttaatgagaaatctgataaactaagaggagcaaatgcaaccttgttggacaaactgaaatgctcggaacccgaaaagagagtccccgcaaatatgttgtctagagttaagaactcaggagctggagataagaacaagaaccaaggagacaatgattctaactctacaagcaaattccatcaactgctcgatacgaagcctcgagctaaagcagtagctgcaggctgaatcgatggtaattcatgtcgatttctacttaatttgtcgacataaacaaagaaaataagtgctactaatttcagaaaaacttgatagatagatagtatagtagagagagagagagagagagaggtgtgatgattattgatctataaattttcggagagagagagggagaaagagaaacttttcctccagatgaaaatttg

SEQ ID NO: 3889 - DNA, 2162 bp, Artificial Sequence; identical to SEQ ID NO: 463
  P308 (35S::G584)

SEQ ID NO: 3890 - DNA, 1287 bp, Artificial Sequence
  P310 (35S::G592)
cttcctgaaacgtcacgagacagagcttacaagaagagaaaacagaggaaatttcgttgcattttttttacatattgattcgattaatggattcaaataatcatctctacgacccgaatcccaccgggtcgggtcttcttcgttttagatcagctccgagctctgttctcgccgcttttgttgacgacgacaagattggtttcgactccgataggttgctttcaagattcgtgacctctaatggcgttaacggagatctgggttcacctaaattcgaggataagtctccggtttcgttaacgaacacctctgtttcatacgccgccactctgccgccaccgccgcagcttgagccgtcgagttttctgggtttgccgccgcattacccgaggcagagtaaagggataatgaactcggttggtttggatcagtttctcggtatcaataatcatcacaccaaaccagttgaatctaatcttctccgtcaaagcagctctccagccggaatgtttactaatctctctgaccaaaacggttatggttcaatgaggaatttgatgaattacgaagaagatgaagagagtccatctaattccaatggattaagacgccattgcagtctctcttcaaggccaccttcttcacttggaatgctttctcaaatacctgaaatcgcacccgaaactaattttccatatagccattggaatgatccatccagctttattgataacttatcctcacttaaaagagaagccgaggacgatggaaaattgtttctcggagctcagaacggagagtccgggaatcgtatgcagttactgtcgcatcatttgagcctaccaaagtcatcatcgacagcctcggacatggtttcagtggataagtatcttcagctacaagattctgttccttgtaaaatcagagccaaacgtggttgcgctacacatcctcgaagcatcgctgaacgggtaagaagaacgcggataagcgagcgaatgaggaagttacaagagcttgttcctaacatggacaagcaaaccaacacttcggatatgttggatttagctgtggattacatcaaagatttacaaagacagtataagattttaaacgacaacagagctaactgtaagtgtatgaacaaggagaagaagtcaatatagggcgcaacaaagtgtgtagtagataggactaaaaagcagggagaaggacaagaaagaaacaatgtcatgtctgaatattttttagccgaaacagaccaaattgtctatgtaagctctcgag

SEQ ID NO: 3891 - DNA, 1292 bp, Artificial Sequence; identical to SEQ ID NO: 473
  P311 (35S::G594)

SEQ ID NO: 3892 - DNA, 1226 bp, Artificial Sequence; identical to SEQ ID NO: 477
  P315 (35S::G598)

SEQ ID NO: 3893 - DNA, 1431 bp, Artificial Sequence; identical to SEQ ID NO: 489
  P320 (35S::G616)

SEQ ID NO: 3894 - DNA, 800 bp, Artificial Sequence
  P321 (35S::G620)
tgaacttggaccagcacagcaacaacccaaccccaatgaccagctcagtcgtagtagccggcgccggtgacaagaacaatggtatcgtggtccagcagcaaccaccatgtgtggctcgtgagcaagaccaatacatgccaatcgcaaacgtcataagaatcatgcgtaaaaccttaccgtctcacgccaaaatctctgacgacgccaaagaaacgattcaagaatgtgtctccgagtacatcagcttcgtgaccggtgaagccaacgagcgttgccaacgtgagcaacgtaagaccataactgctgaagatatcctttgggctatgagcaagcttgggttcgataactacgtggaccccctcaccgtgttcattaaccggtaccgtgagatagagaccgatcgtggttctgcacttagaggtgagccaccgtcgttgagacaaacctatggaggaaatggtattgggtttcacggcccatctcatggcctacctcctccgggtccttatggttatggtatgttggaccaatccatggttatgggaggtggtcggtactaccaaaacgggtcgtcgggtcaagatgaatccagtgttggtggtggctcttcgtcttccattaacggaatgccggcttttgaccattatggtcagtataagtgaagatggaattattcttcatttttatatctgttcaaaacatgtgtttggatagatattttatttttatgtcttatcaataacatttctatataatgttgcttctttaaggaaaagtgttgtatttcaatactttatgag

SEQ ID NO: 3895 - DNA, 2709 bp, Artificial Sequence
  P324 (35S::G634)
cggagctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcagagctcctctttgggaacatgtttccaggtctctcttcctctcttctcttccattttcatcaatggtgtttcttgatagagatccatttgcatgtgttttttttttgttaactttttttttttagtgttaggtatatataaatagtaatatattcgagatcaaagcatcttcaccatccccaagaaaaattaaaagaactgtttgtttattacagaagttggttcatgagtttctgggacgttttcgattttgaaaatcccaagactctctttacttccaaaaaaaaaaaaaaaaaatccgatcgaacagtaaccataaaaattttccagctaataacgacaaccaaaaataaaataaaactagagaatctgaattattttcatgtttttggaaacaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccacctcttccgcttccttcaatgggtccgatatttaccggtgttactttctcgtctcatagctcatcgacggcttcaggaatggggtctgatgatgatgacgacgatatggacgttgatcaggctaacattgcgggttctagtagccgaaaacgcaaacgtggaaaccgcggtggaggcggtaaaatgatggaattgtttgaaggtttggtgagacaagtaatgcaaaagcaagcggctatgcaaaggagtttcttggaagctcttgagaagagagagcaagaacgtcttgatcgtgaagaagcttggaaacgtcaagaaatggctcggttagctcgagaacacgaggtcatgtctcaagaacgagccgcctctgcttctcgtgacgccgcaatcatttcattgattcagaaaattactggccataccattcagttacctccttctttgtcatctcaaccgcctccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggagcaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaaggtacaaactttgcttttccttgtcaaaatgtgattggtttaatgttctttgataactgaaatatgatttgttggaattgaagccagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaaaatcagaatcattgtttcaagaaaatgtacttatgtgtgcatagttttctaaacaaaacacccaaaaacacaaaacacaaacacacacacacacacatctgacaccacaaactgaaatatcaaggtctcatcgatcttcgatttttcagtgaatacaattctttttcacattctttcccttttgtg

SEQ ID NO: 3896 - DNA, 3159 bp, Artificial Sequence
  P325 (35S::G638)
ttcccttcactatcgataattgatcttctctttcggctgaatataaatctgaaaaaatggatcaagatcagcatcctcagtacggtataccggagctccggcagctcatgaaaggcggaggaaggacgactactacaacaccgtctacttcttctcattttccctctgatttcttcggttttaaccttgctccggtgcagccaccgccacaccgtcttcatcagttcactactgatcaagatatgggtttcttgccacgtggcatacatggattgggtggaggttcttcaacggctggaaataacagtaacttaaacgcgagtactagtggtggaggagttgggtttagtgggtttcttgacggtggtggtttcggcagcggagtaggaggagacggtggaggaactggaaggtggccgagacaagaaaccctaactctgttggaaattagatctcgtcttgatcataaattcaaagaagctaatcaaaaaggacctctttgggatgaagtttctaggtttgcttcacttctcctctctcgattttaccctaatttctctctctcatcatttttcttgtttttttaaaagcaattatataaaaaaagacactatatgcatatttctcaaatcaattcataccacaagagtttgattcattcatatataatgtctctagctagttttccttctcttttttcaagataatgtctcctagtttaaacgttgatcaataatttgaagaaaattaatgatatttgtaactaaaacactaagtcgtagcttccatcttcttaacaatttttttttcaaacgttgagtattttgttgttgttgttttggattttctttcagatttgaaaagatttgacctttcatacgctttcttgttaaaaattagacctttcaagtgaaaatcccgaagacaattttaatctttttttattcttgtattaataacaagaaagaatgtgacctcaacactcttcttgggttcctcaatttaaacttactttttcagctgatctatacagacgtatatatataaatgtgttaacattctcacgtatatacgcagacacacatattgatgtataaactatagagtggtcagtttcaaacaatttctttaggagttgttttgttttggtcaagagaatgaccagaccttggcagtttcagttaagacactatcaggtgctttaaaaacccaaaagggtaaaacataaacaagagtaaaacaaaaagatttattatcttctttgactttgatttttagttttctacttttctttttactgataacttctgattcatctttcttagcttctgaagatatgtaccctcttcttttgtgtaactgagcattgaaacatgttcttgtgataaactattagtccactagtaactaagtctcaaaaacagtcttggtccgaaagttaacaactgtatgttataagaagacaaactttatgtgtgtcactatcgaatctaatatttgcatgaaaatgaatatgaatatcttatcaattgttaatgattcaagctagtttcaagattagggcactgctccgaattcaatcaaacatgagctgatttagctactttctattcttatttcttttattattatattcttaaataggattatgtccgaggaacatggataccaaaggagtgggaagaaatgcagagagaagtttgagaatctgtacaaatactataggaagactaaagaaggcaaagccggaagacaagacggaaaacattacagatttttccggcagctcgaagcgctatacggggattctaataacttggtttcttgtcccaatcataacacgcagttcatgagcagtgctcttcatggtttccatactcaaaaccctatgaacgttactacaacaacgtccaacatccataacgttgatagtgttcatggttttcatcaaagccttagtctttctaacaactacaactcctccgagcttgagctgatgacttcctcttcggaagggaatgattctagtagtagaaggaaaaagaggagttggaaagcgaagataaaggagttcattgatacgaacatgaaaaggttgatagagaggcaagatgtttggcttgagaagttgacaaaggttattgaagacaaagaggaacaacggatgatgaaagaagaggaatggaggaagattgaagctgcaaggattgataaagagcatttgttttgggctaaagagagggcgaggatggaagctagggatgttgcggtgattgaggcattgcaatacttgacaggaaagccattgataaagccgctgtgttcatccccggaagagaggacaaatggtaataatgagatccgaaacaatagtgagacacagaatgagaatggaagcgatcaaacgatgactaacaatgtttgtgttaaaggaagtagtagctgctggggtgagcaagagattttaaagcttatggagataagaacgagcatggactcgacctttcaagagatattaggagggtgctcggatgagtttctatgggaggaaatcgcagcgaagttgattcagttagggtttgatcagagaagtgccttattatgcaaggaaaagtgggaatggataagcaatggaatgaggaaagaaaagaagcaaatcaacaagaaaagaaaggataattcgtccagctgcggcgtgtactacccgagaaacgaagaaaatccaatctacaataatcgagaaagtggatataatgataatgatccgcatcaaatcaacgaacaaggcaatgtaggttcttcaacatcaaacgcaaacgcaaacgcaaacgtaaccactggaaatccgagcggtgcaatggctgctagtacaaactgcttcccgttcttcatgggagatggagatcagaatttgtgggagagttatggtttgaggctcagtaaagaagagaatcagtaagtaatttctcttaatgaagaagaagaaggtaatcatgtggttaactaattcttttgagttagctatatatgagataaaccttgacttagctattatatgtcacatgctgcttagaattaagaaatatttgttggggcttaacgaattatatatcagcatatataagatgagagtctaagaattatatcaaattaggcttt

SEQ ID NO: 3897 - DNA, 1252 bp, Artificial Sequence
  P334 (35S::G670)
cacagcattgcagctgtgaataactaaatggggagacattcttgctgttacaaacaaaagctgaggaaagggctttggtctcctgaagaagacgagaagcttcttactcacatcaccaatcacggccatggctgctggagctctgtccctaaactcgctggtttgcagagatgtgggaagagttgtcgactcgagcagatctggtaccgccgactaagatggatcaattacttgagacctgatttaaagagaggagctttttctcctgaagaagagaatctcatcgtcgaacttcatgccgtccttggaaacagatggtcacagattgcgtcaaggcttccgggtagaaccgacaacgagatcaagaatctatggaactcaagcatcaagaagaaactgaaacaaagaggcattgacccaaacacacacaagcccatctctgaagtggagagttttagcgacaaagacaaaccaacaacaagcaacaacaaaagaagcggtaacgatcacaagtctcctagttcctcttctgcgactaaccaagacttcttcctcgaaaggccatctgatttatccgactacttcggatttcagaagcttaacttcaactccaatctaggactctctgttacaactgattcttcactctgctcgatgattccgccgcagtttagccccgggaacatggttggttctgtccttcagacaccagtatgcgtaaagccctcgattagtcttcctcccgacaacaacagttcgagtcctatctccggaggagatcatgtgaaattggctgcaccaaactgggaatttcagacaaacaacaataatacctcaaatttcttcgacaatggcggattctcatggtctatcccaaattcttctacttcttcttcacaagtcaaaccaaatcataacttcgaagaaataaaatggtcagagtatttgaacacaccgttcttcatagggagtactgtacagagtcaaacctctcaaccaatctacatcaaatcagaaacagattacttagccaatgtttcaaacatgacagatccttggagccaaaacgagaacttgggcacaactgaaactagtgacgtgttctccaaggatcttcagagaatggccgtctcttttggtcagtccctttagcttttttctttctttctttcttatttctaacagatgtagagaacataaagatatacaaatacatacaatgtcaatacgtacagtggatttaagtgttctg

SEQ ID NO: 3898 - DNA, 1973 bp, Artificial Sequence
  P336 (35S::G680)
atagctgcaaccggtcctgttatggatactaatacatctggagaagaattattagctaaggcaagaaagccatatacaataacaaagcagcgagagcgatggactgaggatgagcatgagaggtttctagaagccttgaggctttatggaagagcttggcaacgaattgaagaacatattgggacaaagactgctgttcagatcagaagtcatgcacaaaagttcttcacaaagttggagaaagaggctgaagttaaaggcatccctgtttgccaagctttggacatagaaattccgcctcctcgtcctaaacgaaaacccaatactccttatcctcgaaaacctgggaacaacggtacatcttcctctcaagtatcatcagcaaaagatgcaaaacttgtttcatcggcctcttcttcacagttgaatcaggcgttcttggatttggaaaaaatgccgttctctgagaaaacatcaactggaaaagaaaatcaagatgagaattgctcgggtgtttctactgtgaacaagtatcccttaccaacgaaacaggtaagtggcgacattgaaacaagtaagacctcaactgtggacaacgcggttcaagatgttcccaagaagaacaaagacaaagatggtaacgatggtactactgtgcacagcatgcaaaactacccttggcatttccacgcagatattgtgaacgggaatatagcaaaatgccctcaaaatcatccctcaggtatggtatctcaagacttcatgtttcatcctatgagagaagaaactcacgggcacgcaaatcttcaagctacaacagcatctgctactactacagcttctcatcaagcgtttccagcttgtcattcacaggatgattaccgttcgtttctccagatatcatctactttctccaatcttattatgtcaactctcctacagaatcctgcagctcatgctgcagctacattcgctgcttcggtctggccttatgcgagtgtcgggaattctggtgattcatcaaccccaatgagctcttctcctccaagtataactgccattgccgctgctacagtagctgctgcaactgcttggtgggcttctcatggacttcttcctgtatgcgctccagctccaataacatgtgttccattctcaactgttgcagttccaactccagcaatgactgaaatggataccgttgaaaatactcaaccgtttgagaaacaaaacacagctctgcaagatcaaaccttggcttcgaaatctccagcttcatcatctgatgattcagatgagactggagtaaccaagctaaatgccgactcaaaaaccaatgatgataaaattgaggaggttgttgttactgccgctgtgcatgactcaaacactgcccagaagaaaaatcttgtggaccgctcatcgtgtggctcaaatacaccttcagggagtgacgcagaaactgatgcattagataaaatggagaaagataaagaggatgtgaaggagacagatgagaatcagccagatgttattgagttaaataaccgtaagattaaaatgagagacaacaacagcaacaacaatgcaactactgattcgtggaaggaagtctccgaagagggtcgtatagcgtttcaggctctctttgcaagagaaagattgcctcaaagcttttcgcctcctcaagtggcagagaatgtgaatagaaaacaaagtgacacgtcaatgccattggctcctaatttcaaaagccaggattcttgtgctgcagaccaagaaggagtagtaatgatcggtgttggaacatgcaagagtcttaaaacgagacagacaggatttaagccatacaagagatgttcaatggaagtgaaagagagccaagttgggaacataaacaatcaaagtgatgaaaaagtctgcaaaaggcttcgattggaaggagaagcttctacatgacagacttggaggta

SEQ ID NO: 3899 - DNA, 1530 bp, Artificial Sequence; identical to SEQ ID NO: 557
  P341 (35S::G718)

SEQ ID NO: 3900 - DNA, 513 bp, Artificial Sequence; identical to SEQ ID NO: 571
  P344 (35S::G736)

SEQ ID NO: 3901 - DNA, 1212 bp, Artificial Sequence; identical to SEQ ID NO: 575
  P345 (35S::G740)

SEQ ID NO: 3902 - DNA, 1606 bp, Artificial Sequence
  P346 (35S::G748)
agaagacggaacagaggctccaaaaaaatgatgatggagactagagatccagctattaagcttttcggtatgaaaatcccttttccgtcggtttttgaatcggcagttacggtggaggatgacgaagaagatgactggagcggcggagatgacaaatcaccagagaaggtaactccagagttatcagataagaacaacaacaactgtaacgacaacagttttaacaattcgaaacccgaaaccttggacaaagaggaagcgacatcaactgatcagatagagagtagtgacacgcctgaggataatcagcagacgacacctgatggtaaaaccctaaagaaaccgactaagattctaccgtgtccgagatgcaaaagcatggagaccaagttctgttattacaacaactacaacataaaccagcctcgtcatttctgcaaggcttgtcagagatattggactgctggagggactatgaggaatgttcctgtgggggcaggacgtcgtaagaacaaaagctcatcttctcattaccgtcacatcactatttccgaggctcttgaggctgcgaggcttgacccgggcttacaggcaaacacaagggtcttgagttttggtctcgaagctcagcagcagcacgttgctgctcccatgacacctgttatgaagctacaagaagatcaaaaggtctcaaacggtgctaggaacaggtttcacgggttagcggatcaacggcttgtagctcgggtagagaatggagatgattgctcaagcggatcctctgtgaccacctctaacaatcactcagtggatgaatcaagagcacaaagcggcagtgttgttgaagcacaaatgaacaacaacaacaacaataacatgaatggttatgcttgcatcccaggtgttccatggccttacacgtggaatccagcgatgcctccaccaggtttttacccgcctccagggtatccaatgccgttttacccttactggaccatcccaatgctaccaccgcatcaatcctcatcgcctataagccaaaagtgttcaaatacaaactctccgactctcggaaagcatccgagagatgaaggatcatcgaaaaaggacaatgagacagagcgaaaacagaaggccgggtgcgttctggtcccgaaaacgttgagaatagatgatcctaacgaagcagcaaagagctcgatatggacaacattgggaatcaagaacgaggcgatgtgcaaagccggtggtatgttcaaagggtttgatcataagacaaagatgtataacaacgacaaagctgagaactcccctgttctttctgctaaccctgctgctctatcaagatcacacaatttccatgaacagatttagagttacatatgtatatgtatatatgtatgattgattgtatgtatagatgatactggagaatgatgagtttttgagaatcaaactcttttcttctttctagtgattgcctttattcctttacatgttttggttctctgtacactatttgatttaccttttttactttctttcttcatttgtcaggaaatgttggaagataacattaatggtaaaaagttggtgtggaccgttg

SEQ ID NO: 3903 - DNA, 1069 bp, Artificial Sequence
  P352 (35S::G773)
aagtgcagatattttctttgtcctagagaaagaggtgataggaaaaatgggtctccaagagcttgacccgttagcccaattgagcttaccgccgggttttcggttttatccgactgacgaagagctgatggttgaatatctctgtagaaaagccgccggtcacgacttctctctccagctcatagctgaaatcgatctctacaagtttgatccatgggttttaccaagtaaggcgttattcggtgaaaaagaatggtattttttcagcccgagggataggaagtatccaaacgggtcaagacctaatcgggttgccgggtcgggttattggaaagccaccggtacggataaagttatctcgacggagggaagaagagttggtatcaagaaagctttggtgttttacattggaaaagctccaaaaggaaccaaaaccaattggattatgcatgagtaccgtctcatcgaaccctctcgtcgaaatggaagcaccaagcttgatgattgggttttatgtcgaatatacaaaaagcaaacaagcgcacaaaaacaagcttacaataatctaatgacgagtggtcgtgaatacagcaacaatggttcgtcgacatcttcttcgtctcatcaatacgacgacgttctcgagtcgttgcatgagattgacaacagaagtttggggtttgccgccggttcatcaaacgcgctgcctcatagtcatagaccggttttaaccaatcataaaaccgggtttcagggtttagccagggagccaagttttgattgggcgaatttgattggacagaactcggtcccggaactcggactgagtcataacgttccgagtattcgttacggtgacggtggaacgcagcaacaaactgaggggattcctcggtttaataataactcggacgtctcggctaatcagggttttagtgttgacccggttaacggatttgggtactcgggtcaacaatctagtgggttcgggtttatttgattgtgtaatggtaacgtaataagaaaaacatatttttattttttgtccgtgtcagattagttaattaat

SEQ ID NO: 3904 - DNA, 1640 bp, Artificial Sequence; identical to SEQ ID NO: 589
  P354 (35S::G776)

SEQ ID NO: 3905 - DNA, 1057 bp, Artificial Sequence; identical to SEQ ID NO: 591
  P356 (35S::G777)

SEQ ID NO: 3906 - DNA, 1389 bp, Artificial Sequence; identical to SEQ ID NO: 593
  P357 (35S::G778)

SEQ ID NO: 3907 - DNA, 1201 bp, Artificial Sequence
  P359 (35S::G784)
ctcggacaaagctgaaatccctaaagaaaaaacacttctccaaacttttcatctccgatatctctttaactaacatgtcgaataatcaagctttcatggaattgggatggagaaacgacgtcggatcacttgctgtgaaagatcagggcatgatgtcagaaagagcaagaagtgatgaagatcgtctaatcaacggtctaaaatggggctacggctactttgatcatgatcaaactgataattatcttcagattgttccagagattcataaagaagtagaaaatgcgaaggaggatttattggttgttgtccctgatgaacattctgaaactgatgatcatcatcatattaaagatttttcagagagatcagatcatcgattttatctgagaaacaaacatgagaaccccaaaaaacgtcgtatccaggtcttaagtagtgatgatgaatcggaggagtttacaagagaagttccttcagttactcgaaaaggttccaagagaagaagaagagacgagaagatgagtaataagatgcgtaagctacagcaactcgtacctaattgtcacaagacggacaaggtttcggttctcgacaagaccatagagtatatgaaaaaccttcaacttcaacttcagatgatgtcaacagtgggggtgaatccttattttcttccggcgacattaggatttggaatgcacaaccacatgctgacggcaatggcttcggctcacggcctaaatccggcgaatcacatgatgccatcgccgctaattccggcgttaaattggccattaccaccgtttactaatatttcattcccacattcatctagtcaatctctatttcttacaacatcatcaccagcttcttctcctcagtctcttcacggtttggttccttatttcccaagtttcttggatttttcttcccatgcgatgagaagactatgataagtaagtagctcgataaaagtttatgtgaaatgatcgttgactaattaagagagaaaagagttccaaattaggacagtttgtgtgaaccatttgtgtcatatacttttttttccgggtggttttgtatattaataataatcaataagttaaaactttttgtataaattcttgcatgtaacaatttttttcatttatctgatattttgtaaaatatattgagacatgcttataagagcaaaaaaaaa

SEQ ID NO: 3908 - DNA, 1107 bp, Artificial Sequence; identical to SEQ ID NO: 603
  P363 (35S::G791)

SEQ ID NO: 3909 - DNA, 1009 bp, Artificial Sequence; identical to SEQ ID NO: 609
  P366 (35S::G801)

SEQ ID NO: 3910 - DNA, 1604 bp, Artificial Sequence; identical to SEQ ID NO: 611
  P367 (35S::G802)

SEQ ID NO: 3911 - DNA, 1231 bp, Artificial Sequence; identical to SEQ ID NO: 613
  P370 (35S::G805)

SEQ ID NO: 3912 - DNA, 1134 bp, Artificial Sequence; identical to SEQ ID NO: 641
  P379 (35S::G861)

SEQ ID NO: 3913 - DNA, 1149 bp, Artificial Sequence
  P380 (35S::G864)
ttataaacacacagagagaaacaaagtcacagtctcgagtcaaaaacagagaatacgaaagaaaaatggaagcggagaagaaaatggttctaccgagaatcaaattcacagagcacaaaaccaacacgacaacaatcgtatcggagttaaccaacactcaccaaaccaggattcttcgtatctcagtcactgacccagacgctactgattcctccagtgacgacgaagaagaagaacatcaacgctttgtctctaaacgccgtcgtgttaagaagtttgtcaacgaagtctatctcgattccggtgctgttgttactggtagttgtggtcaaatggagtcgaagaagagacaaaagagagcggttaaatcggagtctactgtttctccggttgtttcagcgacgacgactacgacgggagagaagaagttccgaggagtgagacagcgtccatggggaaaatgggcggcggagataagagatccgttgaaacgtgtacggctctggttaggtacttacaacacggcggaagaagctgctatggtttacgataacgccgctattcagcttcgtggtcccgacgctctgactaatttctcagtcactccgacaacagcgacggagaagaaagccccaccaccgtctccggtgaagaagaagaagaagaaaaacaacaaaagcaaaaaatccgttactgcttcttcctccatcagcagaagcagcagcaacgattgtctctgctctccggtgtctgttctccgatctcctttcgccgtcgacgaattctccggcatttcttcatcaccagtcgcggccgttgtagtcaaggaagagccatccatgacaacggtatctgaaactttctctgatttctcggcgcccttgttctcagatgatgacgtgttcgatttccggagctcagtggttcccgactatctcggcggcgatttatttggggaagatctattcacggcggatatgtgtacggatatgaacttcggattcgatttcggatccggattatccagctggcacatggaggaccattttcaagatatcggggatctattcgggtcggatcctcttttagctgtttaataatattttaaataaataaatagttataccggccgttactaaacggaaccgg

SEQ ID NO: 3914 - DNA, 1126 bp, Artificial Sequence; identical to SEQ ID NO: 645
  P381 (35S::G865)

SEQ ID NO: 3915 - DNA, 1198 bp, Artificial Sequence; identical to SEQ ID NO: 647
  P382 (35S::G866)

SEQ ID NO: 3916 - DNA, 1281 bp, Artificial Sequence; identical to SEQ ID NO: 15
  P383 (35S::G867)

SEQ ID NO: 3917 - DNA, 1201 bp, Artificial Sequence
  P384 (35S::G869)
cgcttaagacccaaaaggacttgttctagtgttgaagtctttgggggttttcacataaagcagcaaaagttttcttttttcatagttcgctgagagttttgagttttgataccaaaaaagttttgaccttttagagtgattttttgttctttctgttttctgggtatttttgaggagtgggtttaacaatggttgcgattagaaaggaacagtctttgagtggtgttagtagcgagattaagaagagagctaagagaaacactctatcgtcccttcctcaagaaacccaacctttgaggaaagtccgtattattgtgaatgatccttatgctactgatgattcctctagtgatgaggaagagcttaaggttcctaagccaaggaaaatgaaacgtatcgttcgtgagattaactttccttctatggaagtttctgaacagccttctgagagttcttctcaggacagtactaaaactgatggcaagatagctgtgtcagcttctcctgctgttcctaggaagaagcctgttggtgttaggcaaaggaaatgggggaaatgggctgctgagattagagatcctattaagaaaactaggacttggttgggtacttttgatactcttgaagaagctgctaaagcttatgatgctaagaagcttgagtttgatgctattgttgctggaaatgtgtccactactaaacgtgatgtttcttcatctgagactagccaatgctctcgttcttcacctgttgttcctgttgagcaagatgacacttctgcatcagctctcacttgtgtcaacaaccctgatgacgtctcgaccgttgctccaactgctccaactccaaatgttcctgctggtggaaacaaggaaacgttgttcgatttcgactttactaatctacagatccctgattttggtttcttggcagaggagcaacaagacctagacttcgattgtttcctcgcggatgatcagtttgatgatttcggcttgcttgatgacattcaaggattcgaagataacggtccaagtgcgttaccagatttcgactttgcggatgttgaagatcttcagctagctgactctagtttcggtttccttgatcaacttgctcctatcaacatctcttgcccattaaaaagttttgcagcttcataggatcttgcttagtaatgttaagtgagaagagtgttttg

SEQ ID NO: 3918 - DNA, 675 bp, Artificial Sequence
  P385 (35S::G872)
ccggaaacagaatccaattcaaccaaaccgaatcgaaccgaaccggagtttttatccaatggtgaagcaagcgatgaaggaagaggagaagaagagaaacacggcgatgcagtcaaagtacaaaggagtgaggaagaggaaatggggaaaatgggtatcggagatcagacttccacacagcagagaacgaatttggttaggctcttacgacactcccgagaaggcggcgcgtgctttcgacgccgctcaattttgtctccgcggcggcgatgctaatttcaatttccctaataatccaccgtcgatctccgtagaaaagtcgttgacgcctccggagattcaggaagctgctgctagattcgctaacacattccaagacattgtcaagggagaagaagaatcgggtttagtacccggatccgagatccgaccagagtctccttctacatctgcatctgttgctacatcgacggtggattatgatttttcgtttttggatttgcttccgatgaatttcgggtttgattccttctccgacgacttctctggcttctccggtggtgatcgatttacagagattttacccatcgaagattacggaggagagagtttattagatgaatctttgattctttgggatttttgaattcccaaacataatatttttttagagcg

SEQ ID NO: 3919 - DNA, 1152 bp, Artificial Sequence; identical to SEQ ID NO: 657
  P388 (35S::G881)

SEQ ID NO: 3920 - DNA, 1195 bp, Artificial Sequence; identical to SEQ ID NO: 659
  P389 (35S::G883)

SEQ ID NO: 3921 - DNA, 724 bp, Artificial Sequence
  P393 (35S::G912)
catcttatccaaagaaaaaatgaatccattttactctacattcccagactcgtttctctcaatctccgatcatagatctccggtttcagacagtagtgagtgttcaccaaagttagcttcaagttgtccaaagaaacgagctgggaggaagaagtttcgtgagacacgtcatccgatttacagaggagttcgtcagaggaattctggtaaatgggtttgtgaagttagagagcctaataagaaatctaggatttggttaggtacttttccgacggttgaaatggctgctcgtgctcatgatgttgctgctttagctcttcgtggtcgctctgcttgtctcaatttcgctggttctgcttggcggcttcgtattcctgagactacttgtcctaaggagattcagaaagctgcgtctgaagctgcaatggcgtttcagaatgagactacgacggagggatctaaaactgcggcggaggcagaggaggcggcaggggagggggtgagggagggggagaggagggcggaggagcagaatggtggtgtgttttatatggatgatgaggcgcttttggggatgcccaacttttttgagaatatggcggaggggatgcttttgccgccgccggaagttggctggaatcataacgactttgacggagtgggtgacgtgtcactctggagttttgacgagtaattttttggctctttttctggataataagtt

SEQ ID NO: 3922 - DNA, 1057 bp, Artificial Sequence
  P396 (35S::G921)
ccaagatcgactcttacttcgaatctctctcaactttcttcctcagcttacgggaacttccacacatatacatccacaagaacccatatcgaagattcatcctacatatatttacatggatcagtactcatcctctttggtcgatacttcattagatctcactattggcgttactcgtatgcgagttgaagaagatccaccgacaagtgctttggtggaagaattaaaccgagttagtgctgagaacaagaagctctcggagatgctaactttgatgtgtgacaactacaacgtcttgaggaagcaacttatggaatatgttaacaagagcaacataaccgagagggatcaaatcagccctcccaagaaacgcaaatccccggcgagagaggacgcattcagctgcgcggttattggcggagtgtcggagagtagctcaacggatcaagatgagtatttgtgtaagaagcagagagaagagactgtcgtgaaggagaaagtctcaagggtctattacaagaccgaagcttctgacactaccctcgttgtgaaagatgggtatcaatggaggaaatatggacagaaagtgactagagacaatccatctccaagagcttacttcaaatgtgcttgtgctccaagctgttctgtcaaaaagaaggttcagagaagtgtggaggatcagtccgtgttagttgcaacttatgagggtgaacacaaccatccaatgccatcgcagatcgattcaaacaatggcttaaaccgccacatctctcatggtggttcagcttcaacacccgttgcagcaaacagaagaagtagcttgactgtgccggtgactaccgtagatatgattgaatcgaagaaagtgacgagcccaacgtcaagaatcgattttccccaagttcagaaacttttggtggagcaaatggcttcttccttaaccaaagatcctaactttacagcagctttagcagcagctgttaccggaaaattgtatcaacagaatcataccgagaaatagtttagcttcaaattccgttagagtttttagatt

SEQ ID NO: 3923 - DNA, 1388 bp, Artificial Sequence
  P398 (35S::G926)
ccaaaatctagggttttcttctcgcccaatttcacttttcttctacgaaattctccattcctgccggctgtcgggttttctgaatcgattctccttcaccaacttcttctctggttctgttcgattctgattttttttcaaggtcaattttttcttctctttaaactctgcaaaatcgtgatcgattaaattcacctcagggttttttgatttctgaaagaagttaatcttcttcgaaggcgattgcaaaagagtgctctgctgtgaatttccactgagatgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcaccataataaaaaaagccaaagctctgagaggagagagagacacacactttggctaatataatccattgcctcaaaccggcaaatcattcttggctttttcgtttttgtgtttgctagttgttcttgtcagagtctcatattgtgtgggtttaacagttatgatgaatgtacaaagagcgagttatgttaggtgttagattttggagacaagagacaaaggaatagcaagtaggtcttgtttttattctttgaccttttttttctcttttgcaaaattgaaaaatacgtttgcttaaaaa

SEQ ID NO: 3924 - DNA, 953 bp, Artificial Sequence; identical to SEQ ID NO: 697
  P399 (35S::G929)

SEQ ID NO: 3925 - DNA, 1491 bp, Artificial Sequence
  P400 (35S::G932)
ccacttgtacctctttgtcttaagtactctttaaccctacaatttcctaagctctcaagccacaaaaaaccacaaaccgttcttcaccaatatatatatctgatcatcatcaaagtccttctctctgctcataccacaaaccgttccattcttcccctaatcacaaagtgatatttacatagagaagatagagatgggaagaccaccatgctgtgacaagattggagtgaagaaaggaccatggacaccagaggaagatatcatcttggtttcttacatccaagaacatggtcctggaaactggagatctgtgcctactcacacaggtttgaggagatgtagcaaaagctgtagattgaggtggactaattatcttcgacctgggatcaagcgtggaaatttcaccgagcatgaagagaagatgattctccatcttcaagctcttttgggaaacaggtgggcagctatagcatcatatcttccagaaaggacagacaatgatataaagaactattggaacactcatttgaagaaaaagctcaagaagatgaatgattcttgtgatagtactatcaacaatggccttgataataaagacttctccatatcaaacaaaaacactacctcacatcaaagcagcaactccagtaaaggtcaatgggagagaaggcttcagacagatatcaacatggctaaacaagctctttgtgatgccttgtctattgacaaaccacaaaacccaactaatttttctattcccgatcttggttatggtccatcatcttcttcgtcctctaccaccaccaccaccaccaccaccaccacgagaaacactaatccatacccatctggggtctatgcttcaagtgctgagaacattgctcgtttgcttcagaattttatgaaagacacaccaaagacctcggtgcccttgccggttgcagccaccgagatggctatcaccacggcagcttcgagccctagcacaaccgaaggagacggagaagggattgaccattctttgttcagcttcaactccatagatgaagctgaagagaagcctaaactaatagaccatgacattaatggtctaattacacaaggctctctttctttgttcgagaaatggctctttgatgagcaaagccacgatatgatcatcaataacatgtcactagagggtcaggaagtgttgttctagaaagcattaaagtttgacgatttgcttgaggaaccacgaggcttagttataaacaatttgtataattaagtactctttagttttgttttcaatccttattatgatcatattgcagtaattagggattttagtctttagtagtaactcttaagttttaacacatttttctctatctttttagtagtaactctttattttttccttaaatctttgtcgacgtggagatgatatcttctatgtagtagaaactcaaaagtgtacatcatctttattaatgtaacgtcttttta

SEQ ID NO: 3926 - DNA, 1755 bp, Artificial Sequence; identical to SEQ ID NO: 705
  P401 (35S::G938)

SEQ ID NO: 3927 - DNA, 1592 bp, Artificial Sequence
  P402 (35S::G939)
cagattctatggatatgtataacaacaatatagggatgttccggagtttagtttgtagctcggcgcctccatttacagagggacatatgtgttctgattcgcatacggctttgtgcgatgatctgagtagtgatgaggaaatggaaatagaggagcttgagaagaagatctggagagacaagcagcgtttaaagcggctcaaggaaatggcgaagaacggtctaggaacaagattgttgttgaagcagcaacatgatgattttccagagcactctagtaagagaaccatgtacaaggcacaagatgggatcttgaagtacatgtcgaagacaatggagcgatataaagctcaaggttttgtttatgggattgtgttagagaatgggaaaacggtagcgggatcttctgataatctccgtgaatggtggaaagacaaagtgaggtttgataggaacggcccagctgctataatcaagcaccaaagggatatcaatctttctgatggaagtgattcagggtctgaggttggggattctaccgcacagaagttgcttgagcttcaagatactactcttggagctctgttatcggctctgtttcctcactgcaaccctcctcagaggcggtttccgttggagaaaggcgtgacaccgccatggtggccaacggggaaagaagattggtgggatcaactgtctttacccgttgattttcgaggtgttccgccaccttacaagaagcctcatgatctcaagaagctgtggaaaattggtgttttgattggtgtaatcagacatatggcttctgacattagcaacatacccaatctcgtgagacggtctagaagtttgcaggagaaaatgacgtcaagagaaggcgctttatggctcgctgctctttaccgagaaaaggctattgttgatcaaatagccatgtctagagaaaacaacaacacttctaactttcttgttcctgcaaccggtggagacccagatgttttgtttcctgaatctacagactatgatgttgaactgattggtggcactcatcggaccaatcagcagtatcctgaatttgaaaacaactacaactgtgtttacaagagaaagtttgaagaagattttgggatgccaatgcatccaacactcctaacatgtgagaacagtctctgtccttatagccaaccacatatgggatttcttgacaggaacttaagagagaatcaccaaatgacttgtccttataaagtcacttccttctaccaaccaactaaaccctatggtatgacgggtttaatggttccttgtccggattataacgggatgcagcagcaggttcagagctttcaagaccagtttaatcatcccaacgatctctacagaccaaaagctccacaaagaggcaacgatgacttggttgaggatttgaatccttctccttcgacgctgaatcagaatcttggtttagtcttacctactgacttcaatggaggtgaggaaacagtaggaacagagaacaatctgcataatcaagggcaagagttgcccacatcttggattcagtaaagaaagcttcagagttttctttttatg

SEQ ID NO: 3928 - DNA, 1983 bp, Artificial Sequence; identical to SEQ ID NO: 723
  P405 (35S::G965)

SEQ ID NO: 3929 - DNA, 686 bp, Artificial Sequence
  P408 (35S::G975)
attactcatcatcaagttcctactttctctctgacaaacatcacagagtaagtaagaatggtacagacgaagaagttcagaggtgtcaggcaacgccattggggttcttgggtcgctgagattcgtcatcctctcttgaaacggaggatttggctagggacgttcgagaccgcagaggaggcagcaagagcatacgacgaggccgccgttttaatgagcggccgcaacgccaaaaccaactttcccctcaacaacaacaacaccggagaaacttccgagggcaaaaccgatatttcagcttcgtccacaatgtcatcctcaacatcatcttcatcgctctcttccatcctcagcgccaaactgaggaaatgctgcaagtctccttccccatccctcacctgcctccgtcttgacacagccagctcccatatcggcgtctggcagaaacgggccggttcaaagtctgactccagctgggtcatgacggtggagctaggtcccgcaagctcctcccaagagactactagtaaagcttcacaagacgctattcttgctccgaccactgaagttgaaattggtggcagcagagaagaagtattggatgaggaagaaaaggttgctttgcaaatgatagaggagcttctcaatacaaactaaatcttatttgcttatatatatgtacctat

SEQ ID NO: 3930 - DNA, 838 bp, Artificial Sequence
  P409 (35S::G976)
cttatatataacaaataaacacataagttgacatatatactatatacaagtatattaattatacatatatggctgaccctaacaatcctatcactgaacctaaagctataatccaatcttctacttcatcgtcagttactattgtgccagttcccacgtgcggtgacagcctctctgactctgccacgtgtgaaaacccttgtccacttgatactatcactactactactactactgtttgttttgcggctccttcttctactgcaagtggtaatgatattaatactttaatggccactgacaccgacatctctcgccggaaaaagaatccggtttatcggggaattcgttgtcggagtggaaaatgggtgtctgaaatccgagagcctaaaaagactacacgtgtctggcttgggacttatccgacgccggagatggctgctgccgcatatgacgtggcggcgttagctcttaaaggtggagacactctcttgaacttcccggattccctgggatcttaccccattcccctttcctcttccgcagctcatatcagatgcgctgcagctgcggctgctgcgactaggggtgcggctggagcggccgtgaaggtaggtcaaaagaaggaagataaagtttatgatacggcggaatcttcaactatggggtttgtggatgaagaagagctattgaacatgcctggtttgctagcggatatggccaaagggatgatggtggctccaccgtggatgggatctccaccgtcagatgattcgccagagaattctgatggagagagcttgtggagctattgatcgattgaaagcagtttaatatc

SEQ ID NO: 3931 - DNA, 913 bp, Artificial Sequence; identical to SEQ ID NO: 751
  P417 (35S::G1006)

SEQ ID NO: 3932 - DNA, 813 bp, Artificial Sequence; identical to SEQ ID NO: 763
  P424 (35S::G1020)

SEQ ID NO: 3933 - DNA, 1236 bp, Artificial Sequence
  P426 (35S::G1023)
cttgttctggggtaaaggacttttcttgttcttgagagagttcattttgaggcttttctgggaattttgagaggttttttagggtttaagggggtttggttttgaatttcgcacaccaagtgttcgataaaatggctgaacgaaagaaacgctcttctattcaaaccaataaacccaacaaaaaacccatgaagaagaaaccttttcagctaaatcacctcccaggtttatctgaagatttgaagactatgagaaaactccgtttcgttgtgaatgatccttacgctactgactactcatcaagcgaagaagaagaaaggagtcagagaaggaaacgttatgtctgtgagatcgatcttcctttcgctcaagctgctactcaagcagaatctgaaagctcatattgtcaggagagtaacaataatggtgtaagcaagactaaaatctcagcttgtagcaaaaaggttttacgcagcaaagcatctccggtcgttggacgttcttctactactgtctcgaagcctgttggtgttaggcagaggaaatggggtaaatgggctgctgagattagacatccaatcaccaaagtaagaacttggttgggtacttacgagacgcttgaacaagcagctgatgcttatgctaccaagaagcttgagtttgatgctctggctgcagccacttctgctgcttcctctgttttgtcaaatgagtctggttctatgatctcagcctcagggtcaagcattgatcttgacaagaagctagttgattcgactcttgatcaacaagctggtgaatcgaagaaagcgagttttgatttcgactttgcagatctacagattcctgaaatgggttgcttcattgatgactcattcatcccaaatgcttgtgagcttgattttctcttaacagaagagaacaacaaccaaatgttggatgattactgtggcatagatgatctggacatcattggtcttgaatgtgacggtccaagcgaacttccagactatgatttctcagatgtggagatcgatcttggtctcattggaaccaccattgacaagtatgctttcgttgatcatatcgcaacaactactcccactcctcttaatatcgcgtgcccataagttttgcagctaggtgttattattagctataggagcaacgtaaaaagctcgttgttactcggttttgtcttaagttattaaagtatagcagaggcagttaatctca

SEQ ID NO: 3934 - DNA, 1057 bp, Artificial Sequence; identical to SEQ ID NO: 773
  P432 (35S::G1040)

SEQ ID NO: 3935 - DNA, 1606 bp, Artificial Sequence; identical to SEQ ID NO: 799
  P444 (35S::G1068)

SEQ ID NO: 3936 - DNA, 965 bp, Artificial Sequence
  P448 (35S::G1073)
ctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 3937 - DNA, 1084 bp, Artificial Sequence
  P450 (35S::G1075)
tttgtgtttggtgttggcatggctggtctcgatctaggcacaacttctcgctacgtccacaacgtcgatggtggcggcggcggacagttcaccaccgacaaccaccacgaagatgacggtggcgctggaggaaaccaccatcatcaccatcataatcataatcaccatcaaggtttagatttaatagcttctaatgataactctggactaggcggcggtggaggaggagggagcggtgacctcgtcatgcgtcggccacgtggccgtccagctggatcgaagaacaaaccgaagccgccggtgattgtcacgcgcgagagcgcaaacactcttagggctcacattcttgaagttggaagtggctgcgacgttttcgaatgtatctccacttacgctcgtcggagacagcgcgggatttgcgttttatccgggacgggaaccgtcactaacgtcagcatccgtcagcctacggcggccggagctgttgtgactctgcggggtacttttgagattctttccctctccggatcttttcttccgccacctgctcctccaggggcgactagcttgacgatattcctcgctggagctcaaggacaggtcgtcggaggtaacgtagttggtgagttaatggcggcggggccggtaatggtcatggcagcgtcttttacaaacgtggcttacgaaaggttgcctttggacgagcatgaggagcacttgcaaagtggcggcggcggaggtggagggaatatgtactcggaagccactggcggtggcggagggttgcctttctttaatttgccgatgagtatgcctcagattggagttgaaagttggcaggggaatcacgccggcgccggtagggctccgttttagcaatttaagaaactttaattgttttttccacttttttgtttttctccgaattttatgaaattatgatttaagaaaaaaaacgatattgttcatgtattgaccctcttactgcatggtttcttctattgggttaattgactagctcataagaattgtttaatttggttattgtcatcaaatttgcccacatataaagcttctagcaaat

SEQ ID NO: 3938 - DNA, 1342 bp, Artificial Sequence; identical to SEQ ID NO: 805
  P452 (35S::G1076)

SEQ ID NO: 3939 - DNA, 2652 bp, Artificial Sequence
  P453 (35S::G1079)
cgatttcgatttgagtttgttaagtgataagagtctgaagaaatgggttgtgctgcttcaagaattgataatgaagaaaaggttttagtgtgtaggcagagaaagaggctaatgaaaaagttattagggttcaggggagaatttgcagatgcacagttggcttatcttagagctttgaggaacactggtgttactcttaggcaattcactgagtctgagaccttggagcttgaaaacactagttatggtttaagtttgcctttgcctccttcgcctcctcctacattgcctccttcacctccaccacctcctccatttagcccggatttgagaaatcctgagactagtcatgacttggctgatgaggaggaagagggtgaaaatgatggtggtaatgatggaagtggtgcagctcctccgcctccattgccgaattcttggaacatttggaacccttttgagtcacttgagctgcatagtcatccaaatggtgacaatgtagttacacaagttgaactgaagaagaaacaacaaattcagcaagctgaagaggaagattgggcggagacgaagtctcaatttgaggaagaagatgagcaacaagaagcaggaggtacttgccttgatttgagtgttcatcaaatagaggctgttagtggctgtaacatgaagaagccacgtcgtctgaagtttaagctgggagaagttatggacggtaactcatctatgacaagctgctccggtaaagatcttgagaaaactcatgtgactgattgtagaatcaggaggaccttagaaggaatcatcagagagttggatgattattttcttaaagcatcgggttgcgagaaggagatagctgtgatagtagacatcaacagtagggatactgttgatcctttcaggtaccaggaaacaagaagtaagtgactgactgagatttttaatcttttttgatgttggaccaactacagattttgatttgtgttcataagcataaacaatttgttgtacatattataatacttatgtggctcgcagggaagagaagcagctcggcaaaggtattcagtgcattgtcatggagttggtcttcaaagtctcttcagttgggcaaagatgctacaacaagcgggactgttgaaccctgtaggcctggagctcactgcagcacacttgagaagctatacacagctgagaagaaactttaccagctagtcagagtaagagctagctgatctaactctttcggtgttagattatcaagttcaacaatgaaatactaagttttattctctgaccagaacaaagagattgccaaagtggagcatgagaggaagtctgcattactgcaaaagcaagatggggaaacctatgatttgagcaaaatggagaaagcacgcttgtctttggagagtttggaaaccgagatacagcgtctagaagattccataactacaacacgctcatgtttgcttaacttgatcaatgatgagctgtatccgcagctagttgctttaacttcagggtaaactccacaaccactcttatgctgaccatctcattgaaaagcattttttttatgcgatttgcatatgtcgcttctcaagattgatttggtcttaatatgtgcaggctagcacagatgtggaaaacaatgctcaagtgtcatcaagttcaaattcatatatcccagcaactgaaccatcttccggattacccgagtatagatctcagttcggaatacaaacgccaggcggttaatgaactagagaccgaggttacttgctggtacaatagcttttgcaagttagtaaattcccagcgagaatacgtgaaaacactctgtacgtggatccaacttactgatcgcctctctaacgaagacaaccaaagaagtagcttgcctgttgctgctcgtaagctctgcaaagagtggcagcttgtatttgaaaagcttcctgataaggttcttctatcacttgcagcttatttgtattattctagttcatggctctatgaaagccatctttaatacgtgcaaatgcaactgttttgggtggcgtaggtaacttcagaggccattaaaagctttctgatgtcaattaaatctattattcatcaacaagctgaggaatacaacctgcgtaggaaatgcaataaacttgagaggaggcttgagaaagagctaatttcactggctgagattgaaagaaggctcgaggggattttagcaatggaagaggaggaagtaagctcaacgagtttgggctctaagcatccgttgtcaatcaaacaagccaagatcgaagccttgagaaaacgagtggatattgagaaaactaagtacttaaactcggtcgaggttagtaagagaatgacactagacaacctcaaatcaagccttcccaatgtctttcagatgttgactgctctagctaatgtctttgccaatgggtttgaatccgttaatggccaaaccggtacagatgtttccgacacatcccaacattccgatgaatctcaaccctaagaaaagacctcattccctttttgatgtttgtttctttcttggtgcttcagtgaagaggtttttgtatatgaatgactgtaagagaaactcaacttaacaactttgtccagctccaaaat

SEQ ID NO: 3940 - DNA, 838 bp, Artificial Sequence; identical to SEQ ID NO: 817
  P458 (35S::G1090)

SEQ ID NO: 3941 - DNA, 1322 bp, Artificial Sequence; identical to SEQ ID NO: 831
  P466 (35S::G1133)

SEQ ID NO: 3942 - DNA, 925 bp, Artificial Sequence
  P467 (35S::G1134)
cgtagtgtctattgaaaccagagaaaagccaaaggggatgcaaccaacatccgtcggtagtagcggcggtggtgacgacggaggaggcagaggaggaggaggagggctaagtagaagtggactatctcggatccgttcagctccagcgacttggcttgaagctttacttgaggaagatgaagaagagtctttgaaacctaatcttggtctcaccgatttgcttaccgggaactcgaacgatttaccgacaagtcgcggctcgttcgagttcccgattcctgttgagcaagggttgtatcaacaaggtgggtttcaccgacagaatagtactccggcggattttcttagtggttctgatggatttatccaaagctttgggattcaggcgaattacgattacttatcggggaatatcgatgtttctccgggaagtaagcggtctagagaaatggaagcactcttctcttctcctgagtttacttctcaaatgaaaggagagcaaagcagcggtcaagttcctaccggagtatcaagcatgtcggatatgaacatggagaaccttatggaggactctgttgcttttagggttcgggctaaacgtggttgcgcaactcatccccgcagcattgccgagagggtacgaaggacgcggattagtgatcggataaggaagctacaagagcttgtacctaacatggacaagcaaaccaacactgcagacatgttagaagaagcagtagaatacgtgaaagttcttcaaaggcagatccaggagttaacagaagaacagaagaggtgcacatgcatacctaaggaagaacaataaggtttgctcctgatttgttttatatttgcttaacggcaatgatctgatcgaaaaattcgaaagatgatcttagcttgaatttagatggatgtcatgttg

SEQ ID NO: 3943 - DNA, 1239 bp, Artificial Sequence; identical to SEQ ID NO: 851
  P471 (35S::G1181)

SEQ ID NO: 3944 - DNA, 859 bp, Artificial Sequence; identical to SEQ ID NO: 883
  P483 (35S::G1266)

SEQ ID NO: 3945 - DNA, 1166 bp, Artificial Sequence; identical to SEQ ID NO: 887
  P484 (35S::G1269)

SEQ ID NO: 3946 - DNA, 748 bp, Artificial Sequence; identical to SEQ ID NO: 893
  P486 (35S::G1275)

SEQ ID NO: 3947 - DNA, 911 bp, Artificial Sequence; identical to SEQ ID NO: 897
  P487 (35S::G1277)

SEQ ID NO: 3948 - DNA, 1619 bp, Artificial Sequence
  P701 (35S::G1314)
cttcaattcactaacgagagaaatgggaagagctccgtgttgcgacaagacaaaagtgaagcgagggccttggtcgcctgaagaagactctaaacttagagattacattgaaaagtatggtaatggtggaaattggatctctttccccctcaaagccggtaagttcatacacatgttcttaatcctagataaccttttcgagcttctaagcccaaataagagcttatgccattctttgttgtggtttaaggtttgaggagatgtgggaagagttgtagactgaggtggctaaactatttgagaccaaacataaagcatggtgacttctctgaggaagaagacaggatcatttttagtctcttcgctgccataggaagcaggttctctaattaattccttttgaaatcatctttaatcatataagatccttacaaaaaatgtagaaatgaaatcattttttcgcccacttgcctgtgaaggccctttcatagttatctgcttagataggtttaaagaaaatattaattcacactctccttcaattaatcttataatagtaacaaaatttctcctaaatctaattttgaatttatgtgttattttgaagtaatgatcaaaatatttccaaacgtgcttaatttcttcataaatctagtcaaaatcacgagctacattgattccatgatttagtcaaaactacgagcaactttaattcatcaagagtgctatacttttctccaatattagctattaatatacatcaattgaaacttgtaggtggtcaataatagcagctcatctaccgggacgaacagacaacgacataaaaaactattggaacacaaagctaaggaagaaactcttgtcttcttcctctgattcatcatcatcagccatggcttctccttatctaaaccctatttctcaggatgtgaaaagaccaacctcaccaacaacaatcccatcttcttcttacaatccgtatgctgaaaaccctaatcaatacccaacaaaatccctcatctccagcatcaatggcttcgaagctggtgacaaacagataatttcctatattaaccctaattatcctcaagatctctatctctcggacagcaacaacaacacctcgaacgcaaatggtttcttgctcaaccacaatatgtgtgatcagtacaagaaccacaccagtttttcttcagacgtcaatgggataagatcagagattatgatgaagcaagaagagataatgatgatgatgatgatagaccaccacattgaccagaggacaaaagggtacaatggggaattcacacaagggtattataattactacaatgggcatggggatttgaagcaaatgattagtggaacaggcactaattctaacataaacatgggtggttcaggttcatcttctagttcgataagcaacctagctgagaacaaaagcagtggtagcctcctactagaatacaaatgcttgccctatttctactcctagttcttctagactctcttgtcttcttatataaatatatcttggactgactgttagtaatatcaaagatttgatggggtatgggaggagagagaatgagatagagagcgactatgatcag

SEQ ID NO: 3949 - DNA, 971 bp, Artificial Sequence
  P703 (35S::G1317)
actccacttggctcttcgattttttctatctaaataacagaaccaaatcattatcgaaatttaaagttgtgcgaaacaaaacaaagatgggaagatcaccttgttgtgataaaaatggagtgaagaagggaccatggactgctgaggaggatcagaaactcatcgattatattcgatttcatggtcctggcaattggcgtacgctccccaaaaatgctggactccatagatgtggaaaaagctgccgtcttcgatggaccaattatctaagaccggacatcaagagaggaagattctcgttcgaggaagaagaaactatcattcagctacacagtgttatgggaaacaagtggtcagcaatagccgctcgtctaccagggaggaccgataacgaaataaaaaaccattggaacactcacatccgcaagagacttgtaaggagtggtatcgaccctgttactcattctccacgccttgatcttcttgatttgtcctcacttttgagtgcacttttcaaccagccaaacttttcagcagttgcaacacatgcgtcttctcttcttaatcctgatgtattgaggttggcctctctactactgccacttcaaaaccctaatccagtttacccatcgaacctcgaccaaaatcttcaaactccaaatacatcatcagaatcgtctcaaccacaagctgagactagtacagtcccaacaaactatgaaacttcatcattggagcctatgaacgcaagactcgacgacgttggtcttgcagatgtattaccacctttgtcagagagttttgacttagactcgctcatgtcaacgccaatgtcttctccacgacaaaatagcattgaagcagaaaccaactccagcactttcttcgactttggaattccggaagatttcatcttagatgactttatgttttaattttcaacatttgcatacacatgtcttgctttcaca

SEQ ID NO: 3950 - DNA, 1002 bp, Artificial Sequence
  P707 (35S::G1324)
agtatggaaaattcgatgaagaagaagaagagcttcaaagaaagtgaagatgaagaactaagaagagggccttggactttggaggaagacacacttctcacaaattacatcctccataacggtgagggtcgttggaatcacgtcgccaaatgtgctgggctaaagagaactgggaaaagttgtagattgagatggttgaattacttgaaacccgacataagacgagggaatcttactcctcaagaacagcttttgatccttgagcttcactctaaatggggtaataggtggtccaagattgcacagtacttgccaggaagaacggataacgagatcaagaactattggagaacaagagttcaaaaacaagctcgtcaactcaacatcgaatctaacagcgacaagttctttgacgctgttcgtagtttttgggtccctagattgatcgagaagatggaacaaaactcatccactactactacttattgttgtccccaaaacaacaacaacaactctcttcttcttccttctcaatctcacgactctttaagtatgcaaaaagatatagattactcgggtttcagcaacatagacggttcttcttcaacttctacttgcatgtctcatctaacaacagttccacactttatggatcaaagcaacaccaatatcatcgatggctcgatgtgtttccatgaaggcaatgttcaagaattcggaggatatgttcctggcatggaggattacatggtaaactcggacatctcaatggaatgtcacgtggcggatggttattcagcgtacgaggatgttacacaagatcccatgtggaatgtggatgacatttggcagtttagggagtaattaagtcgtcaagagatgagatggtagagcctaccactacggttctattatatggactaatatacttcttttgcttaactaagcaaaaagtttcgaaccttttacccatattatctcgggttggagactagaacatgt

SEQ ID NO: 3951 - DNA, 880 bp, Artificial Sequence; identical to SEQ ID NO: 923
  P709 (35S::G1326)

SEQ ID NO: 3952 - DNA, 1055 bp, Artificial Sequence
  P711 (35S::G1328)
catttgacttcatcgatcggttaacaattaatcaaaaagatgggacgatcaccatgttgtgagaagaagaatggtctcaagaaaggaccatggactcctgaggaggatcaaaagctcattgattatatcaatatacatggttatggaaattggagaactcttcccaagaatgctgggttacaaagatgtggtaagagttgtcgtctccggtggaccaactatctccgaccagatattaagcgtggaagattctcttttgaagaagaagaaaccattattcaacttcacagcatcatgggaaacaagtggtctgcgattgcggctcgtttgcctggaagaacagacaacgagatcaaaaactattggaacactcacatcagaaaaagacttctaaagatgggaatcgacccggttacacacactccacgtcttgatcttctcgatatctcctccattctcagctcatctatctacaactcttcgcatcatcatcatcatcatcatcaacaacatatgaacatgtcgaggctcatgatgagtgatggtaatcatcaaccattggttaaccccgagatactcaaactcgcaacctctctcttttcaaaccaaaaccaccccaacaacacacacgagaacaacacggttaaccaaaccgaagtaaaccaataccaaaccggttacaacatgcctggtaatgaagaattacaatcttggttccctatcatggatcaattcacgaatttccaagacctcatgccaatgaagacgacggtccaaaattcattgtcatacgatgatgattgttcgaagtccaattttgtattagaaccttattactccgactttgcttcagtcttgaccacaccttcttcaagcccgactccgttaaactcaagttcctcaacttacatcaatagtagcacttgcagcaccgaggatgaaaaagagagttattacagtgataatatcactaattattcgtttgatgttaatggttttctccaattccaataaacaaaacgccattggaatagagttatgtaaacatgcaatca

SEQ ID NO: 3953 - DNA, 873 bp, Artificial Sequence
  P714 (35S::G1334)
ccattggacttttggaacataagctatgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatatgatcagcagataggggacaagacatgattggtcaccagtc

SEQ ID NO: 3954 - DNA, 965 bp, Artificial Sequence; identical to SEQ ID NO: 937
  P715 (35S::G1335)

SEQ ID NO: 3955 - DNA, 1630 bp, Artificial Sequence; identical to SEQ ID NO: 939
  P716 (35S::G1337)

SEQ ID NO: 3956 - DNA, 1002 bp, Artificial Sequence
  Artificial sequence
  P724 (35S::G1363)
ctactatggtctggagattagttcgtttattgaactaatgttttagacaatgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggttacaaagaaaacccggaaaatcctattggaagtcattcgatatcaaaggtgtctcaagattcagtggttcttcctattgaggcggcttcttggcctttacacggcaatgtaacgccacatttcaatggtttcttgtcttttccttatgcatcacaacacacggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaaccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatgtgagagagctcccgcaagtggtggatgag

SEQ ID NO: 3957 - DNA, 944 bp, Artificial Sequence
  P737 (35S::G1411)
gaagaaaaggctatatttaaaagaaaatcaagcaaaagtagatcctcggatgtatgggaagaggccttttggaggtgatgaatctgaagaaagggaagaagatgagaacttgttcccggtcttctcggcccgatctcaacacgacatgcgtgttatggtctcggccttgactcaagtaatcggaaaccaacaaagcaaatctcatgataacatcagctctattgatgataactatccttctgtgtataatccacaagaccctaatcaacaagttgcgcctactcatcaagaccaaggggacttgaggaggagacattatagaggtgtaaggcaaaggccatggggaaagtgggcagctgaaatccgagacccaaaaaaggcggcacgtgtgtggctcgggacatttgaaaccgctgaatctgcggccttagcttatgatgaagcagccctaaagttcaaaggaagcaaagcaaaactcaatttcccggagagggttcagcttggaagtaactctacatattactcctccaaccaaattccacaaatggaaccacaaagtataccgaactataatcaatactatcatgatgcgagtagtggtgatatgctaagttttaatttgggcggtgggtatgggagtggtaccggatattcaatgtctcatgataatagtactacgactgctgctacaacttcttcgtcttctggtggctcttctaggcaacaagaagagcaagattatgccagattctggcgctttggggattcttcttcctctcctcattcgggatattaattaggagatttgatcagttacttgtgatgaagtaatgatacatttcccgtcaaaattgagatgatcatatgcttcctgaatgtttttgagtgtcatttttgtcttccgcgttaagatttattgaacgtgttttcttgtttttttggtt

SEQ ID NO: 3958 - DNA, 1281 bp, Artificial Sequence; identical to SEQ ID NO: 981
  P745 (35S::G1435)

SEQ ID NO: 3959 - DNA, 799 bp, Artificial Sequence; identical to SEQ ID NO: 987
  P751 (35S::G1449)

SEQ ID NO: 3960 - DNA, 1342 bp, Artificial Sequence; identical to SEQ ID NO: 1001
  P753 (35S::G1466)

SEQ ID NO: 3961 - DNA, 975 bp, Artificial Sequence
  P756 (35S::G1540)
ctctttctcttgttcctctctaagtcttgatcttatttaccgttaactttgtgaacaaaagtcgaatcaaacacacatggagccgccacagcatcagcatcatcatcatcaagccgaccaagaaagcggcaacaacaacaacaagtccggctctggtggttacacgtgtcgccagaccagcacgaggtggacaccgacgacggagcaaatcaaaatcctcaaagaactttactacaacaatgcaatccggtcaccaacagccgatcagatccagaagatcactgcaaggctgagacagttcggaaagattgagggcaagaacgtcttttactggttccagaaccataaggctcgtgagcgtcagaagaagagattcaacggaacaaacatgaccacaccatcttcatcacccaactcggttatgatggcggctaacgatcattatcatcctctacttcaccatcatcacggtgttcccatgcagagacctgctaattccgtcaacgttaaacttaaccaagaccatcatctctatcatcataacaagccatatcccagcttcaataacgggaatttaaatcatgcaagctcaggtactgaatgtggtgttgttaatgcttctaatggctacatgagtagccatgtctatggatctatggaacaagactgttctatgaattacaacaacgtaggtggaggatgggcaaacatggatcatcattactcatctgcaccttacaacttcttcgatagagcaaagcctctgtttggtctagaaggtcatcaagacgaagaagaatgtggtggcgatgcttatctggaacatcgacgtacgcttcctctcttccctatgcacggtgaagatcacatcaacggtggtagtggtgccatctggaagtatggccaatcggaagttcgcccttgcgcttctcttgagctacgtctgaactagctcttacgccggtgtcgctcggg

SEQ ID NO: 3962 - DNA, 766 bp, Artificial Sequence; identical to SEQ ID NO: 1063
  P758 (35S::G1545)

SEQ ID NO: 3963 - DNA, 896 bp, Artificial Sequence; identical to SEQ ID NO: 1085
  P760 (35S::G1634)

SEQ ID NO: 3964 - DNA, 1036 bp, Artificial Sequence
  P781 (35S::G208)
cttcttcattcaccatgggaagatctccttgttgtgaaaaagctcacacaaacaaaggagcttggactaaagaagaagatcaacgtctcgtagattatatccgtaatcacggtgaaggttgttggcgttctcttcctaaatccgctggattgttgcgttgtggtaaaagttgtagattgagatggattaattaccttcgtcctgatcttaaacgtggtaattttactgatgatgaagatcaaatcatcatcaaactccatagcttactcggtaacaagtacgataactttttcctctctttctcttcttctaaaaaaacagagtgaaaatagaaaaacagagtcacttttttttttctccctactcttgtttctaggaaaaagatttcaactttctaggaaacagagagaaaatagaaactgggtcactttgttttcctgctctttcttcttctttgatctttcccaggaaaaaagtttcaactttctaggaaacagagtcgttcacttttttgtttcctctgtttttgttaaagctttcctctgttattgttattcatatgaatttgaaatgttttgttttgcagatggtcattgatagctggaagattaccaggaagaacagataacgaaataaagaattattggaacactcatattaagaggaagcttcttagtcacggtattgatccacaaactcatcgtcagattaacgaatccaaaacggtgtcgtctcaagttgttgttcctattcaaaacgatgccgttgagtattctttttccaatttagccgttaaaccgaagacggaaaattcctccgataacggagcttcgactagcggcacgacgacggacgaggatctccggcagaatggggagtgttattatagtgataattcaggacatataaagctgaatttggatttaactcttgggtttggatcctggtcgggtcggatagtcggagtcgggtcatcggctgattctaaaccgtggtgcgacccggtgatggaggcgcgtttgtcactgttgtaata

SEQ ID NO: 3965 - DNA, 3283 bp, Artificial Sequence
  P783 (35S::G431)
ccatagatacacacacacagttacttactcttttagggtttcccaataaatttatagtactttaatgtgtttcatgatattgatgataaatgctagctgtatttacaatgggggctcctctttttttttctttatgttattttcattttttatttctcatagctatatagcaaagccaaagtgaataataatactagtgagagaaagagaagatggagagtggttccaacagcacttcttgtccaatggcttttgccggggataatagtgatggtccgatgtgtcctatgatgatgatgatgccgcccatcatgacatcacatcaacatcatggtcatgatcatcaacatcaacaacaagaacatgatggttatgcatatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctcttcctcttcttcagcctctgtcaaggccaagatcatggctcatcctcactaccaccgcctcttggccgcttatgtcaattgtcagaaggtgatgagagaaagaaacttgaaaaaattactttgaaagtttcttcgtaactctaatgattcttatttgattttcttgcacaaaaaagaagagaaagattctagaaaccctaattaccaaactttaccttttatttcctttttacataaccctttacttgatgtctgagtttgattttgatatctacttttgtttactagttacttaacccagctaagtatatacaaatcaaaggatacaatttttcctatattgagaaagtttcaagaaacaatttgtaaaaaccctacttgcaagagattatccaaaatattgtatgtaggcttgaagattaggacatatataattatttcatttttttctttactatattatatatccacaataaacgtgaggatccttatcttagttcaattaacgtttttatgtctatcatttactaattacacaatttcttaaggttggagcaccaccggaggttgtggcgaggctagaggaggcatgctcgtctgccgcagccgctgccgcatctatgggaccaacaggatgtctaggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttactctctcctctctctctagttctctgtttttttttctttctttttaattcatattcttgttaattatggcgtcaaattaaacgtaagatgaggaaagttgttttttttctttgtgggttttaagaaagattttcctttttctgatttttcttgggtaaatacccctttgatggttgttactagggttagtgtcagattgttatatatagcttactaggtttacgtgtataatctatctatacataagttagtgtatgtagttgttttcattgaattaaaacagtttgtttactgtttttttgttttgtttggaattgaattcatttgctttggtacaacaacaatcactgttcttgtctctttcttctccgtttgttttggatctatttaattcaaatgcatcaaaaagaatatctggatctagagtctgctcgtccttagatctattgctcaatttagacatacacatgtttttgtacgtataatcacatatacatatatctacacaatgtcatatcactcttcttttcaagaatgtagttaagtttatatagacacacaaactcacatctacttaacatgttactttgaattatttggatcactagcctattctttttcatttccctagacacatgttcttgttgacaaatttgtcttgctttcacatgtttaatcaatataaggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggtaactctcttcccttatactctaattaaataatcatttcatgtttttaaaaaagcatttatatgatagcaaattcaatttagttgtctattagcttgtttcaatgtttttagtgatttttgcattcatactatatcgttagggacattagtttatgttagctcatgttggcattgcacaatatgcatttgcataatttgaaatcctaaaagctgaatgaagtgaacttatttagtctatgtgtactgttttggtctattagccgatgacaaacttgattcttgcttccataccttttttagggtccgaataatatgtcaatcttagtcaagactacgatcaatttcatcttatggctgtgtaccataacttagactaaactttgttgcacatatttcaagtcataactttggaaagtagggtgcatgaggccataccctaatgcaatagtagctcatgtctttattacacttgtatagtgtcattacccatgttcgtatgagtagatggattctaagttctccttacaatctagcaaatcgtgatgtagctgtgatcatggactgaccttatatcggagagaacacttgatgattgattttttctcgcatgtgatatgaaattgcaggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttgggcaatcctttcccaatggatcacatctcctccaccatgctttgatcgatcctttaaaacgtttatttcattatatttataatcgttaaacagcttataatatgtataatctatggttctcggtatacttggaacatatgaaacatgttccgattgatgaacaagcgtttgatgttgtggtgtgtatcc

SEQ ID NO: 3966 - DNA, 3633 bp, Artificial Sequence
  P784 (35S::G419)
gggttttaggagctatctctattgtcttggttctgatacaaagttttgtaattttcatggtatgagaagatttgcctttctattttgtttattggttctttttaactttttcttggagatgggttcttgtagatcttaatgaaacttctgtttttgtcccaaaaagagttttcttttttcttctcttctttttgggttttcaattcttgagagacatggcaagagatcagttctatggtcacaataaccatcatcatcaagagcaacaacatcaaatgattaatcagatccaagggtttgatgagacaaaccaaaacccaaccgatcatcatcattacaatcatcagatctttggctcaaactccaacatgggtatgatgatagacttctctaagcaacaacagattaggatgacaagtggttcggatcatcatcatcatcatcatcagacaagtggtggtactgatcagaatcagcttctggaagattcttcatctgccatgagactatgcaatgttaataatgatttcccaagtgaagtaaatgatgagagaccaccacaaagaccaagccaaggtctttccctttctctctcctcttcaaatcctacaagcatcagtctccaatctttcgaactcagaccccaacaacaacaacaacaagggtattccggtaataaatcaacacaacatcagaatctccaacacacgcagatgatgatgatgatgatgaatagtcaccaccaaaacaacaacaataacaatcatcagcatcataatcatcatcagtttcagattgggagttccaagtatttgagtccagctcaagagctactgagtgagttttgcagtcttggagtaaaggaaagcgatgaagaagtgatgatgatgaagcataagaagaagcaaaagggtaaacaacaagaagagtgggacacaagtcaccacagcaacaatgatcaacatgaccaatctgcgactacttcttcaaagaaacatgttccaccacttcactctcttgagttcatggaacttcagaaaagaaaagccaagttgctctccatgctcgaagaggtatatatattttcaagaaattatttcattactactatcaaaacttacatgagtttcttagaaaatctaatccttttttatttggtttcaacttattcctaaaaatgtaaaatacccacaagtcttttacaaatctttttttttttcctttcatttggtttcaacttattcctaaatatgtaagatacccataaatcttgtattttttcgattcttgattaggtccatatatttcttaaagttacaaatttcttttagatattaagataaaaagattcttttttgtcttcattctttcatgtattctcgtcgaaaacaagttcgatcgtatcaactacgaaaagatcaacccttttaattcctttactcattatttctttttttctatagaaccaaaatataattttgttttctttgctttgagctaatttggagactctagtggtcctccatatttatagcaatcagtttcatcatcataagccataacgagttgtttctttttcgtgtatttactcattctaagaatctacatttacacgattgtgattgaaatctttgtgaatggtgtggggtaacgtttttttgcggttttttggcagcttaaaagaagatatggacattaccgagagcaaatgagagttgcggcggcagcctttgaagcggcggttggactaggaggggcagagatatacactgcgttagcgtcaagggcaatgtcaagacactttcggtgtttaaaagacggacttgtgggacagattcaagcaacaagtcaagctttgggagagagagaagaggataatcgtgcggtttctattgcagcacgtggagaaactccacggttgagattgctcgatcaagctttgcggcaacagaaatcgtatcgccaaatgactcttgttgacgctcatccttggcgtccacaacgcggcttgcctgaacgcgcagtcacaacgttgagagcttggctctttgaacactttcttcacccgtaagttatttcatatacatcctcttaatatatttacacatacctaaaagttactaattgtgtctttctgaagtgatcaatgaaggtagaatcacaagttaattgggtatatttatggagctatataaaacctctttaacgattttatttcattgatagtacgttgataaatagtatgataggttttttttgtttgttacatgaatatttttgaacatataaaagtaaaaaaatatgtacattttatatagagagattgagattgacttgacaagcataggatacaatctaccttaatctgttaattgcatatagcttttttattttcctttttctttcatttgcactattggtgtgaaagtgagtgtacaaacatatacatatacacatgtatatatatgtatacgaacatataaaattaaataaaataaatttaactggtggatgaaagacagaaatagagaaaggtacaaagtggattgagagagagaatcaatgttctttacctaacactaacaaaagagagaaactatacataactccttgcttttttctccatgtttttattttgttctttttcttctactttttatttatttaatttacagaagttatatgtttatcatcatatgtaacacttgtctccatcaattcccaaacactgctcaaacaatgaaacatcttgttagttttcaccaaaccctttacctttgcttccattttatttgcatcattcttcaatcatttatatccttttttttaattacatatccatttgtcttatatttttccattaaagtaaaattttcttatttttgttttcagatatccgagcgatgttgataagcatatattggcccgacaaactggtttatcaagaagtcaggtaaagaataactccactaattcttgatatattccaaaatttattatcctatttactaaagttataataaaccaaaattgttaggtatcaaattggtttattaatgcaagagttaggctatggaaaccaatgattgaagaaatgtactgtgaagaaacaagaagtgaacaaatggagattacaaacccgatgatgatcgatactaaaccggacccggaccagttgatccgtgtcgaaccggaatctttatcctcaatagtgacaaaccctacatccaaatccggtcacaactcaacccatggaacgatgtcgttagggtcaacgtttgacttttccttgtacggtaaccaagctgtgacatacgctggtgaaggagggccacgtggtgacgtttccttgacgcttgggttacaacgtaacgatggtaacggtggtgtgagtttagcgttgtctccagtgacggctcaaggtggccaacttttctacggtagagaccacattgaagaaggaccggttcaatattcagcgtcgatgttagatgatgatcaagttcagaatttgccttataggaatttgatgggagctcaattacttcatgatattgtttgagattaaaagattaggaccaaagttatcgatacatattttccaaaaccgattcggttatgtaacggtttagt

SEQ ID NO: 3967 - DNA, 1055 bp, Artificial Sequence
  P786 (35S::G394)
tacgaagagaaaattcaaatgggtcttgatgattcatgcaacacaggtcttgttcttggtttaggcctctcaccaacgcctaataattacaatcatgccatcaagaaatcttcctccactgtggaccatcgtttcatcaggctcgatccgtcgttgactctaagcctatccggtgagagctacaagatcaagactggtgccggcgccggcgaccaaatttgccggcagacctcgtcccacagcggcatctcatctttctcgagcggaagggtaaagagagaaagagaaatctccggcggcgatggagaagaagaggcggaggagacgacggagagagtggtgtgttcgagagtgagtgatgatcatgacgatgaagaaggtgttagtgctcgtaaaaagcttagactcactaaacaacaatctgctcttctcgaagataacttcaaacttcatagcacccttaatcccgtatgatatagttaattatttccttaattaaactaatcagtctcttcttatttacgttaatcatatcgttaattattttttctatgaatttacagaagcaaaaacaagctcttgcgagacagctgaatctaaggcctagacaagttgaagtgtggttccaaaacaggagagctaggtaaatataattgattacttttgtgaattttaatatcatacttttctttctttattttggttcataaaaatattttttaattaaattttaatttgaacagaacaaaactaaagcaaacagaagtggattgtgagtttttgaagaaatgttgcgagactttaacggatgagaatagaaggcttcaaaaagagcttcaagaccttaaggctttaaaattgtctcaaccgttttacatgcacatgccggcggcgactttgactatgtgcccttcttgtgagagactcggcggtggtggtgtcggaggagatacgacggcggttgatgaagaaacggcgaaaggagctttctccatcgtcacaaagcctcgtttctataaccctttcactaatccttctgcagcatgttagttact

SEQ ID NO: 3968 - DNA, 1041 bp, Artificial Sequence
  P787 (35S::G255)
ctagaagcaattaggctcaccttccacctccaacacctctctccccttctctctccataaaaccctcaacaacagaatcaaaagcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtaagcccctatgctctgttttatatagcttatgctctgtttcttgaaacttatcctctgtttttttattaggtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtgtgataatgaatgttag

SEQ ID NO: 3969 - DNA, 969 bp, Artificial Sequence
  P790 (35S::G242)
cactaaagaggagaagattgctaaagtttgataaaacattccaaaatcaatggctgataggatcaaaggtccatggagtcctgaagaagacgagcagcttcgtaggcttgttgttaaatacggtccaagaaactggacagtgattagcaaatctattcccggtagatcggggaaatcgtgtcgtttacggtggtgcaaccagctttcgccgcaagttgagcatcggccgttttcggctgaggaagacgagacgatcgcacgtgctcacgctcagttcggtaataaatgggcgacgattgctcgtcttctcaacggtcgtacggacaacgccgtgaagaatcactggaactcgacgctcaagaggaaatgcggcggttacgaccatcggggttacgatggttcggaggatcatcggccggttaagagatcggtgagtgcgggatctccacctgttgttactgggctttacatgagcccaggaagcccaactggatctgatgtcagtgattcaagtactatcccgatattaccttccgttgagcttttcaagcctgtgcctagacctggtgctgttgtgctaccgcttcctatcgaaacgtcgtcttcttccgatgatccaccgacttcgttaagcttgtcacttcctggtgccgacgtaagcgaggagtcaaaccgtagccacgagtcaacgaatatcaacaacaccacttcgagccgccacaaccacaacaatacggtgtcgtttatgccgtttagtggtgggtttagaggtgcgattgaggaaatggggaagtcttttcccggtaacggaggcgagtttatggcggtggtgcaagagatgattaaggcggaagtgaggagttacatgacggagatgcaacggaacaatggtggcggattcgtcggaggattcattgataatggcatgattccgatgagtcaaattggagttgggagaatcgagtagac

SEQ ID NO: 3970 - DNA, 1732 bp, Artificial Sequence
  P792 (35S::G256)
cgttgtgtttctcctcaacattcaaagtctttagtgaaacctctcttgtaagaagccaaaaaaataaagagaaagattcaaagaaggaaagaaattgaggatgactatttcaagtccaaagagagattttgagtagaccctcttcacaaaaatccaatcttagagtcttactagttactatctagcttacatacacagagacactataccaaaaatccaatcttattagagtacttactatatagcttacacatacacacacacgaagtactatttcaacgatcaagagcgtgtgcgtgaggatatgggtagaccaccttgttgcgagaagattgaggtgaagaaaggaccatggactcccgaagaagacataatcttggtctcttatatccaacaacacggccctggaaattggagatctgtccctgcaaacaccggtctttatatatcttcattcactctccttctttcttcttcttatatatctttcttataagatttttccacatatataaatatttatatatgtttcaggtttgctaaggtgtagcaagagttgcagacttagatggactaattaccttcgtcccgggatcaaacgaggaaatttcactcaaccggaagagaagatgatcatccaccttcaagctcttttgggaaataggtatggaattactcctttaattctccctgttttatattaaattgattcacgttgatctccaatatctaagtttgtccatcttccgtaatctcctaattaacaatataaattatatagagtattagcatttcattttattagtgttttttttgttattatttatttgattggatgtccactttgaaaataagatgggcagctatagcatcatatctacctcagaggaccgacaatgatatcaagaactactggaacactcatcttaaaaagaaactagtgatgatgaagtttcaaaatggtatcatcaacgaaaacaaaaccaatctggcaacagatatttcgtcttgtaataataacaacaatggatgtaatcacaacaaaaggaccaccaacaaaggccaatgggagaaaaaacttcaaacagacatcaacatggccaaacaagccttattccaagccttgtcacttgaccaaccatcttcattgatccctcccgatcctgactcaccaaaacctcatcatcattctaccaccacttatgcctcaagcacagataacatctctaaattactccagaactggacaagctcatcatcgtcaaagcctaacacttcatcagtctccaacaaccggagctcaagccccggtgaaggaggactttttgatcatcactctttgttctcatcgaattcagaatctggatcagttgatgagaagctgaatttgatgtccgagacaagcatgttcaaaggtgagagcaagccagacatagacatggaagctacacctactactactactactgatgatcaaggctcgttgtcattgatcgagaaatggttgtttgatgatcaaggcttggttcagtgtgatgatagtcaagaagatctcatcgacgtgtctttagaggagttaaaataatgataacaacagtcaagatttgttctataagaaaataaaacgtatagaacaacgataaagctagctaggtttattaatttttctttcttttgtcttttctctatgatctttagttacattttattttactgtgtggcttgcttgtgg

SEQ ID NO: 3971 - DNA, 1305 bp, Artificial Sequence
  P794 (35S::G198)
tactaaaccagttgaccatttttttctgataaacaatcaatggcaaggtcaccttgttgcgagaagaacggactcaagaaagggccttggacatctgaagaagaccagaagcttgttgactatatccagaaacatggttatggtaactggagaaccctccccaaaaatgccggtacgtgtcttaattttcatttattattcatgttttagttatgtttttcgaaagtttcaaattgtaatatgtttttttctcttcatcaggtttgcaaagatgtggcaaaagttgtaggttaaggtggactaattatctccgaccagatataaagcgaggaaggttctcttttgaggaagaagaaaccattattcagcttcatagcttcttaggaaacaagtaagtttgctttttttttctcctccgacaatatctactatgaaaatagttcaagattcttacgtgtttggtttatcttgttataggtggtctgcgattgcggcgcgtttaccaggaagaacagataatgagatcaagaacttttggaacactcatataagaaagaagctacttagaatggggattgatccagtgactcacagtccacgactcgatctcctcgatatctcatccatcttagcttcatctctatacaattcatcttcacatcacatgaacatgtcaagactcatgatggatactaatcgtcgtcatcaccagcaacatccattggttaaccccgagatactcaagctcgctacctctctcttctctcaaaatcaaaaccaaaaccttgtggtggatcatgactcgagaactcaagagaagcaaacagtttatagccaaaccggagtaaaccaataccaaaccaaccaatatttcgagaacacgattactcaagaactccaatcttccatgccaccattccccaatgaagctcgtcagtttaacaacatggatcatcacttcaatggttttggagaacaaaatcttgtttcaacttctactacgtcagtccaagattgctataatccgtcattcaacgattattcaagttcaaattttgtcttggatccttcttattcggatcagagcttcaacttcgcaaattcggtcttaaacacgccatcctcgagcccgagcccgactacgttaaactcgagttacatcaatagtagcagttgcagcactgaggatgaaatagaaagctattgcagtaatctcatgaagtttgatattcccgatttcttggacgttaatggttttattatataattccaagaaacaaaataaaactcgagtgggatacagtt

SEQ ID NO: 3972 - DNA, 1380 bp, Artificial Sequence
  P795 (35S::G222)
cctcttcaagcttatagaacctccaagaaccataaaactctctctgcaacaatctatactttcttcattacttttataaaaaatgggaagacattcttgttgttttaagcagaagctaagaaaaggcctttggtctcctgaagaagatgagaaacttctcaattacatcactagacatggtcatggctgttggagttctgtccctaaactcgcaggtttggtctctatgtgctcttatattatatatagcttaaagaggtttatatagcatcgtttataatgtttttatatgcgttggtggatatatatgatcaaataggtttgcaaagatgtggaaagagttgtagacttaggtggataaattatttgagaccagatttaaagagaggagctttctctcaagacgaagaaagcttgatcattgagctccatgctgcattaggcaacaggttcattaatttgcaacacatttatatagttttgaatttataatgtatattgtgtatatatatatatatgttaaaaaaaaaatctttggttcatattgaatatgtagatggtctcaaatcgcaacgcggttaccgggaagaacagacaacgagatcaaaaacttttggaactcatgtcttaagaagaagctgagaagaaaaggcattgacccaacaacacataaacccttaataacaaacgagcttcaatctcttaacgtcatagatcagaaactgacgtcatcagaagtagtaaagtcaacgggttcgataaacaacctacatgatcagtcaatggtcgtctcatcgcaacaaggtccatggtggttcccggcgaatacaactacgactaatcaaaactctgcgttttgctttagttcaagtaatactacaacggtttcagaccagatcgtatctttaatctcttcaatgtctacgtcatcatctccgacaccaatgacttcaaacttcagtcctgctccaaacaactgggaacaactcaactactgcaacacagtaccaagtcagagcaacagtatctacagtgccttctttggtaatcaatacacagaagctagccaaaccatgaacaataataatccactagtagatcaacatcatcatcatcaagacatgaagtcatgggcatcagagattcttcattacacagaacacaaccaaagctcagaaactgttatagaagcagaagtgaagccagacattgccaactactactggagatcagcatcatcatcgtcgtcaccaaaccaagaagctgcaacattactacacgatgctaacgtggaagtgtacggtaaaaatctacaaaagcttaataacatggtgtttgatcagagcctttagattattaacatgtgttatagagagtttc

SEQ ID NO: 3973 - DNA, 1068 bp, Artificial Sequence
  P796 (35S::G225)
gctactattaatccttcccctcgtgaggaaatcatttcttcttgtttctcgagatttattctctttctctctctctttctctgtgtgtttcgtgtcttcagattagttcgatgtttcgttcagacaaggcggaaaaaatggataaacgacgacggagacagagcaaagccaaggcttcttgttccgaaggtctgatttctctttgtttctctctatatctttttgatcggtttgagtctgattttgtatgtttgtttcgcagaggtgagtagtatcgaatgggaagctgtgaagatgtcagaagaagaagaagatctcatttctcggatgtataaactcgttggcgacaggttagagactctttctctctcgatccatcttgttgctttctcttttttttggtctttcatgttttgtcgaatctgcttagattttgatctcaaagtcggtcgtttatttatgcattttcttggtttttctattatattattgggtctaacttaccgagctgtcaatgactgtgttcagcctgatttttgatcttgttattattctctgttttttgttttagttgttcaaatagcaaaacctaatcaagatttcgttttcagtttctttttttatatatgattctttagcaaaacatattcttaatttatgtcagaactcactttggctagtttggttcaattttgattacagcatgtttgtatgaagtcaaagtgtaaattacgattttggttcggttccatagaattttaaccgaattacaaactttatgcggtttttatcggaataaaaggtatttggttaagtgtaagttcctcaacactgactgttagcctatcctacgtggcgcgtaggtgggagttgatcgccggaaggatcccgggacggacgccggaggagatagagagatattggcttatgaaacacggcgtcgtttttgccaacagacgaagagacttttttaggaaatgattttttttgtttggattaaaagaaaattttcctctccttaattcacaagacaagaaaaaaaggaaatgtacctgtccttgaattact

SEQ ID NO: 3974 - DNA, 3306 bp, Artificial Sequence
  P798 (35S::G217)
ggttccaaccctaatctagggttactctctctctcgcttccttctgttcttcgttcttaccgagttccacgagcattagcttcagagaccttgaattggagtgcggttggatcaaaaacagttgagcgaagatgaggattatgattaagggaggtgtttggaagaacaccgaagatgagattctcaaagccgccgtgatgaagtatggtaagaaccaatgggctcggatctcgtctcttctcgttcgtaagtctgctaaacagtgtaaagctcgctggtacgagtggctcgatccatctatcaaaaaggtaagtcgtgttcgcgttttccttctcttaactagtagtgttcgaaaaaaaactatggatctggcgaacatttttttgtttggggatttggccttttaggtagtttgttagcttgttactaggtgctttagttgtatatatgtattgatttgcatctggaaattcatagaaagtgtaggcagtaatgctaggagttttggagtattcgaaggttttcttatgtttttgaattacaactgagtttaattttgtgatgttaatgtagactgaatggaccagagaagaagatgagaagcttctacatcttgctaaacttctgcctactcaatggagaactattgctcctattgtgggtcgtacaccatctcaatgtcttgagaggtatgagaagctccttgatgcagcatgcactaaggatgaaaattatgatgcagcggatgatccacgaaaattacgtcctggtgagattgatccgaacccagaagcaaagcctgctcgtcctgatccggtagacatggacgaagatgagaaagaaatgctttctgaagcaagagctagattggctaacacgaggggaaagaaggctaaaagaaaagctagagaaaaacaacttgaggaagctagaaggcttgcttctctgcaaaaaagaagagaactaaaagcagctgggattgatggaaggcataggaaaagaaagagaaagggaatcgactataatgcagaaattccttttgaaaagagggcacctgcgggattttatgatactgcggatgaagatcgtcctgctgatcaagtaaaatttccaactaccattgaagaacttgaaggaaaaagaagagctgatgtagaagcacatttacgcaaacaagatgttgcaaggaataaaattgctcagagacaggatgctccagcagctatattgcaagcaaacaagctgaatgatccggaagttgttaggaagaggtcaaagctgatgttaccaccaccgcagatttcagaccacgagctagaagaaattgctaagatgggctatgccagtgaccttcttgccgagaatgaggagctaacagaaggcagtgctgctactcgtgcacttttggcaaattactcacaaacaccaaggcaaggaatgacacccatgaggacacctcaaagaactcctgctggtaaaggtgatgctattatgatggaagcagaaaacctggccagattaagagactctcagacacctttgctaggaggagaaaatcctgagttgcacccttctgacttcactggggtcactccgagaaagaaggagattcaaacgcctaatccaatgttgaccccttcaatgactcctggtggtgctggtcttactccaagaattggcttgacgccatcaagggatgggtcttctttttctatgacacccaaagggactcccttcagggatgaacttcacattaacgaagacatggacatgcacgaaagtgcaaaacttgagaggcagagacgagaggaagctagaaggagtttacgctctggtttgactgggcttcctcagccaaagaacgagtaccaaatagttgcacaacctcctcctgaggaaagtgaagagccagaagagaaaattgaggaagacatgtcagacaggatagcgagggaaaaggcggaggaagaagcaagacaacaggcattgcttaagaagagatccaaggtcttgcagagagatcttcctagacccccagctgcttcattggcagtaattaggaactcgttgctttcagctgatggagacaaaagttctgttgttcctcctactccgattgaggttgcagataaaatggtaagagaggagcttctacagttgctggagcatgataatgcaaagtatccgcttgatgacaaagctgagaagaagaaaggagccaagaaccgtaccaaccgttctgcttctcaagttcttgcaattgacgattttgatgaaaatgagctccaagaggtatgtagatgaaaatatctatccaatttcagtttacttttgttttgttttttggttgattaattcgttggccagcttctggaatccttagttctctcttggtttaggctagattgtttgattgataatttttgcatgaatgttaatccctccttaattatcaacatctgtaattaatttggtatacactagggagttttgaatgaaggttgttgcttatgatttttggtaggctgacaaaatgataaaggaggaggggaagtttctgtgtgtgtcaatgggacatgagaacaagacacttgatgattttgtagaagctcacaacacatgcgtgaatgatctcatgtatttccccactcgaagcgcttacgagctctcaagtgttgctgggaacgcggacaaagttgcagcttttcaggaggagatggagaatgtgagaaaaaagatggaggaggatgagaagaaggcagaacacatgaaggccaagtacaaaacttatacaaagggtcatgaggtaacatatagtccacattgccttaaatgttaattctgaaactatattttgtttggtgtcaatgtttaacggatttgtacatttgacagaggagggcagagaccgtgtggacccaaatagaggcgacattgaagcaggctgagattggtggaacagaagtagagtgctttaaagcattgaagaggcaagaagagatggctgcatcttttaggaaaaagaatttgcaagaggaagtgataaagcaaaaggaaacagagagtaaactgcagactcgctatgggaatatgttggcaatggttgaaaaagcagaggagataatggtcggtttccgagcacaggcattgaagaaacaagaggatgttgaagattctcacaaactgaaagaagctaagctagccactggagaggaagaggacatagccatagccatggaagcttctgcataaaaacttgagttttgtattgcttacaagttttaaggagacgtagcttgactttgt

SEQ ID NO: 3975 - DNA, 928 bp, Artificial Sequence
  P800 (35S::G207)
aaaagatctgtttcaatggcggatcgtgttaaaggtccatggagtcaagaagaagatgagcagctacgaaggatggttgagaaatacggaccgaggaattggtctgcgattagcaaatcgattccaggtcgatctggtaaatcgtgtagattacgttggtgtaatcagttatctccggaggttgagcatcgtcctttctcgccggaggaagatgagactattgtaaccgcccgtgctcagtttggtaacaagtgggcgacgattgctcgtcttcttaacggtcgtacggataacgccgttaaaaatcactggaactctacgcttaagaggaaatgcagcggaggtgtggcggttacgacggtgacggagacggaggaagatcaggatcggccgaagaagaggagatctgttagctttgattctgcttttgctccggtggatactggattgtacatgagtcctgagagtcctaacggaatcgatgttagtgattctagcacgattccgtcaccgtcgtctcctgttgctcagctgtttaaaccaatgccgatttccggcggttttacggtggttccgcagccgttaccggttgaaatgtcttcgtcttcggaggatccacctacttcgttgagtttgtcactacctggagctgagaacacgagttcgagccataacaataacaacaacgcgttgatgtttccgagatttgagagtcagatgaagattaatgtagaggagagaggagaaggacgtagaggtgagtttatgacggtggtgcaggagatgataaaagctgaagtgaggagttacatggcggaaatgcagaaaacaagtggtggattcgtcgtcggaggtttatacgaatccggcggcaatggtggttttagggattgtggagtaataacacctaaggttgagtagttttggt

SEQ ID NO: 3976 - DNA, 687 bp, Artificial Sequence
  P804 (35S::G25)
cgcaaatacgtcttgttctagtttggagttggaagcgtaaaaaacaaaaaacaaaaatgtgtgggggagctatcatttctgatttcatctggtcgaaatctgagtcagaaccgagtcaactcggctctgttagcagcaggaagaagcgtaaacccgtctcaggtacaacacttttggtttcgagttttgtttttttattataaaacctaatatatccgtttctgattcgggaatatcttcgaacagtgagtgaagaaagagatgggaaacgagagaggaagaatctgtacagagggataaggcagaggccatggggcaaatgggcagcggagattcgtgacccgagcaaaggtgtacgtgtctggcttggcacattcaaaaccgccgacgaagctgctcgagcctacgacgttgctgccatcaaaatccgtggccggaaagccaaactgaatttcccaaacactcaagtagaagaagaagccgatactaaaccaggggggaatcaaaatgagctgatttcggaaaaccaagtagagagcttatcggaggacctgatggcattggaggattacatgagattctatcagattccggttgccgacgaccaatcggcgaccgatattggaaatttatggagctatcaagactccaattaaatctcttatttcccggccggtttgctcactc

SEQ ID NO: 3977 - DNA, 907 bp, Artificial Sequence
  P806 (35S::G22)
ctcatacacaactacttatctcttcacttcattagtctccaagaagaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatgg

SEQ ID NO: 3978 - DNA, 1547 bp, Artificial Sequence
  P807 (35S::G26)
catagatgcagagaatagacatctttgctggttctttggcttgtacccaaacccatctttgacttcaaaaataaaataaaaataatcataattgacatcatcggataatgcatagcgggaagagacctctatcaccagaatcaatggccggaaatagagaagagaaaaaagagttgtgttgttgctcaactttgtcggaatctgatgtgtctgattttgtctctgaactcactggtcaacccatcccatcatccattgatgatcaatcttcgtcgcttactcttcaaggtaatttcatcagatcctttttccaataattttaattgctatactttataactcgagtgattgtcttttccattggtgattctctttacacataggaatgatttaatcttggattttgcaattggtaatcctttagtggctgcagcatggccttgatcaaatagagatataatttcatgtatggccacaatgcattagttcaatttactatatgatttttttaatgaatgttcatggttagattttcttgaaaaaacctgtcggctttattggttggacaaaattgatcatatttggctttcggacaaatatgattggcaaggcttggttgcaatggtcgtattttggttgagataactagccagagagagttttaggattgtaacatggggaaaacgtatttaaaatgatcaaacttaatttatatcctaattatatcattggtgtgatacataagtatatatatagttaattaccaattacgagagagaggaatgtataaatgtaggtttggcctaatatatagatttcataagtagatgtagaagaggggaataaaagttgatgtagaatgatcatatcatatgattcaaacgccctttaataatctttacgaaatgcctctacaccgatagtatacgttatattcatagacatgcacgtcacatttaagtcaccattttcatgacaagagtgaacttacaattttcatcatttttctacagaaaaaagtaactcgaggcaacgaaactacagaggcgtgaggcaaagaccgtggggaaaatgggcggctgagattcgtgacccgaacaaggcagctcgtgtgtggcttgggacgttcgacactgcagaagaagccgccttagcgtatgataaagctgcatttgagtttagaggtcacaaggccaagcttaacttccccgagcatattcgtgtcaaccctactcaactctatccatcgcccgctacttcccatgatcgcattatcgtgacaccacctagtccacctccaccaattgctcctgacatacttcttgatcaatatggccactttcaatctcgaagtagtgattccagtgccaacttgtccatgaatatgctgtcttcttcgtcttcatctttgaatcatcaagggctaagaccaaatttggaggatggtgaaaacgtgaagaacattagtatccacaaacgacgaaaataacatgttaatggcataaatatctcttcgtccaagttatcaaacgcattgacctccggct

SEQ ID NO: 3979 - DNA, 1130 bp, Artificial Sequence
  P810 (35S::G230)
gacctctctaaccatcacacctcgtataaatactctctcctcttcatacttatcctctcaacaaaaatcgtttcgttcttttccaaaatccccaaacaatagaaacgcgttttaaacgatttgattagttttaaattaaaaagaagatccgagcgatgtctggttcgacccggaaagaaatggatcggatcaaaggaccatggagtcctgaagaagacgatctgttacaatcgttggttcagaagcacggaccaaggaactggtctctgataagcaaatcaatccctggacgttccggtaaatcttgccgtctccgttggtgtaatcagctttctccggaggtagagcaccgtggattcacggcggaggaagatgatacgattatactagcgcacgctcggtttggtaacaagtgggcgacgattgcacggcttctcaatggtcgcactgataacgcgattaagaatcactggaactcaacgctgaagcggaaatgtagcggcggaggcggcggaggagaggaagggcagagttgtgatttcggtggtaatggagggtatgatggtaatttaactgatgaaaaaccgttaaaacggagggcgagtggtggaggaggagttgttgtggtgacggcgttaagtccaacgggatctgacgtcagcgagcaatcgcaatctagtggatctgttttaccggtttcttcttcttgtcatgtttttaaaccgacggcgagagctggtggagtggtgattgagtcatcatcgccggaggaggaggagaaagatccgatgacttgtttgaggttgtctttgccttgggtcaatgagtcaacaactccaccggagttgtttccggtgaagagagaagaagaagaagagaaggaaagagagatttctggacttggtggagattttatgacggtggtgcaggagatgattaagacggaggttaggagttacatggcggatttacagctaggaaacggcggaggagctggaggaggagcaagttcgtgtatggtgcaaggaactaatggtcgtaatgtagggtttagagagtttattggattaggtaggatcgagtagtgagtgagaaaagagaagaattgtgtagcaaatgcagagaaagag

SEQ ID NO: 3980 - DNA, 1099 bp, Artificial Sequence
  P814 (35S::G197)
aggcttcaccttcctcttccaacctctctctctctctctctttctcaaaccgtctctccataaagccctaatttcttcatcacaagaatcagaagaagaaagatgggaaggtctccttgctgtgagaaagaccacacaaacaaaggagcttggactaaggaagaagacgataagctcatctcttacatcaaagctcacggtgaaggttgttggcgttctcttcctagatccgccggtcttcaacgttgcggaaaaagctgtcgtctccgatggattaactatctccgacctgatctcaagaggggtaacttcaccctcgaagaagatgatctcatcatcaaactacatagccttctcggtaacaagtgagtcacaaaacaactcctctgttttttttactatcctctgttatgttaaaaagctctgttttttaaactctgttttttttttcttctatcaggtggtctcttattgcgacgagattaccaggaagaacagataacgagattaagaattactggaacacacatgttaagaggaagctattaagaaaagggattgatccggcgactcatcgacctatcaacgagaccaaaacttctcaagattcgtctgattctagtaaaacagaggaccctcttgtcaagattctctcttttggtcctcagctggagaaaatagcaaatttcggggacgagagaattcaaaagagagttgagtactcagttgttgaagaaagatgtctggacttgaatcttgagcttaggatcagtccaccatggcaagacaagctccatgatgagaggaacctaaggtttgggagagtgaagtataggtgcagtgcgtgccgttttggattcgggaacggcaaggagtgtagctgtaataatgtgaaatgtcaaacagaggacagtagtagcagcagttattcttcaaccgacattagtagtagcattggttatgacttcttgggtctaaacaacactagggttttggattttagcactttggaaatgaaatgaaatgaaatactatattaatcaatttatagctgtgaattgtgatataaaagctattaacagactcgttcatggttctc

SEQ ID NO: 3981 - DNA, 870 bp, Artificial Sequence
  P817 (35S::G241)
ccaagaagctcaccaatgcttttgaattctcccacatgtcttttgacaattttagtataaatactcaaaccccttagtcagtcattctcatgttcatcaacagcatttgatctcaagctcataggaatttgatctccacattatatcttgatcatcaccacaagaaaaacatttcaacttcttttatcagcaatcacaaaacaaagagatgggaagagctccatgctgtgagaagatggggttgaagagaggaccatggacacctgaagaagatcaaatcttggtctcttttatcctcaaccatggacatagtaactggcgagccctccctaagcaagctggtatgtaaaaattataatatcaaatttcttaattttgatcaaatttcttacattaattattggtaattattatttacaggtcttttgagatgtggaaaaagctgtagacttaggtggatgaactatttaaagcctgatattaaacgtggcaatttcaccaaagaagaggaagatgctatcatcagcttacaccaaatacttggcaataggtattttacttcaacatataagtatataaccgacacacaagttttattttgttttcttactatatataaatcaccaaaagaaagtaactttattacacacgtctaggtcgcactactattcttttaactacacaatgatcggctctttaattacttttgtattgatgttcttcgttttccttttggtatcatctttagatggtcagcgattgcagcaaaactgcctggaagaaccgataacgagatcaagaacgtatggcacactcacttgaagaagagactcgaagatttatcaaccagctaaacctaagaccatcaac

SEQ ID NO: 3982 - DNA, 1760 bp, Artificial Sequence
  P818 (35S::G206)
cacacttagccatcgtacacttactagttacttccaacatttggcttcctttgctttcacgaatagaaaccttagcttcttccatttcttctttctctcctcgtttaaattagtttttgacaaggaagaaaaagatggggagaagaccatgctgtgagaagataggattgaagaaagggccatggagtgctgaagaagatcgaatcttgatcaattatattagtctccatggccatcccaattggagagctctccctaaactagccggtaaataagccattttatatttgctatttgccatatgtatatattagtaacaaaataattttgtacctagctagcatgtgtattattgttctatagtatatagtagtgtatatttgttgtgtaaagttaataatggtgtttgtgaaatgattagggctacttcggtgcggaaaaagttgcaggcttcgttggattaattatttgagaccagacatcaaacgtggcaatttcactcctcatgaagaagatactatcatcagcttacatcaactcttaggcaacaggtttctcctccttttccattttctgtttttttacttcttcctttgattatatgcgaaattttagattttttggtcctatattctttgaaaccagaaattaaacaagaatttgagaaatcactcacaaatttttctttatttttaatctttgagaagtcaaatcacaagtttttttctttcttttaaagtaagtcaatgcaatttctgtttagtccataactccatatatattacagtgaaaatgatataatgttcatttgtagatgaaggattttgggacatcaaattgtgaaaagtatcattattttggaagtttagtttgttttaactgtggagactagctagctagattacttcacaattttctctttgtatatgtgttgcttttgtcaatatgcgaaattttatatctttgtggggcagagaactgagaagattccaacccgtgattgcctttgtccattaaataatttcaattttttactttcctctaattatactttttattcactagtagacaaagataggcactgtgatcagtgtaagacatgtgcaaattcttttaaccatacgcatgaacttcaataactttccttttgttttactcgctctttgttctcataacaatgtagacgacgtattatgatgattgatgagtcattcatgtgacatttgttttgagtagatggtctgcgatagctgcaaaattgcctggacgaacagacaacgaaattaaaaatgtttggcacactcatttaaagaaaagactccaccacagtcaagatcaaaacaacaaggaagatttcgtctctactacagctgcggagatgccaacctctccgcaacaacaatctagtagtagtgccgacatttcagcaattacaacattgggaaacaacaatgacatctccaatagcaacaaagactccgcgacgtcatccgaagatgttcttgcaattatagatgagagcttttggtcagaagtggtattgatggactgtgacatttcaggaaatgagaagaatgagaaaaagatagagaattgggagggctcactagatagaaacgataagggatataaccatgacatggagttttggtttgaccatctcactagtagtagttgtataattggagaaatgtccgacatttctgagttttgatttgttttagttaaagacttatatatcttcctttgtgacccacatg

SEQ ID NO: 3983 - DNA, 1766 bp, Artificial Sequence
  P819 (35S::G212)
ccatcataagttcactactcataatctctttctctctctcacacacacacacagacacacacaaacatagaaggaatcagagaataaaaaaagaatgagaataaggagaagagatgaaaaagagaatcaagaatacaagaaaggtttatggacagttgaagaagacaacatccttatggactatgttcttaatcatggcactggccaatggaaccgcatcgtcagaaaaactggtactctttctctctctcgcgcgttttgtgattatatatattaactttagtctctagctagttcatatataaatatatctcagttagactaaatttgattcgttgatagggctaaagagatgtgggaaaagttgtagactgagatggatgaattatttgagccctaatgtgaacaaaggcaatttcactgaacaagaagaagacctcattattcgtctccacaagctcctcggcaataggtacataactttatgttactacaatattatacaccatgtctttttatttaatcgatcgttaactgattttttctttcgtcaaatatttgaattgttgttttaaacaaagatttggccggttaagttgatttttaaaaatctaattgaaggattttcttacttgcaaatgtaaaaataaagagagttgacaagtaaagactgttttatttcaattaaactatgtgttcgtggattatttcacatttcaaaaggtgttttcttcacaaaataaatcttaaaaataatcctttgaacttaaaatatgttcaaaattttcaagttgatatatttttctgaagaagaaaagagttgcacaagataaaagtttgtcttctcttcaatgaaactcaaccgatgtgttggtgggttatttcaattttaaaaggtgtttcctccaaaaacaaatctttaagagtatcttttgaacttaaaaatgttcgaacatttcaagtggatatatttaatgaataatagacactttttcataagtgtattagtcgtgcaaacagtcacttctcaaaattcattatagagttagaaacgttttccacaattgaaaaataaaaataaaaaatcctctctatgtatataaatatgcattcatttatgaatcacatacagatgtcgaaataataaaaagaatcataaacatatggtatgttataatttatgttatatggtatgaatttaataaaaatgtcctataatattttttccccaaattcagatggtctttgatagctaaaagagtaccgggaagaacagataaccaagtcaagaactactggaacactcatctcagcaaaaaactcgtcggagattactcctccgccgtcaaaaccaccggagaagacgacgactctccaccgtcattgttcatcactgccgccacaccttcttcttgtcatcatcaacaagaaaatatctacgagaatatagccaagagctttaacggcgtcgtatcagcttcgtacgaggataaaccaaaacaagaactggctcaaaaagatgtcctaatggcaactactaatgatccaagtcactattatggcaataacgctttatgggttcatgacgacgattttgagcttagttcactcgtaatgatgaattttgcttctggtgatgttgagtactgcctttagttgatgttttgaatttgtctttgaatttttgagataaaataacaattaattatggatactaatatcgatatcaatactaccactattacaatctaggagtacgtacttct

SEQ ID NO: 3984 - DNA, 3961 bp, Artificial Sequence
  P821 (35S::G418)
caccaaggaggtatcttcaacttctctaatggattcgaccgatcagattctcccaatttaacaactcagcagaagcaagagcatcaaagggtagagatggacgaggaatcttcagtcgccggaggtaggattccggtctacgaatcagccggtatgttatccgaaatgtttaatttccccggaagcagcggtggaggaagagatctcgacctcggccaatctttccggtcaaataggcagttgcttgaggagcaacatcagaatattccggctatgaatgctacggattcagccaccgccaccgcagccgccatgcagttattcttgatgaatccaccgccaccgcaacaaccaccgtctccgtcatccacaacttccccaaggagccaccacaattcttcaactcttcacatgttacttccaagtccatccaccaacacaactcaccatcagaactacactaatcatatgtctatgcatcagcttccacatcagcatcaccagcagatatcgacgtggcagtcttctcccgatcatcatcatcatcatcacaacagccaaacggagattgggaccgtccacgtggaaaacagcggaggacacggaggacaaggcttgtccttatctctctcatcgtctttagaggctgcagcaaaagcggaagagtatagaaacatttactacggagccaattcttctaacgcatcacctcatcatcaatacaatcaattcaagactcttcttgctaattcttctcaacatcaccatcaagtattaaaccaattccgatcatctccggctgcttcttcctcttccatggcagcggtcaatatcttaagaaactcgaggtacacaacggccgcgcaagagttgttggaagagttttgtagtgttggaagaggatttttgaagaagaacaaacttgggaacagctcaaaccctaatacttgcggtggtgatggtggtggcagctctccttcgtcggccggagcaaacaaggagcatcctcctttatcggcgtctgatcggattgagcatcaaagaaggaaagtgaaactactcaccatgcttgaagaggtatgttcatattaacttttaatattgattttgactttgtctatactctacagtgatattagttcatacattttacgtaaaattgttttcgttgcatttcgataagattcataaattgatccaagagttatgacaaagaaacaagaaacctgatatgactgaattggtcttttgttttctcgattaactacttatttttgattattttggtagagtttgattgcgcaatcctaccatcatttgtttaaaattaaaattaatttaatcattttgctcgtgtgacggtcgtattagaaagtatattgaatattttgatgcttagcgtttggtggaatcgattaatcaaagaaaatgcattaaataattacgattaattatgtaattggcgtttccttctccatataagctactctccagttacgtcctaaagctaacccttgacgttacttatttgtttacccataattgaattatctactttttagttgaccttgcttttttctcactagaaataaatattttagtttatgctcgaggatacgataaaatgtgctgttggtaggattgcgcaaacattgaagtatattctctggtcaataatttgtctatataatatcttattttcttattttgtctcgtttaaaggtaactaattaatctcattagtttatttattagatgatgctcgtacacaagcataggttcccgtgataaaatctacactaaataataatcacgtgaacatataacacaacacacacgagttaacaataacattaattaaaagaaaaaggcaaatattgatatttatggattgtataatgtatagttttgtttcgttggcaggtggaccgacggtacaaccattactgcgagcaaatgcagatggttgtgaactctttcgacatagtaatgggccacggtgcggcattaccgtacaccgcattggctcaaaaagctatgtcaagacattttagatgccttaaagatgcagttgcggctcagcttaagcagagttgcgaacttcttggggacaaagatgcagcgggaatctcttcttccgggttaacaaaaggtgaaactccgcgtttgcgtttgctagagcaaagtttgcgtcagaaccgtgcgtttcatcaaatgggtatggaacaagaagcttggcggccacaacgcggtttgcctgaacgctccgtcaatatacttagagcttggctcttcgaacatttccttcacccgtaagtcaattttttctttctttctcgttatttattaattattatagagaaactgaattttgaaaaaagctgagaaaaagtatttattttctcgttatttcacctctactttctttagtactatgtctctagaattttgctattttattgttaacgagagtgaacgaaaaaatggaaataaagcaaaagagtagtgtttttgtactattttcacctctctgacaaattgctttaagagtaaaaccaaaccaaaaaagccaagtaaaaaaaaaaaaactggatcgatgatatgtaatcatcaacttttcttttgtctgttagattctcacgcccttgttaggaaaaagtctgtactttttcttgcgtctacttgattgtattgtatatagtgaaaagataaagaaaataaattacattgagtttattagggcaaagatagagagtgatgtcattttctggtctctttctcaggtatccaagtgatgcagataaacacctattggctcgacagactggtttatccagaaatcaggtcagtctacatatatacatatagccaacgatataatgaaatttaaaatctccatgaatcaaatacatatgcctctacttcaccaagttgtgttagctgagtatactcttaatcagacaatcaaatgaccacagtctggattacgaattcttaaccgcgtgttttaaagatttgttttaaacccatcattctatgtttataaataaactccacaatagtacacagttatatatataactacaatattaatttatcacccaaacccatttcataattttcataaacatatacatgcttgttataaacatcaaataataaatactagtagttactcaaaacgaatttgactaagccaaaattatttgacaccatgtacgagtacactaactagtagcctgagatgactctattgcatggtttttgtttcttatctttgtttggtttgtgatatgacagaggaacaccatgtgttttgccttccactcaccattagcttttcttgggattcgtctttaaattattatagcatatttatatatacaaaaacataggagagagagaaagagatcgacattaaagacgcaaaagggtccatttttcctcaagtacatcaaagtttgcagctttcaattgtcccaaagaaaccctcaatttcttgtatccctacattaaataaccaaatgacaaataaacaaaaagagccctcaattttatttcgatattataatgattcaactagtgaaaattttgtctcttttattcaggtatcaaattggttcataaatgctagggttcgtttatggaaaccaatggtggaagaaatgtaccaacaagaatcaaaagaaagagaaagagaagaggaattagaagagaacgaagaagatcaagaaacaaaaaacagcaacgacgacaagagcacaaaatccaacaacaatgaaagcaacttcactgccgttcggaccacttcacaaactccaacgacaaccgcaccagacgcatcagacgcagacgcagcagtagcgacaggccatccgtctaagatccaacattaatgcttacgaaaacgacgcttcatcacttctactcccttcctcttattccaacgccgccgctcctg

SEQ ID NO: 3985 - DNA, 1487 bp, Artificial Sequence
  P825 (35S::G409)
ctcagaactcagaagtagttgttgttttatttctgttgatcaaaaatggaatccaattcgtttttcttcgatccatctgcttcacacggcaacagcatgttcttccttgggaatctcaatcccgtcgtccaaggttcttttctcactctcttaatcttatttcatcatcttggaacacattacttttcggtgaatttcccctgtttttgtgtataaaacgttaggaacacacatacacacacatgagaaccaatttgaatatgaatacctcattcgattattgacagcagttgttcgtttgaatttgtgaaggaggaggagcaagatcgatgatgaacatggaggaaacttcgaagcgaaggcccttctttagctcccctgaggatctctacgacgatgacttttacgacgaccagttgcctgaaaagaagcgtcgcctcactaccgaacaagtagattctctcactatccacaataataattaacgatccactattcaaaaacaagtttgatagattctcattatattatggtaaaaggtgcatctgctggagaaaagcttcgagacagagaacaagctagagcctgaacgcaagactcagcttgccaagaagcttggtctacagccaaggcaagtggctgtctggtttcagaatcgccgagctcgttggaaaacaaaacagcttgagagagactacgatcttctcaagtccacttacgaccaacttctttctaactacgactccatcgtcatggacaacgataagctcagatccgaggtacttatacatgggactattatttatctcaacaagattacaaattgaatgatttaccttaattggtccaaaggagaaaaataaaaaaagcatcaagtgaaaagagaatatgcttttcctatttttcaacacaagctgatagagagaatccatcatcatatatatataaattagaggagagactagaaaaagaaagaaaattggggaatcaaatcaatcaacgagtttaattatctttttatgggaggaggttgcttgtgttgaccgttgtgattaaagttagaatctttccaacccgacaggttacttccctgaccgaaaagcttcagggcaaacaagagacagctaatgaaccacctggtcaagtgcccgaaccaaaccaacttgatccggtttacattaatgcggcagcaatcaaaaccgaggaccggttaagttcagggagcgttgggagcgcggtactagacgacgacgcacctcaactactagacagctgtgactcttacttcccaagcatcgtacccatccaagacaacagcaacgccagtgatcatgacaatgaccggagctgtttcgccgacgtctttgtgcccaccacttcaccgtcgcacgatcatcacggtgaatcattggctttctggggatggccttagaaaaccactctgataataaatgtgtgtttatttaagttcaagagtcatcttcttg

SEQ ID NO: 3986 - DNA, 4600 bp, Artificial Sequence
  P829 (35S::G390)
ctccaaccattaccatctcatgaacactctcacaggaggctctctcttctcagagagcctacccatctaatatttcttcatctgagtctcttttacttctctcaaagtatcgatctttattcttctttttgtaaaccctctctctctctctgatttctactgacctgtttggaagatatgatggctcatcactccatggacgatagagactctcctgataaaggatttgattccggcaagtacgttagatacacgccggaacaagttgaagctcttgagagagtttatgctgagtgtcctaaacctagctctctgagaagacaacagcttattcgtgaatgtcccattctctgtaacatcgagcctcgacagatcaaagtttggttccagaatcgcaggttattatttctttattaattgtctttaatggaatgttttttgtgttctttgattgtttctgtaattataaaattgaatttcttttgtttgtatttggagacaaaaatgttcttgtctgacaatgtttttggtaatcttcttgtttttggtctaattggtgattgttaagcttttgaaactttcagatctatgtctataaatttgtttttctctttttgcttattaggcttttgttgacacagttgaaagttaaaatcacaaggaaaagtgacagctaatcaaactgtctttgatgagctttaaaacgcctctctctttttttccttctgcagagaatatgttggaaattacattatcttttgttctttatgtcattctggtatcattctaaagcaaaaaagtgtgtgtttcttctgttcatttttctattatttcaacacatttatcatactgctataggtttgtctttaacttttctggtttcttttggttgttttgttgactttttagatgtcgagagaagcagaggaaagagtcagctcgtcttcagacagtgaacaggaagctgagtgctatgaacaagcttttgatggaagagaatgatcgtttgcagaagcaagtctccaacttggtttatgagaatggattcatgaaacatcgaatccacactgtaagtccttgaatcccttttgctaaatgcattgttgagttgttatctttgatgcttgtatatgtatttgttctttaagagttctctgttgttagagagtgactggtgaaatctctgtgttgtgtcttaggcttctgggacgaccacagacaacagctgtgagtctgtggtcgtgagtggtcagcaacgtcagcagcaaaacccaacacatcagcatcctcagcgtgatgttaacaacccagctaagtaaggaaggctctttttttgtttgtgaatttctcattgtgacattatgagaagagactaaatggagtgtttttttggtagtcttctctcgattgcggaggagaccttggcggagttcctttgcaaggctacaggaactgctgtcgactgggtccagatgattgggatgaaggtagataagttgaagtattttaacgttttcatatgtggaaatgaagtggtttttagaaaatgttttaatatgtattttcatggttatgtatgtagcctggtccggattctattggtatcgtagctgtttcacgcaactgcagtggaatagcagcacgtgcctgtggcctcgtgagtttagaacccatgaaggtaatggtgttttctttttattttaatcttgtgttgtaagaagcggaaattctacgaaggcaatctaaacttcaaatactgtgtaggtcgctgaaatcctcaaagatcgtccatcttggttccgtgactgtcgatgtgtcgagactctgaatgttatacccactggaaatggtggtactatcgagcttgtcaacactcaggtctgtttcataaatccatgagtgttgtttttgttcctttaaaatgtaatgatcattattcatggttggttatcagatttatgctcctacaacattagcagcagctcgtgacttttggacgctgagatatagtacaagtctagaagatggaagctatgtggtgggtattaggacctggttttgttcatctatgattctatttattagatttgccttatatttgcttttttgccttcaggtctgtgagagatcactcacttctgcaactggtggccccaatggtccactttcttcaagcttcgtgagagccaaaatgctgtcaagcgggtttcttatccgtccttgtgatggtggtggttccattattcacatcgttgatcatgtggacttggatgtaagcatattggatttgtaatagcacattaggtttcgtaaaagccttctatttatgttgattgatacgtttttttggtttggtaggtctcaagtgttcctgaagtcctcaggcctctttatgagtcttccaaaatccttgctcaaaaaatgactgtcgctgtaagttccatataaaccttatccacccgtgacctgattaggctctctttatgagttttacttccacatttcaggctctgagacatgtgcgccaaattgctcaagagactagtggagaagtccagtatagtggtggacgccagcctgcagttttaaggactttcagccagagactctgccggtaatacatttccttgataagcttagttttattttctaaagcattgttctaattgcttttcttgaaattcaggggtttcaatgatgctgtaaatggttttgtcgatgatggatggtctccaatgagtagtgatggaggagaggatattacgatcatgattaactcttcctctgctaaatttgctggctcccaatacggtagctcatttcttccaagttttggaagtggtgtcctctgtgccaaagcttctatgctgttgcaggtgcctatatcatgttttgacacttgtgaatagacaaaagaaccggtttcttcaatttctgacatcattctcttttttatctgctcttgaagaatgttccaccccttgtattgattcggttcctgagagaacaccgagctgaatgggcagactatggtgtcgatgcctattctgctgcatctctcagagcaactccatatgctgttccatgcgtcagaaccggtgggttcccgagtaaccaagtcattcttcctctcgcacagacactcgaacatgaagaggtacaaagaatctcaagaacattttccttgttgtctattcttttgccatgcctataatcctattttgcttacttgtttctcagtttctcgaagtggttagacttggaggtcatgcttactcacctgaagacatgggcttatcccgggatatgtatttactgcaggtttgctttatactaaagacactcagggattcttaaagatgagttattgaaattgaattcttggtttcttttttgcttttgtccagctttgtagcggcgttgatgaaaatgtggttggaggttgtgctcagcttgtctttgccccaatcgatgaatcatttgctgatgatgcacctttgcttccttctggtttccgtgtcataccactcgaccaaaaaacaaatccggtaaaaagaaaactgtttatgataagaaatttgatatcttgaaattgacacagtcctttttcttttattcctgtatgtaacgttacagaatgatcatcaatctgcaagtcgaacacgggatctagcatcgtccctagatggttccaccaaaaccgattcggaaacaaactctagattggtcttaacaatagccttccagttcacgtttgataaccattccagagacaatgttgctacaatggcgagacagtatgtgaggaacgttgttggttcgattcagagagtggctctagccattacgcctcgtcctggctcaatgcaacttcccacttcccctgaagctctcactcttgtccgttggatcacccgtagttacaggtactcttcttagaaccttaatctaaagacttgtaacaatatagaatgtgcttatctcatttaataactcaataaaatgtttttctccgatgttttagtattcatacaggtgcagatctgtttggagctgattctcagtcctgtggaggagacacattgcttaagcaactctgggaccatagtgatgccatattgtgctgctccctgaaaactaatgtaagaattctgtttttttaagaggtgctcaatctagtttatggttcggtttgggaattgtctgattattttttggttctcaggcctcaccggtattcacatttgcaaaccaagctggtttagacatgcttgaaactacacttgtggcacttcaggatataatgctcgacaaaacacttgatgactctggtcgtagagctctttgctccgagttcgccaagatcatgcagcaggttaaacattttctagctagtcttttaagtctttccctggaaaatactaagtttggattgaatcttcttcagggatatgcgaatcttccggcaggaatatgtgtgtcgagcatgggcagaccggtttcgtatgagcaagcgacggtgtggaaagttgttgatgacaacgaatcaaaccactgcttggcttttaccctcgttagttggtcgtttgtttgatgaagg

SEQ ID NO: 3987 - DNA, 789 bp, Artificial Sequence; identical to SEQ ID NO: 743
  P836 (35S::G991)

SEQ ID NO: 3988 - DNA, 2104 bp, Artificial Sequence; identical to SEQ ID NO: 251
  P841 (35S::G278)

SEQ ID NO: 3989 - DNA, 1832 bp, Artificial Sequence
  P865 (35S::G636)
cgatgatgcaactgggtggtggtactccgaccactacagcggcggctacaaccgtcacaactgctacagcaccaccgccacaatcaaacaacaacgattcagcggcaacagaagcagcggcagcagcggttggggcgtttgaggtgtcggaagagatgcacgaccgtgggtttggaggaaatcgttggccgcggcaggaaacgctagcgttgttgaaaatacgatctgacatgggaatagcgtttcgagacgctagcgttaaaggtcccttatgggaagaggtttctaggaaaatggcggagcatggttacataagaaacgcaaagaaatgcaaagagaaattcgagaacgtttacaaataccacaaacgaaccaaagaaggtcgtaccggaaaatccgaaggcaaaacttatcgcttctttgatcaattagaagctctcgagtctcaatctacaacctcactccaccatcatcaacaacaaacgcctcttcgaccacagcaaaacaacaacaacaacaacaacaacaacaacaacagctccatattttcaactcctcctccggtaacgacagttatgccgacgcttccttcttcatcaattcctccgtatactcagcagattaatgtaccttcgtttccaaacatctccggtgattttctatcggataattctacatcgtcttcgtcttcttattcgacttcttctgacatggagatgggtggtggaactgcgactacaaggaagaaaaggaagaggaaatggaaggtgtttttcgagcggttgatgaaacaagtagttgataaacaggaagagcttcaacgcacattcttggaagctgttgaaaagcgagaacacaagagattggttagagaagagtcttggagagttcaagagattgccagaatcaaccgcgagcacgagatcttagctcaagaacgctctatgtccgctgcaaaagacgctgctgttatggcctttcttcaaaaactgtcagagaaacaaccgaatcagccacaaccgcagcctcagccgcaacaagttcgaccatcaatgcagcttaataacaacaatcagcagcaaccgcctcaacggtctcctccaccgcaacctcctgctccgcttccgcagccaattcaagcggttgtgtcgacgttagacacaacgaaaacgcacaatcgtggtgatcagaatatgactcctgcagcttcagcgagctcgtcgcggtggccgaaagtggagatagaagcattgataaagctgaggacgaatcttgattcgaaatatcaagaaaacggaccaaaaggaccattgtgggaagagatatcagcgggaatgagaaggttaggattcaacaggaactcaaagagatgcaaagagaaatgggaaaacataaacaaatacttcaagaaagtcaaagagagcaacaagaaacgtcccgaagattccaagacttgcccttactttcaccagcttgatgctttatatagagagaggaacaaattccacagcaacaacaacattgcagcttcttcttcatcttccggtcttgttaaaccggataattctgttcccttgatggtccaaccagagcagcaatggcctccggctgtaacgactgcgacaactactcccgcagcggctcagcctgatcagcaatctcagccgtcggagcagaactttgatgatgaagaaggtacagatgaagagtacgacgatgaagatgaggaagaggagaatgaagaagaggaaggaggtgagttcgagcttgtgcctagcaataacaacaacaacaagacgacgaataatctgtaatgatgatgattcgagttc

SEQ ID NO: 3990 - DNA, 3283 bp, Artificial Sequence
  P866 (35S::G657)
gctttccttgctaactatgaagcgtgagatgaaagcacctactactccactagagagtctccaaggtgacctcaaaggaaaacaagggtacgcttacatctctcttccttttcttctattgggtttcaatgttgaagttggattgcttttggcaccaaattttgcattcaactagacattctcaggttaataatgatgcaagctctttgtgacattttcataggaggacatctggccctgctagacgatctaccaaaggacaatggacacctgaagaggtgcgttccgttcctgtgtcttttttgttgtctatctgattcttccatgcttcatattatgtatcctggaacactgcctgagcttaatcagttgtctctgtaacaccctattgttgcttcgcacagttccatttaactagttgacattagctatcctttgcatctattgaagaattcgtctctatgaagttttctgttgtatcaattctgtttttctggatcaggacgaagtcttgtgtaaagctgttgagcgttttcaaggaaagaactggaagaagataggtaaatcgaatagcaaattctgatttcttcttgttttcccagtttgtttttccagcgtatgttaagatcatatcaataataatctactttagctgccatgtttatttgtagtctttagttagtacggtgaaagtaatatgtggttttatttgattcaccttttcagctgaatgttttaaggatcggactgatgttcagtgtcttcatagatggcaaaaggtcttgaacccagagcttgtgaaaggaccgtggtcaaaagaggtgattttgtgaattgctttatatgctttactcggtttgagtctaatacaccttagcatttgtaatgtgttccatgacattacttttccatgttttgaaggaggataacacaataattgacctggttgaaaaatatgggccaaagaaatggtctactatatctcagcatttacctgggcgcataggaaagcaatgtagggaaaggtaatgcaaaggctctcaacttctttccgataaaatgatatttacatacattgggtggtacttcaacgcacataaacaatattgtgggtgatgtaggtggcataaccatcttaaccctgggattaataaaaatgcatggactcaggaagaggaactgactcttattcgtgcgcatcaaatttatgggaataaatgggcagagcttatgaaatttttgccaggaaggtaaatatgtcttttccatgggtcctagtataacaacataggtgtaacatgtccgtaaaattggtggcctcataaatgaaataataggtttttgatgctggtagttgtggtctatcgttcctgctttggtgatttgcttattttttcttacgttcctgtaggtcagataattcgataaaaaatcattggaacagctcagttaagaagaagttggattcctactatgcatcaggtcttttagatcagtgtcaaagctcgccattaattgcccttcagaacaaatctatcgcttcatcttcctcgtggatgcacagcaatggagatgaaggtagttcaaggccaggggttgatgctgaggaatcagaatgcagccaagcttcaactgttttctcacaatcaaccaacgatttacaagatgaagttcaacgtggaaatgaggaatattacatgcctgaatttcattcaggaacggagcagcaaatctcaaacgctgcatctcatgcagaaccgtactacccttcctttaaagatgtcaaaattgttgtccccgaaatttcttgtgaaacagaatgttcgaagaagtttcagaatcttaattgttctcacgagctaagaactaccacagctacggaggatcaattgccgggtgtatctaatgatgctaaacaggaccgtggtctagagttattgacccataacatggacaacggtggaaaaaaccaagcacttcaacaagattttcaaagttcagtaagattaagtgatcaaccttttttgtcaaactcggacacagatccagaagctcaaactttgatcacggatgaggagtgttgtagggttctttttccagataacatgaaagatagcagtacatcttctggtgagcaaggtcggaatatggttgaccctcaaaacggcaaaggatctctttgttctcaggctgcagaaacccatgctcatgaaactggaaaagttccagctttaccgtggcatccttcaagttctgagggcctggcgggtcataattgtgtccctttgttggattcagacttgaaggactcacttttaccccgtaatgattccaacgctcctatacaaggttgtcgcctttttggagctaccgaattagaatgtaagactgatacaaatgacggtttcatcgatacttacggacatgtaacttcccatggcaatgatgataatggtggtttcccagaacaacaggggctgtcatatattcccaaggattctttgaagctagtacctttgaatagtttttcttctccttctagagtgaacaagatttattttcctattgacgataagccggctgaaaaagacaaaggagctctttgttatgaacctccacgttttccaagtgcagatattcctttcttcagctgtgatcttgtaccatcaaatagtgacttacggcaagagtacagtccctttggtatccgtcagttgatgatttcttcaatgaattgtacaactccgttaaggttatgggattcaccgtgtcacgataggagccctgatgtcatgcttaatgatactgccaaaagttttagtggtgcaccatccatcttaaagaagcggcatcgagacttgctttcacctgtgcttgatagaagaaaagacaaaaagcttaaaagggctgcgacttcctccttggctaatgatttttcgcgcttagatgtaatgcttgatgaaggagatgattgcatgacctctcgtccgtcagagtctcctgaagataaaaatatatgtgcctccccttccatagccagagataacagaaattgtgcatcagctcggttatatcaagaaatgattccgatagatgaggaaccaaaggaaaccttagaatcaggtggagtgacttctatgcaaaatgaaaatggatgtaatgacggtggtgcttcagctaaaaatgtaagtccgtctttgtccttgcatattatctggtatcagttataaaatcccagtcatctcattctctgatgtctatagctgtaaggtgcaatgtctgg

SEQ ID NO: 3991 - DNA, 1419 bp, Artificial Sequence
  P868 (35S::G772)
tatgggtcgcgaatctctggctgttgtgtcctcgccgccatcggcgactgcgcccagtactgctgtgtcggctacctcgcttgctcctggctttcgatttcatccgactgatgaggaactcgtgagctattacttgaagaggaaggttctgggtaaacctgtacgcttcgatgcgattggagaggtagatatctacaagcatgagccctgggatttagcagtgttttcgaagttgaaaactcgggaccaagaatggtacttcttcagtgcgttagataagaagtacggtaatggtgctaggatgaatcgagcaactaacaaagggtactggaaagcaactggaaaagacagagaaatccgccgggatattcagttgctcggtatgaaaaagacgcttgttttccacagcgggcgtgctccagacggccttcggactaattgggtcatgcacgagtatcgccttgtggaatatgaaactgaaactaacggaagcctgctgcaggatgcatatgtgttgtgcagagtgtttcacaagaataacattgggccaccaagtgggaacagatatgcgccattcatggaagaagaatgggctgatggtggaggagctctgattccaggaatagacgttagggtcagggtagaggctctaccacaagccaatggaaacaaccagatggaccaggaaatgcattcagcaagcaaggatctcattaacatcaacgagctaccgagagatgctactccaatggacatcgaacctaaccaacagaatcatcatgagagtgccttcaagccacaggagagtaacaaccatagtggttatgaagaagatgaggacacactcaaacgcgagcacgcagaagaagatgagcgtcctccttctctatgcattctcaacaaagaagctccactacctctcctgcaatacaaacgtagacgccaaaacgagtccaacaacaactcaagcaggaacacacaggaccattgttcgtccacaataacaaccgtcgacaatacaaccaccttaatctcatcatctgctgctgctgctaccaacactgccatctctgcattgcttgagttctcacttatgggtatctccgacaagaaagaaaaccagcagaaagaggaaacttctcctcctagtccaattgcatctcctgaagagaaggttaatgatctccagaaggaggttcaccagatgtctgttgaaagagaaactttcaagcttgagatgatgagtgcagaggctatgatcagcattctccagtcaagaatcgatgcgctgcgtcaggagaacgaggaacttaagaagaagaacgccagtggacaagctagttaaaccaccgcaacatctctccaggtgtcttcttcttcttcttcttcttctttgcctcttagctgtaatcttcttaa

SEQ ID NO: 3992 - DNA, 2473 bp, Artificial Sequence
  P873 (35S::G837)
ttggggagatctgaggcaaccctttttctctggtgcatgtgactagggattgtgccgtgggtttaggatcatggcaatggggaagtattctcgtgtagacgggaagaagtcatcgggatatggcttaaccattaccatcgttttaattgtttctctatgtttggttggggcgtggatgttcatgtcttcatggtctgctccaactgagtctattgacttctctgcaaacgagaggacaaaagatgtagatactactaagagtgatttcaaaagtgaagaggttgatcgaggttccaagagttttccggatgaaaagaatgaggagacggaggttgtgacagagaccaacgaagagaagactgatcctgagaaatctggtgaggagaactctggtgagaaaacggagtcggctgaggaaagaaaggagtttgatgacaaaaatggtgatggggatagaaaaaatggagacggtgagaaagacacggaatcagaaagtgatgaaaccaagcaaaaagagaaaacacaactggaagagagctcagaagaaaacaaatctgaggatagtaatggaaccgaagagaatgctggtgaatctgaagaaaacaccgagaagaagtcagaagaaaacgctggtgaaactgaagagagcactgagaagagtaaggatgttttcccagctggtgaccaggctgaaatcacaaaggagtcaagcactggaagtggggcttggtctacccaattggtggaatcccagaacgagaagaaagcacaagtgtcctcaattaaatggaaagtctgcaatgtgacagctggaccagactacatcccttgccttgacaattggcaagctatcagaaagcttcattcgacaaagcattatgaacatcgtgagaggcattgtcccgaggagtctccacgctgccttgtttctcttcccgaagggtataagcgatccatcaagtggcctaagagcagagaaaagatctggtacaccaatattccacacaccaagcttgcagaagtcaagggacatcaaaactgggtgaagatgagtggtgaatacttaacattccctggtggaggtactcaattcaagaatggtgctcttcactacattgatttcctccaagagtcatatcctgatattgcttggggaaataggactcgtgttatattggatgttgggtgtggggttgctagctttgggggatatctttttgacagagatgtactcgctttgtcatttgcacccaaagacgaacacgaggcacaggtgcaatttgctctggaacgtggtattcctgcaatgtcaaatgttatgggaaccaagagattaccttttccaggatctgtttttgaccttatccattgtgctcgttgtagagttccttggcatatcgaaggtggtaaactacttttggagttgaaccgtgcattgaggccgggtggtttctttgtctggtcagcgactccagtctataggaagactgaggaagatgttggcatatggaaagctatgtcgaagctaacaaaggcaatgtgctgggaactgatgacgattaagaaagatgaactgaatgaagttggtgctgccatttaccagaagccaatgtcgaataaatgctacaatgaaagatctcaaaatgagccacctctctgcaaagactctgatgatcaaaatgccgcctggaatgttccacttgaggcatgtattcacaaagtaacagaagattcatcaaaacgcggagcagtttggcctgaaagttggccggaaagagtggagacggttcctcagtggttagattctcaggaaggagtatatggaaaacctgcacaagaggatttcacagcagaccatgaacgctggaagactattgtttcaaagtcatacctcaacggtatgggaatcgattggtcttatgttagaaatgtgatggacatgagagcagtctatggaggttttgctgctgcattgaaggatctgaaactgtgggtgatgaatgtagttcctatcgactcacctgatacccttccgattatatacgaacgtggtttgtttggaatctatcatgattggtgtgaatcattcagcacttaccctcggacttacgacctccttcacgctgatcatcttttctcttcactgaaaaagaggtgcaacttggtgggcgtgatggctgaagtagaccggattcttagaccacaaggaactttcatagtaagagatgacatggaaacgataggagaaattgagaagatggtgaaatcgatgaaatggaatgtaagaatgacacattccaaagatggagaaggattgctctctgttcagaagtcatggtggcgtcctacagaggccgagaccattcagtcggcaatagcttgagatcaaggaaacgaagaagagtgtgggttaatatagtcgacagttgttccttttacgatccaattgattgtttcttacatgtattagtcg

SEQ ID NO: 3993 - DNA, 535 bp, Artificial Sequence
  P893 (35S::G30)
ctcttctgacgcacaacagtatatacacatacacagatatatggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataaagggaatacaatcggtattaactgaaagttatgtgaaagaccattttcagttataacaaataaaataaaatcccaagcgtacaaagctgtttc

SEQ ID NO: 3994 - DNA, 505 bp, Artificial Sequence
  P894 (35S::G47)
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 3995 - DNA, 868 bp, Artificial Sequence
  P895 (35S::G147)
aaatcatcagatagaaggaaatattctgattgagagatggctcgtggaaagattcagcttaagaggattgagaacccggttcacagacaagtgactttttgcaagaggagaactggtcttctcaagaaggctaaggagctctctgtgctctgtgatgccgagatcggtgttgtgatcttctctcctcagggcaagctctttgagctcgctactaaaggaacaatggagggaatgattgataagtacatgaagtgtactggtggtggtcgtggttcttcttctgctacttttactgctcaagaacaacttcaaccaccaaatcttgatccgaaagatgagatcaacgtgcttaagcaagagattgagatgcttcagaaagggataagctatatgtttggaggaggagatggggctatgaatcttgaagaacttcttttgcttgagaagcatcttgagtattggatttctcagattcgctctgctaagatggatgttatgcttcaagaaattcagtcattgaggaacaaggaaggagtcctcaaaaacaccaacaagtatctcctcgacaagatagaggaaaacaacaatagcatattagatgctaacttcgcagtcatggagacaaactattcctatccgctaacaatgccaagtgaaatatttcagttctagaccatagggtatttgaagactatgtctcacgaatttaaataaccttggtaagtataatatagtgttgttaaatcacacataattaaaataaagcctgtggaacttcgctaggcagttgaaaatctatccgtatgttttatcctcttgttttacatttgttggtgtgaagatgaaatgactgcaagtgtggtgtgta

SEQ ID NO: 3996 - DNA, 959 bp, Artificial Sequence; identical to SEQ ID NO: 109
  P896 (35S::G152)

SEQ ID NO: 3997 - DNA, 883 bp, Artificial Sequence
  P909 (35S::G442)
tttaatagtgattgtactgcgctccgtaatattttctacagtttgtacgtgttgtgtttttccaatggaaaaggaagataacggatcgaaacagagctcctctgcttctgttgtatcctcgagaagacgaagaagagtggttgagccagtggaagcgacgttacagagatgggaggaagaaggattggcgagagctcgtagggttcaagccaaaggttcgaagaaaggttgtatgagaggaaaaggtggaccagagaatcctgtttgtcggtttagaggtgttcgacaaagggtttgggggaaatgggttgctgagatacgtgaaccagtgagtcaccgtggtgcaaactctagtcgtagtaaacggctttggcttggcacgtttgctactgcagctgaagctgctttggcttacgacagagctgctagtgtcatgtacggaccctatgccaggttaaatttcccggaagatttgggtgggggaaggaagaaggacgaggaggcggaaagttcgggaggctattggttggaaactaacaaagccggtaatggcgtgattgaaacggaaggtggaaaagactatgtagtctacaatgaagacgctattgagcttggccatgacaagactcagaatcctatgactgataatgaaatagtgaacccagcagtgaaatcagaggaaggttacagctatgatcgattcaaattggataacggattgttgtataatgaacctcaaagctccagttatcaccagggaggtggattcgattcatattttgagtatttcagattctagcttaggatttatgctgcatcaatatactatgactatgagactatgttttttacattgttagtttactccattttcatttatctt

SEQ ID NO: 3998 - DNA, 779 bp, Artificial Sequence
  P912 (35S::G490)
acccttgttcttgccaaactctacatcttcaaagatttttcatcatctgttgtgaaatataacatgaggaggccaaagtcatctcacgtcaggatggaacctgttgcgcctcgttcacataacacgatgccaatgcttgatcaatttcgatctaatcatcctgaaacaagcaagatcgagggggtctcttcgttggacacagctctgaaggtgttttggaataatcaaagggagcagctaggaaactttgcaggccaaactcatttgccgctatctagggtcagaaagattttgaaatctgatcctgaagtcaagaagataagctgtgatgttcctgctttgttttcgaaagcctgtgaatacttcattctagaggtaacattacgagcttggatgcatactcaatcatgcactcgtgagaccatccggcgttgtgatatcttccaggccgtaaagaactcaggaacttatgatttcctgattgatcgtgtcccttttggaccgcactgtgtcacccatcagggtgtgcaacctcctgctgaaatgattttgccggatatgaatgttccaatcgatatggaccagattgaggaggagaatatgatggaagagcgctctgtcgggtttgacctcaactgtgatctccagtgaacatgaagctgctctggaagacaaaaacttgaagaagagaagaaatctgaagaggaatcacccaacaactctatgttatgttcaccttataatagtttatcataaactcattcactaaactatgtgta

SEQ ID NO: 3999 - DNA, 1339 bp, Artificial Sequence
  P915 (35S::G567)
gagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtg

SEQ ID NO: 4000 - DNA, 2079 bp, Artificial Sequence; identical to SEQ ID NO: 623
  P927 (35S::G831)

SEQ ID NO: 4001 - DNA, 768 bp, Artificial Sequence
  P929 (35S::G913)
aaaacacattgtaacattagtttaagcattaagcttctttatgtcgaataataataattctccgaccaccgtgaatcaagaaacgacgacgtctcgtgaagtctcaatcacattgcctactgatcaatctcctcaaacctcaccaggatcatcttcttctccttcaccgagaccttccggtggatcaccggcgagaagaacggcgactggattatccggcaagcactctattttcagggggattcgactacgtaacggaaaatgggtatcggagattagagagccacgtaaaacgacaagaatttggctcgggacttatccggtaccggagatggctgccgccgcttacgacgtggctgcgttagctttaaaaggacccgacgccgttttgaattttcctggtttagctttgacttacgtggctccggtttcaaactctgctgcggatataagagcggctgctagtagagcagcggagatgaagcaaccggatcagggtggggatgagaaggtattggaaccggttcaacccggcaaagaggaagaattagaagaagtgtcgtgtaactcgtgttcgttggagtttatggatgaggaagcgatgttgaatatgccgactttgttgacggagatggctgaagggatgttgatgagtccaccgagaatgatgatacatccgacgatggaagatgattcgccggagaatcatgaaggagataatctttggagttataaatgaatccattgaagctgctctcttttttattg

SEQ ID NO: 4002 - DNA, 532 bp, Artificial Sequence
  P934 (35S::G1053)
ctcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactc

SEQ ID NO: 4003 - DNA, 1311 bp, Artificial Sequence; identical to SEQ ID NO: 837
  P938 (35S::G1137)

SEQ ID NO: 4004 - DNA, 747 bp, Artificial Sequence
  P939 (35S::G1140)
attcaagaacagtagtgaaggagagatctggtaaaatggcgagagagaagataaggataaagaagattgataacataacagcgagacaagttactttctcaaagagaagaagaggaatcttcaagaaagccgatgaactttcagttctttgcgatgctgatgttgctctcatcatcttctctgccaccggaaagctcttcgagttctccagctcaagaatgagagacatattgggaaggtatagtcttcatgcaagtaacatcaacaaattgatggatccaccttctactcatctccggcttgagaattgtaacctctccagactaagtaaggaagtcgaagacaaaaccaagcagctacggaaactgagaggagaggatcttgatggattgaacttagaagagttgcagcggctggagaaactacttgaatccggacttagccgtgtgtctgaaaagaagggcgagtgtgtgatgagccaaattttctcacttgagaaacggggatcggaattggtggatgagaataagagactgagggataaactagagacgttggaaagggcaaaactgacgacgcttaaagaggctttggagacagagtcggtgaccacaaatgtgtcaagctacgacagtggaactccccttgaggatgactccgacacttccctgaagcttgggcttccatcttgggaatgaatctgagagagagaaagatccagcagagttgacttcgatggaagcccac

SEQ ID NO: 4005 - DNA, 1563 bp, Artificial Sequence
  P941 (35S::G1198)
gagactaatcaagaagagatatcatcaattgaagctgttttcttgagtagagatggcgaaccatagaatgagcgaagctacaaaccataaccacaatcatcatcttccttattcacttattcatggtctcaacaacaatcatccatcttctggtttcattaaccaagatggatcgtccagtttcgattttggagagctagaagaagcaattgttctgcaaggtgtcaagtataggaacgaggaagccaagccacctttattaggaggaggaggaggagctacgactctggagatgttcccttcgtggccaatcagaactcaccaaactcttcctactgagagttccaagtcaggaggagagagcagcgattcaggatcggctaatttctccggcaaagctgaaagtcaacaaccggagtctcctatgagtagcaaacatcatctcatgcttcaacctcatcataataacatggcaaactcaagttcaacatctggacttccttccacttctcgaactttagctcctcctaaaccttcggaagataagaggaaggctacaacttcaggcaaacagcttgatgctaagacgttgagacgtttggcccaaaatagagaagctgctcgcaaaagccgtcttaggaaaaaggcgtatgtgcaacagctagaatcaagtaggataaagctttcccaattggagcaagaacttcagcgagctcgttctcaggggctgttcatgggtggttgtggaccaccaggacctaacatcacttccggagctgcaatatttgacatggaatatgggagatggctagaggatgataaccggcatatgtcggagattcgaaccggtcttcaggctcatttatctgacaatgatttaaggttgatcgttgacggttacattgctcattttgatgagatattccgattaaaagccgtggcagcgaaagccgatgtttttcacctcatcattgggacatggatgtccccagccgaacgttgttttatttggatggctggtttccgtccatccgacctaatcaagatattggtgtcgcaaatggatctattgacggagcaacaactgatgggaatatatagcctacaacactcgtcgcaacaagcagaggaggctctctcgcaaggcctcgaacaacttcagcaatctctcatcgatactctcgccgcatctccagtcattgacggaatgcaacaaatggctgtcgctctcggaaagatctctaatctcgaaggctttatccgccaggctgataacttgaggcagcagaccgttcaccagctgaggcggatcttgaccgtccgacaagctgcacggtgtttcctagtcatcggagagtactatggacggctcagagctcttagctccctttggttgtcacgcccacgagagacactgatgagtgatgaaacctcttgtcaaacgacgacggatttgcagattgttcagtcatctcggaaccacttctccaatttctgaatggaatgaaactttgtataactaaaaggccaagtttcattgtctgtcgtaatttcacctatttc

SEQ ID NO: 4006 - DNA, 1200 bp, Artificial Sequence
  P946 (35S::G1229)
caacgaacgaggaagagagagagagaaggatatatctctaatcacgatgcaggagataataccggattttcttgaagagtgtgaatttgtcgacacttcactagccggagatgatctatttgccatcttagagagtcttgaaggtgccggagagatatctccgacagctgcatctacacctaaagatggaaccacaagttccaaggagttagttaaggatcaagattatgaaaactcatctcctaagaggaaaaagcaaagactagaaaccaggaaagaagaggacgaagaagaagaagacggagacggagaagcagaagaagataataagcaagatgggcaacaaaagatgtctcatgtaaccgtggaacgtaaccggagaaagcaaatgaacgagcacttaaccgttttgcgttctcttatgccttgtttctacgtcaaacggggggaccaagcatcgatcataggaggagttgtggagtacataagcgagttacaacaagttctccaatctttggaagccaagaaacaacgtaaaacctacgccgaagtcctaagcccgagagttgtcccgagccctcgtccttcaccgcctgttctaagcccaagaaaaccgcctcttagcccgcgcatcaaccaccaccagattcaccaccacctacttctccctcccataagtcctcgaacacctcagccaacaagcccataccgggccattccaccgcaactaccactcatcccacagcctccgcttcgctcttacagctcattggccagttgcagcagcttaggagatccacctccatactctcctgcttcatcttcttcatctccttcagttagtagtaaccatgagagtagtgtgatcaatgagcttgttgctaactcaaaatcggctttggctgatgtggaagtgaagttttcaggagctaacgtgctgctcaaaacggtgtcgcataagatcccgggacaagttatgaagataattgctgctcttgaagatttggctcttgagattcttcaggttaatattaacaccgtcgacgaaaccatgcttaattctttcaccatcaagattggaattgagtgccaactaagtgcagaagaactggctcaacaaattcagcaaacattctgctagtaaagaaggatttaatatagcttcgtataaaccttaacgagagagcagtacgtactcac

SEQ ID NO: 4007 - DNA, 1424 bp, Artificial Sequence; identical to SEQ ID NO: 1027
  P961 (35S::G1494)

SEQ ID NO: 4008 - DNA, 800 bp, Artificial Sequence; identical to SEQ ID NO: 1099
  P964 (35S::G1646)

SEQ ID NO: 4009 - DNA, 719 bp, Artificial Sequence
  P965 (35S::G1781)
cagattgatcacatgtggttaacatcaatcaaaaaaaaaaacaaagagatagagatatgactgaggagagcccagaagaagatcatgggtctcctggagtagctgaaacaaatccaggaagcccttcttcaaagaccaacaacaacaacaacaacaacaaagaacaagaccggtttcttcccattgcgaatgtcggaaggatcatgaaaaaagttcttcccggtaacggtaagatctcaaaagacgctaaagaaaccgttcaagaatgtgtctcggagttcattagtttcgtcactggtgaagcttctgacaagtgtcaaagagaaaagaggaagaccatcaatggagatgatatcatttgggctatcacaactctcggtttcgaagactacgtggctccattaaaggtctacctctgcaaatatagagacaccgaaggagagaaagttaacagcccaaaacaacaacaacaaagacaacaacaacagcagattcaacaacagaatcatcataattatcagtttcaagaacaagaccaaaacaataacaacatgtcatgtactagttacatctctcatcatcatccttctccattcctaccagtggatcatcaaccttttcccaatattgctttctctcctaaatcattgcagaaacagttcccgcagcagcatgataataacattgattcaattcactggtgagagagacatttgctt

SEQ ID NO: 4010 - DNA, 1007 bp, Artificial Sequence
  P966 (35S::G1782)
gatttgtgactggacttgttggtttggacatttagtttattgaagtaaagatttgaagacaatgcaagtgtttcaaaggaaagaagattcatcttggggaaactcaatgcctacaacaaattcaaatattcaaggatctgaatctttcagcttgactaaggatatgataatgtctacaacacaattacccgcgatgaaacattcgggtttgcagctgcaaaatcaagattcaacctcatcacaatctactgaagaagaatcaggcggcggtgaagttgcaagctttggagaatataagcgttatggatgcagcattgttaataacaatctctcaggttacatcgaaaacttgggaaagcctattgaaaattatactaagtcaattactacctcgtcgatggtgtctcaagactctgtgtttcctgctcctacttctggtcaaatatcttggtctcttcaatgtgctgaaacgtcacatttcaatggtttcttggctcctgaatatgcatcaacaccaacggcgctgccacatttagagatgatgggtttggtttcttcaagagtgccattgcctcatcacattcaagagaatgaaccaatatttgtcaatgcgaaacagtatcatgcgattctccgtcgcaggaagcaccgtgctaaactcgaagctcagaacaaactcatcaaatgccgtaaaccgtaccttcatgagtctcgccatcttcatgctttaaagagagctagaggctccggtggacgtttcctcaatacaaagaagcttcaagaatcatcaaactcactgtgttcttctcaaatggcaaatggacaaaatttctctatgagccctcacggtggtggaagcggaatcgggtctagttcgatctcaccgagctccaattcaaactgtatcaacatgttccaaaacccgcagttcagattctcaggttatccgtcaacacaccatgcctcagctctcatgtcagggacttgaggcacatgagaagaccttg

SEQ ID NO: 4011 - DNA, 1701 bp, Artificial Sequence
  P968 (35S::G184)
gttacattcctagggttttggagaatccaatcaacaacaaagaaaataatcatcgttacaataatcagtatcacgcacagacttagatgttccggtttccagtgagtctaggcggttcacgtgacgaagaccgtcacgatcagatcacaccgttggatgaccatcgtgtggtggttgatgaggttgacttcttctcagagaagagagatagggtttcacgtgagaacatcaacgacgacgacgacgaaggcaataaggttctcatcaaaatggagggttcacgagttgaagaaaacgatcgttccagagatgtcaatatcggtctgaatcttctgaccgcgaatacgggaagcgatgagtcaacggtggatgatggactatcaatggatatggaagataaacgtgcaaagattgagaacgcacaactacaagaagagctcaagaagatgaaaatagagaatcaaaggctaagagatatgttgagccaagcgacgaccaacttcaatgccttacaaatgcaacttgttgccgtcatgaggcaacaagaacaacgtaactcttcacaagatcatctcctggagagcaaagcagaaggaaggaaacggcaggaactgcaaatcatggtgccaaggcagttcatggaccttgggccgtcgtctggagcagcagagcatggagccgaagtgtcatctgaagagaggacaacggttcgttcaggttctcctccttcgcttctagaaagttccaatccccgagagaacggaaagaggttgcttggaagagaagaaagctcagaggaatcagagtctaacgcctggggaaaccctaacaaagtccccaaacataatccatcctctagcaatagcaatggaaacagaaacggaaatgttattgatcagtcggccgcagaagccaccatgcggaaagcccgtgtctcagttcgtgcccgatctgaagctgccatgataagcgatggatgtcaatggagaaagtacggacaaaaaatggctaaaggaaacccgtgtccgcgggcttattatcgttgcacaatggccggtggatgtccagttcgcaagcaagtgcagcgttgcgcagaagacagatctattctcataaccacctacgaaggaaaccacaaccatccactcccaccagccgctacggccatggcctcaacaaccaccgcagctgcaagcatgctcctctcgggctcaatgtcgagtcaagacggtttaatgaacccaacaaacctcctagctcgagctatcttgccttgctcctcaagcatggctacaatctcagcctccgcaccattcccaaccatcacattggacctcaccaattcacccaacggtaacaaccctaatatgaccactaataacccgttgatgcagttcgctcaacggcccggtttcaacccggcagttttgcctcaagtggttggtcaagctatgtacaataaccaacaacagtccaagttttctggtttacagttaccggctcagccactgcagatcgcggccacttcctcggtggccgagagcgttagtgctgccagtgcagcaattgcgtccgatccaaactttgcggcggctctagcggcagcgatcacgtccattatgaacggttccagtcatcaaaataataacaccaataataataatgtggctacgagcaacaatgacagtaggcaataagagt

SEQ ID NO: 4012 - DNA, 597 bp, Artificial Sequence
  P969 (35S::G24)
gttttgtaatttttttaccggcggttatggagacggaagcggcggtgacagcgacggttacggcggcgacgatggggattgggacgaggaagagagatctgaaaccgtataaaggaatacgaatgaggaaatgggggaaatgggtggcggagatacgggaaccgaataagagatcaaggatctggttaggttcttatgcgacgcctgaagcggcggcgagagcttacgacactgctgttttttacctccgtggtccttcagcgaggcttaattttccggagcttttggctggacttactgtttctaacggcggaggaagaggtggtgatttatcggcggcgtatattaggagaaaagcggcggaggttggtgctcaggttgatgcgcttggagcgacggtggttgtgaataccggcggcgagaatcgcggtgattacgagaagattgagaattgtcgtaagagcggtaacgggtcattggaacgggtcgatttgaataaattacccgacccggaaaattcggatggtgatgatgacgaatgtgtgaaaagaagatagaaaaaataaaaagtagttgtagaaggagagacgagaatgt

SEQ ID NO: 4013 - DNA, 1097 bp, Artificial Sequence
  P970 (35S::G189)
ccacaactctctccttgtagagagagagattttatggcggtggagctcatgactcggaattacatctccggcgtcggagctgatagcttcgccgttcaagaagcagctgcttcaggactcaaaagtatcgaaaatttcatcggtttaatgtctcgtgatagctttaactctgatcagccatcttcttcttccgcctccgcctccgcctccgccgccgcagatcttgaatcagctcgtaacacaacggcggacgcggctgtttcaaagtttaaaagagtcatatctctcttagatcgaactcgaaccggacacgcccggtttagacgtgctccggttcatgttatttctccggttcttttacaagaagaaccaaaaacgacgccgtttcagtctcctcttcctcctccgccgcaaatgatccgaaaaggttcgttttcttcatcgatgaaaacgattgatttctcatctctctcctctgtaacaacggaatcagacaaccagaagaagattcatcatcatcaacgtccctctgaaacggcgccgtttgcgtctcaaactcaaagcctctccacgacggtctcgtctttctcaaaatcaacaaagagaaaatgtaactctgagaatcttctcaccggaaaatgcgcttccgcttcttcctccggtcgttgtcattgctcgaagaaaagaaagataaaacagaggagaataattagggttccggcgataagtgcaaaaatgtccgatgtaccaccggacgattattcatggaggaaatacggacaaaaaccaattaaaggatctccacatccaagaggatattataagtgtagtagcgtaagaggttgtccagcacgtaaacatgttgagagagcagctgatgattcgtccatgttgattgttacttatgaaggagatcataatcattctctctccgccgctgatctcgccggagccgccgttgctgatcttattttggaatcgtcttgaaaagaacaaatctttatttaaggcttttataatataaatttagatccttacttagtgaagtactcaaactatgaatgaaatcaatgtaatcaaaatcaaaaagcttttgc

SEQ ID NO: 4014 - DNA, 734 bp, Artificial Sequence
  P972 (35S::G1311)
gaaaaatggattttaagaaggaagaaacacttcgtagagggccatggctcgaagaagaagacgaacggctagtgaaggtcattagtcttttgggagaacgtcgttgggattctttagcaatagtttccggtttgaagaggagtggtaagagttgcaggctaaggtggatgaactatctgaatccgactctgaagcgtggaccgatgagtcaagaagaagagagaatcatctttcagctccatgctctatggggtaacaagtggtcgaagattgcgagaagattacccggtaggactgataacgagataaagaactattggagaactcattatagaaagaaacaggaagctcaaaactatggaaagctctttgagtggagaggaaatacaggagaagaattgttgcacaagtataaggaaacagagatcactaggacaaagacgacgtctcaagaacatggttttgttgaagttgtgagcatggaaagtggtaaagaagccaacggtggtgttggtggaagagaaagcttcggtgttatgaaatcaccgtatgaaaatcggatttcggattggatatcagagatttctactgaccagagtgaagcaaatctttcagaagatcacagcagcaatagctgcagtgagaacaatattaacattggtacttggtggtttcaagagactagggactttgaggagttttcatgttctctatggtcataattctaaagttgg

SEQ ID NO: 4015 - DNA, 706 bp, Artificial Sequence
  P979 (35S::G1047)
caattttaaaccggtcattatgatgtctactgtaccggcctttacctttactgaaccgggtttggttaaccaattatcggatttccagaccggattcactccttgggaattgaactgctccgatctcttctctacaatccatctcgaaccggtcgtaccgagtccttgttctggtgaatccgatgccggttctgtcaaaattaacaccgattttaacggttttgacgaatcgtgtatcggttccatcaaaactaactccggttctgatgattccaaccttttccacggcgtaccgagtcctcaatccgacgaattggactcaaaaaacacgaaaatccgaagtaacgccacgaatcataaccggaacaaattgaaccggtcggttttgcaggtgactgacgaccgtaaacgcaaacggatggaatcaaaccgagaatcagcgaagcggtcgaggatgcgtaaacaaagacacattgataatttaaaagacgaagcaaatcgtctcggtttagaaaaccgggaactcgcaaaccggcttcgaattgttttgtacaacatcgcattaatgtgtacggacaacaatcagcttttgtcggaacaagagattctcagacggagattcttggagatgaggcagattttgattttcagacagcttcagctgaatccatcattgatcatcaatcatcatcatatgatttgaaag

SEQ ID NO: 4016 - DNA, 2844 bp, Artificial Sequence
  P980 (35S::G1084)
cttgagctctggatttgagcttaggaaagaagagtagagagaaatgggatgttctcattccaagttagatgatgaagaagcagttcagatctgtaaagacaggaaacgtttcatcaaacaagctattgaacatagaactaagtttgcttctggtcacattgcttatattcactctcttagaaaagtctctgatgctctccatgactttatcctccaaggagacaacaacaatgagtttgttcctactctctgtcaagactcattcgtcactccggtcaagagaatgccacagagacgtcgtcgaagcagccgtagtaatagcggtgagttcatctccatttcgccttcttcgattcctccgaaaatgattcaaggtaggccaagatcgaatgtgaaagcgaattatttgatggctaatagaagtagaccggttagagtcgaacagagatctcctgaaacgtttagagttgagacattttctccacctagtagtagtaaccaatatggtgaatcagatggtttctttggaatgaatatgaatatgaatacttctgcgtctacttcatcttcgttttggaatccgttgagctctcctgagcaaaggttaagtagtcataacattcctcctccttcaccgcagaattcgcagtgggatttcttctggaatccgttttcttcgttggattattatggatacaatagttatgaccgaggaagtgttgatagtaggagtggtatagatgatgagattagaggattgagacgtgttagagaggaagaagggattcctgatttggaagaagatgatgaacctcataaacctgaacctgtcgtcaatgtgcggtttcagaatcataatccgaatccgaaagcaacggaagagaatagaggtaaagttgataagagttgttgcaatgaggaagttaaagttgaagatgttgatgaggatgaagacgaggatggagatgaggatgatgatgagtttacggatagcgggtgtgagactgagaatgagggagacgagaaatgcgttgctcctccaacgcaagaacagcgaaaagctgaggtgtgtagaggaggagaagctacagggaatgttgttggagtaggtaaggttcaagagatgaagaatgttgttggtgttagagatgatgcaaagacgacggggttcacggtatatgtgaaccggagaccaactagcatggctgaagtaatcaaagatcttgaagatcagttcacaacaatttgtgatgcggctaaggaagtctcggggctattggaagctggtagagctcaatacacatcatcctttaatgaccatagtggtgagtttatgaacaatgttgcaatatttctctgtttaatgacttcacttataaatatgaagtccttttttatgtgtgtttgtagccaggaaaatgctgaatccagtagcgttgttccgctcgggttcatcaagatcttcctcgtcaagattcttgatcacttcttctggtggttcaagagagagcgggtctgaaagcagaagcgatgtttcagatgaatcttgcatgatttcaggtagccaccaaacaacattggacagacttttcgcgtgggagaagaaactctatgatgaagttagggtaagtaacaagagatataagcaactagtgactacatattaatctctgttggttataactgagccgtctttgtggtgttgtaacagtctggagaacgtgttcgaagagcatatgaaaagaaatgtatgcagctgaggaatcaggacgtgaaaggagatgatccgcttgcggttgataaaactagggctactatcagagatctagatacacagatcaaggtgtcaatacactccattgaatccatctccaaaagaatcgagactcttcgtgaccaagaactgttgcctcagcttcttgagctcgttgaagggtaacaacaccaacaacttctttttccttctcttcggtttcacttttaagcctcagactgacaaatggtaatcatgatcataacagattaacaaggatgtggaaagtaatggcggaaagtcaccagatacagaaacgaacactagacgaagccaaactgttacttgcaggcacaccggtttcaaagcgtcacaagaagagacaacctccaataatgccagaggctattaactctcaaagattagctcaatctgctttgaatcttgaagctcagcttcgaaactggagaacctgttttgaattctggatcacctctcagagatcctacatgaaagcattatctggttggcttctaagatgtttcagatgtgatcctgaccccgaaaaagttagattatcctcatgtcttcacccgatataccgagtctgcattcaatggtcaaggttgcttaacagcttgaatgaaaaaccagttttggacaaacttgagttctttgcctcagggatgggttcaatatatgcaaggcaagttagggaagatccaaactggagtggaagcgggtcaaggagatactccgggtcagaaagcatggagcttgtagtggctgataagggagaagaagatgttgtgatgactgctgagaaacttgcagaggttgctgtgaaggttctctgccatggaatgtctgttgcagttagttcactagctgagttttccatcaactcggccgatgaacactcgaagcttgttagccaaccagcagacgatgcgtcggagcagcagcccccggatgtaaatttcaattcctagtacttgttattaattttgtttggttttagagagtttagaattaggtaggtttttggcatcatcttttgctatcagaagatagtttcttagatggatgag

SEQ ID NO: 4017 - DNA, 1142 bp, Artificial Sequence
  P983 (35S::G1640)
cgtcgacctctcactcaagggtccaaaagtgttttctctttttcagtttctctttctctttttgacagaagagaccgagaagcaatgggaagggctccgtgttgtgagaaaatcgggttgaagagagggagatggacagccgaggaagatgagatcctcaccaagtatattcagaccaatggtgaaggttcttggcgatctttgcctaagaaagctggattgttgagatgtggaaagagctgtagactaaggtggataaactacttaagaagagacttaaaaagaggaaatattacttccgacgaagaagaaataatcgtcaagttgcattcccttctcggcaacagatggtcacttattgcaacacatctaccaggaagaacagacaacgaaattaaaaactattggaactcacatctcagccgcaaaatctatgccttcactgccgtttccggagatggacacaatctactcgtcaacgatgtagtcttgaagaaatcttgttcatcgtcttctggagccaagaacaataacaagaccaagaagaagaagaagggaaggactagtaggtcatccatgaagaaacacaagcaaatggtgacggcctcacaatgtttctcacaacctaaggagctagagagtgatttcagtgagggagggcaaaatggtaattttgaaggagagtctttggggccttatgagtggttggatggtgagttagaacggctcttgagtagttgtgtctgggaatgcactagtgaagaggctgtgattggagtaaatgatgaaaaggtgtgtgagagtggggacaatagtagttgttgtgttaatttgtttgaagaagaacaaggaagcgagacaaagattggtcacgtaggaatcacagaggttgatcatgatatgacggtggaaagagaaagagagggaagttttttaagttcgaattcaaatgaaaataatgataaagattggtgggttggtctatgtaattcttcagaagttgggtttggggttgatgaggagttgcttgattgggagtttcaaggtaatgtcacttgtcaaagtgatgatctatgggatctctcagatattggagagataacattggagtgattgtaccgagcaagtggattggcggccgc

SEQ ID NO: 4018 - DNA, 912 bp, Artificial Sequence; identical to SEQ ID NO: 907
  P984 (35S::G1309)

SEQ ID NO: 4019 - DNA, 974 bp, Artificial Sequence
  P986 (35S::G1330)
cgacctctttgtgggtcactcttcatcaatgggtgacaaaggaaggagcttaaagatcaacaagaacatggaggaattcacgaaagtggaagaagaaatggacgtaaggagaggtccatggacagttgaggaagatttagagctcatcaattacattgctagtcatggtgaaggtcgatggaactctctcgctcgttgcgccgaactcaaaaggaccggaaaaagctgcagacttcggtggctgaactatctccgaccagatgtgcgccgtggaaacataaccctcgaagaacaactcttgattcttgaacttcacacacgttggggcaatagatggtctaagattgcacaatatttaccaggaagaacggataacgagatcaaaaactattggagaacacgtgttcaaaagcatgcaaaacagcttaaatgcgacgtgaacagtcaacaatttaaagacaccatgaagtatctttggatgcctcggctcgtagaaaggatccaagccgcgtccatcgggtctgtttccatgtcatcttgcgtcaccacctcctcagatcagttcgtgatcaacaacaacaacaccaacaacgtggataatttggctttaatgagtaaccctaatggttacatcacgccggataattccagcgtggcagtatctcctgtatcagatttgacggagtgtcaagtgagtagtgaagtgtggaagattggtcaggatgagaatttggtggatccaaaaatgacatcgccgaattatatggataatagcagtggactattaaacggagattttacgaagatgcaagatcaaagtgaccttaattggtttgaaaatattaatgggatggtaccaaattattcggacagtttttggaacattggaaatgatgaagacttctggctcttacaacaacatcaacaagtccacgacaatggaagcttctgaatagacaagaagctatgcggcc

SEQ ID NO: 4020 - DNA, 931 bp, Artificial Sequence
  P987 (35S::G1323)
gagagagaatatgggcaaaggaagagcaccatgttgtgacaaaaccaaagtgaagagaggaccatggagccatgatgaagacttgaaactcatctctttcattcacaagaatggtcatgagaattggagatctctcccaaagcaagctggattgttgaggtgtggcaagagttgtcgtctgcgatggattaattacctcagacctgatgtgaaacgtggcaatttcagtgcagaggaagaagacaccatcatcaaacttcaccagagctttggtaacaagtggtcgaagattgcttctaagctgcctggaagaacagacaatgagatcaagaatgtgtggcatacacatctcaagaaaagattgagctcggaaactaaccttaatgccgatgaagcgggttcaaaaggttctttgaatgaagaagagaactctcaagagtcatctccaaatgcttcaatgtcttttgctggttccaacatttcaagcaaagacgatgatgcacagataagtcaaatgtttgagcacattctaacttatagcgagtttacggggatgttacaagaggtagacaaaccagagctgctggagatgccttttgatttagatcctgacatttggagtttcatagatggttcagactcattccaacaaccagagaacagagctcttcaagagtctgaagaagatgaagttgataaatggtttaagcacctggaaagcgaactcgggttagaagaaaacgataaccaacaacaacaacagcataaacagggaacagaagatgaacattcatcatcactcttggagagttacgagctcctcatacattaatgaagccataaagcaagtcattttcaccttgaaaatggaattattagctaacttattggcattattagtatataagcaagatcagataggcgcatgtag

SEQ ID NO: 4021 - DNA, 1300 bp, Artificial Sequence
  P988 (35S::G1635)
tcaagtctagattcgcgaatttatcttggtgtttccttttctgtgttccacacctttcgagtttttttttgttttcctccgccgagatcttaatccgggaagttatggcgtcgtctccgttgactgcaaatgttcagggtaccaacgcttctttgaggaatagagatgaagaaactgcagacaagcagatacaattcaatgaccaaagttttgggggaaatgactatgcacccaaggtacggaagccatacacgataacaaaagagagagagagatggacagatgaagagcacaagaagtttgttgaagccttgaaattatacgggcgagcttggagacgaatagaagaacatgtgggctcaaagaccgcagttcagattcgaagccatgctcagaagtttttctctaaggttgctcgagaagcaactggaggtgatgggagctcagtagagccgattgtaatacctcctcctcgtcccaagagaaagccagcgcatccgtaccctcgtaagtttgggaacgaggcagatcaaacaagtagatcggtttctccctcagaacgtgatactcaatctccaacctctgtgttgtccactgttggatcagaagcattgtgttcccttgattcgagttcacccaatcgaagcttgtccccagtttcttctgcatcaccaccagctgctcttacaaccactgcaaatgcacctgaagagcttgagactctgaagctggagttgtttcctagtgagagactcttaaacagggagagctcgatcaaggaaccaacgaagcaaagtcttaaactctttgggaagacagttttggtatctgattcaggcatgtcctcttctctaacaacttcaacatattgtaaatccccaattcagccattaccacggaaactctcatcatccaagacactacccataataagaaactcacaagaagaactcttgagctgctggatacaagtccctcttaagcaagaagatgtggaaaatagatgtttggattcaggaaaggctgtccaaaacgaaggatcatcgactggatcaaacactggttcggtggatgatacgggacacacggaaaagaccacagaacccgaaacaatgctatgtcaatgggagtttaaaccaagtgagaggtctgcattttctgagctcagaagaacaaactccgagtcaaattcaagaggatttggtccatacaagaagagaaagatggtaacagaagaagaagagcatgagattcatctccacttataacacattttcttacgtaccctaaagaagagact

SEQ ID NO: 4022 - DNA, 433 bp, Artificial Sequence
  P989 (35S::G1911)
atcatcctcttgactcgtaatctccccatacttaaataatctctttctaaccagttatattagtctataactcaacatggcatcaagctcaatgtcttctcagagctctggctcgtggactgctaagcagaacaaagcctttgagcaggctctagcaacctatgaccaggacactcctaaccgttggcaaaatgttgccaaagtcgtgggtggaaaaacaacagaggaggtaaagagacactacgaactcttagtgcaagacatcaacagcatagagaacggtcatgttccattcccaaactacaggactagtggaggctgcactaatggcaggcttagtcaggaggaaaaaaggtatgtattgtcctaaaaaagacacattctgctataattaagaatacaaaacaatccaagccaaagacaccaatctgat

SEQ ID NO: 4023 - DNA, 1732 bp, Artificial Sequence
  P991 (35S::G1637)
agcgagatcttgtgattctaattcttgtgataccgaaaacattggtggcgagagagagatggtgaaggagacggtgacggtggcgaaaacgtgctcacactgtggccataatggccataacgcacggacttgtctcaacggcgttaataaggcaagtgttaaactgttcggcgttaatatatcgtctgatccgattaggccgcctgaggtaacggcgttaaggaagagtcttagtttgggaaaccttgatgctcttctcgctaacgatgaaagtaacggtagcggtgatcctatcgccgccgttgatgataccggttatcattccgatggtcagattcattccaagaagggtaaaactgctcatgagaagaaaaaggggaagccatggacggaagaagaacatcgtaatttcttaatcggtttaaacaaactcggaaaaggagattggagaggcattgcaaagagtttcgtgtcgacaagaacaccaacacaagtcgcaagtcatgctcagaaatattttattaggttaaacgttaacgacaagagaaaaagacgtgctagtctctttgacatctctctcgaagatcagaaggagaaagagaggaactctcaagatgcttcaacaaagactccacctaaacaaccaataaccggaattcaacaaccggtagtacaaggtcatactcaaaccgagatttcgaacaggtttcagaatttatcaatggagtatatgccaatctaccaacccataccaccttactacaactttccacctattatgtaccatccaaattatccaatgtactatgccaaccctcaagtaccggttaggtttgttcatccttctggtatacctgttccaagacatataccgattggtttgcctctgtctcaaccgagtgaagcttctaatatgacaaataaagacggtttggatcttcatatcggtttgcctccacaagctactggagcttctgacttgactggtcatggcgttattcatgtgaaatgaaatctcattttttgtgtgtttatttaagcatgatataggtatattgcttcttttttttggtgttgagttttatttgaatatatagctccatattcaaaagttttgccaatcggattatgtatcatttttatttcttcccagattagattaaataagaatatagatatatttggatttatatttagctgcttctttatcaaccaaaaacaaaacaaaaaaaatcttagttttggtgaagtttattgagtaaaatcaacattcattgggagaaaattaaaaaaatggtgttgattaactagtaaaatcctttgatcaatttcctagaagctcgtctggttctatcagtgaggtttggtttgtcaggatctccgagttctaaggtggcacccaagaaaccggtctgagttccatcgctatcattgtcgatgtctccttcgatcgtcaatccttcaatcttagccgcaatagattcttctctcatcccaacatccacatcttcaaaatttggatcgatgttataagtgccacaaagaataaagtatcaacatgtaacagttacataaaatatttcccaacttcacaaccgccaaatgcagacatgatctctctaccatttgcaatccaatttgatcatgttggattattgcggatgagttcgtggttaacaacatgcatgttttttctttcactttaaaaccgggcatggtttgatcaaacaca

SEQ ID NO: 4024 - DNA, 1317 bp, Artificial Sequence; identical to SEQ ID NO: 219
  P994 (35S::G248)

SEQ ID NO: 4025 - DNA, 1243 bp, Artificial Sequence
  P995 (35S::G671)
ttcacttgagaacaaccccctttgaactcgatcaagaaagctaagtttgaagaatcaagaatggtgcggacaccgtgttgcaaagccgaactagggttaaagaaaggagcttggactcccgaggaagatcagaagcttctctcttaccttaaccgccacggtgaaggtggatggcgaactctccccgaaaaagctggactcaagagatgcggcaaaagctgcagactgagatgggccaattatcttagacctgacatcaaaagaggagagttcactgaagacgaagaacgttcaatcatctctcttcacgcccttcacggcaacaaatggtctgctatagctcgtggactaccaggaagaaccgataacgagatcaagaactactggaacactcatatcaaaaaacgtttgatcaagaaaggtattgatccagttacacacaagggcataacctccggtaccgacaaatcagaaaacctcccggagaaacaaaatgttaatctgacaactagtgaccatgatcttgataatgacaaggcgaagaagaacaacaagaattttggattatcatcggctagtttcttgaacaaagtagctaataggttcggaaagagaatcaatcagagtgttctgtctgagattatcggaagtggaggcccacttgcttctactagtcacactactaatactacaactacaagtgtttccgttgactctgaatcagttaagtcaacgagttcttccttcgcaccaacctcgaatcttctctgccatgggaccgttgcaacaacaccagtttcatcgaactttgacgttgatggtaacgttaatctgacgtgttcttcgtccacgttctctgattcctccgttaacaatcctctaatgtactgcgataatttcgttggtaataacaacgttgatgatgaggatactatcgggttctccacatttctgaatgatgaagatttcatgatgttggaggagtcttgtgttgaaaacactgcgttcatgaaagaacttacgaggtttcttcacgaggatgaaaacgacgtcgttgatgtgacgccggtctatgaacgtcaagacttgtttgacgaaattgataactattttggatgagtgaaactcataatcgatgaatcccacgtgaccatgtcaatatgatgtctatggatatgttaccttgatgatgttgatggtaataataataaataatagatggtgatgatgaccatgcatgaat

SEQ ID NO: 4026 - DNA, 1306 bp, Artificial Sequence; identical to SEQ ID NO: 1029
  P1005 (35S::G1496)

SEQ ID NO: 4027 - DNA, 771 bp, Artificial Sequence
  P1008 (35S::G1655)
tcacattgagagagagagagagagaaagagagactctcagaatctgaagaagaagaagagattgttgtttttgccttttatcatcggtttctttgaatctctggttttaaatcggatttaatggtggagtctctgttcccgagcatcgaaaacacaggtgaatcgtctcgaagaaagaagccgaggatatcagagacggcggaggcggagatagaggcacgacgtgtcaacgaagaaagcttgaagagatggaaaacgaatcgtgtgcaacagatctacgcttgtaagctcgtcgaagctttacgccgagttcgtcagagatcttccaccaccagcaacaacgagaccgataaactcgtctccggcgcggcgagggagatacgtgatacggcggatcgagttctagctgcgtccgctcgtggtacgactcggtggagcagagcgattttagcgagtcgcgtccgagcgaagctgaagaaacatagaaaggcgaaaaagtcaacgggaaattgtaaatcgagaaaaggtctcacggagacgaatcggattaagttaccggcggttgagagaaaactgaagattcttggccgtttggttcctggttgccggaaagtctctgtaccgaatcttttagatgaagcgaccgattacatcgcagcgttagagatgcaggttcgagccatggaggctctcgccgaacttttaaccgcagccgcaccacggacgacgttgaccggaacttaacggcggcagttagtttgtcagttgtta

SEQ ID NO: 4028 - DNA, 1519 bp, Artificial Sequence; identical to SEQ ID NO: 487
  P1020 (35S::G615)

SEQ ID NO: 4029 - DNA, 897 bp, Artificial Sequence; identical to SEQ ID NO: 1255
  P1022 (35S::G1900)

SEQ ID NO: 4030 - DNA, 609 bp, Artificial Sequence; identical to SEQ ID NO: 1301
  P1028 (35S::G1965)

SEQ ID NO: 4031 - DNA, 716 bp, Artificial Sequence
  P1030 (35S::G627)
tatataaagaataaactagaagtaaaggatggtgaggggcaaaacggagatgaagaggatagagaacgcaacaagcaggcaagtgacgttttcgaagagaagaaatggactcttgaagaaagccttcgaattatcggtcctttgtgatgctgaagttgctttggttatcttctctccaagatccaaactctatgagttctctagctctagtatagcagcaacaattgaacgctatcagagacgaataaaagaaattgggaataatcataagagaaatgataattctcagcaagcgagagacgaaacatctggattgacaaaaaagattgaacagctagagatatctaaacgaaaattgcttggagaaggcattgatgcatgttccatcgaggagctgcaacagttagagaatcagttggaccgaagcttgagcaggataagagccaagaagtaccaattactccgtgaagaaattgagaagttgaaggcagaggagaggaatctcgttaaggaaaataaagatctgaaggagaagtggcttggaatgggaacagcaacaatagcatcatcacaatcaacgttatcatcatcagaagtgaacatagatgacaatatggaagtggagactggtttgttcattggacctcctgagacaagacaatccaaaaaattccctcctcaaaattaatcttacaacttcttcaaaaagaatgttt

SEQ ID NO: 4032 - DNA, 2452 bp, Artificial Sequence
  P1033 (35S::G183)
acatcccctctgtattcttctttcatttgctgctagcgttttctgaagaaaaaggtttatcctcttatatctattaattatgtcattatttcaataatttactaatcatttgattctaaatctcaaaattatcacttttacactagattttgtttcttgacatcctaaggatttgtcaaaaatgagtgattttgatgaaaacttcatcgaaatgacgtcgtattgggctccaccatccagtcctagcccaagaacgatattggcaatgctggagcaaaccgacaatggtctgaatccaatcagtgagatcttccctcaagaaagcttgccaagagatcatactgatcaatctggacaaagatctggtcttcgtgagagactggctgcaagagtaggattcaatcttccaacactcaatacagaagaaaacatgagtcctttggatgcatttttcaggagctcgaatgttcctaattctcctgtcgttgcaatctctccaggattcagtccatcagcactattgcatactcccaatatggtcagtgattcttcccaggtaagtattaatgtcttttgtctttatgattgtttaataatatacatgatataaagtttatatgataaatagtaaaaatctctctgtgattgaaccaatatttgggaatatgatcatgtatgttatcataattctatttcgttttaacatatatagagtaatattgctgtcaaagaaaaaaaaagagaaaaaaagtaataatatctatcggtaaacacagaatctattatttccttttgtttaggtttgatatttttcattcctatctgtgtttacaaattttgtcgaaaacaaaataaaaaaaatctgtgtttacaacttaaaaatggttgtcccggactaattaatttatgttgtttatgatcgaaatgtatatgggttgaataaaattttgataccatgtaaatgattattttcaaatccttcttttcttaatttacgtttgaagccatagggatctctaggcctcaattctaaaaccgtaactaaaatagtctttgtgaccttcttgttacagattatccctccgtcttcagccaccaattacggacctctagagatggtggaaacttccggtgaagacaatgcagcgatgatgatgttcaacaacgatcttccttatcagccgtacaatgttgatctgccttctctagaaggtaaatagagttgcttgtgtctcaagtttgcttccattttcaattttccaaatctttttgtcataattttcttacatgtgaaacagtctttgatgatattgcaacggaagagtccttttatatcccatcttatgaacctcatgttgacccaattggaactcctttagtcacatcctttgaatctgaactcgttgacgatgcccataccgacatcatctccattgaggacagtgagagcgaggatggaaacaaagatgatgacgacgaggacttccaatacgaagacgaagacgaagaccaatacgaccaagatcaagatgtagatgaagatgaagaggaagaaaaagatgaagacaatgttgcattagatgatcctcaacctccacctccaaagagaaggtcccaacaaaacttataatatcataatcaataatcttttcacaaaaacttatttaagttaaccatacatatataaaatcttgtaggagatatgaggtatcaaacatgattggagccacaagaacaagcaagacacaaaggatcatacttcagatggaaagcgacgaagacaatcctaacgatggttatcgctggagaaaatacggtcagaaagtcgtcaaaggaaatcctaatccgaggttattatttcgcaatgttgttagtctcttttccctaacgatttaatcatcttacacattaatatgtttttttgtgtggtatatatgttaatatgcaggagttacttcaagtgcacaaacatcgagtgcagagtgaaaaaacatgtggagagaggagcagacaatatcaagttggttgtgactacatacgatgggatacacaaccatccttcaccacctgcacgtagaagcaattccagttcaaggaaccggtctgcaggggcaacaatacctcaaaatcagaatgatcgaaccagtcggttaggtagggctcctcctactcctactcctcctactcctcctccttcgtcttacacacctgaggagatgaggcctttctcttcgttggctacagaaattgatctgacagaggtttatatgaccggaatctctatgctgccgaatataccggtttacgagaattcgggttttatgtaccagaatgatgaaccgacgatgaatgcgatgccggatggttcagatgtgtacgatgggatcatggaacgcctgtattttaagtttggtgtcgacatgtagacataaaacctttattttcagtcctt

SEQ ID NO: 4033 - DNA, 1135 bp, Artificial Sequence
  P1034 (35S::G1750)
ccttttcctctctttctccaaatctctgaaaattttcaccagaatctctgttctttttttcaccagaatctctctgtttaaaataataggtgatgatgatggatgagtttatggatcttagaccagtgaagtacacagagcacaagactgttatcagaaagtacactaaaaagtcgtctatggagaggaagaccagtgttcgtgactcggccaggttggttcgggtctcaatgacggatcgtgacgccactgattcatcaagcgacgaggaagagtttctgttccctcgaagacgtgtcaagagattgattaacgagatcagagtcgagcctagcagctcttccaccggcgacgtctctgcttctccgacgaaggaccggaaaagaatcaacgttgattctacggttcaaaagccctctgtttccggccaaaaccagaagaagtaccgcggcgtgagacagcgaccatggggaaaatgggcggcggagattcgtgatcctgagcaacgccggagaatctggctcggtacttttgcaacggcggaggaagctgccatcgtctacgacaacgcagcaatcaaacttcgtggccctgatgctcttaccaacttcaccgtacaaccagaaccagaaccggtacaagaacaagaacaagaaccggagagcaacatgtcggtttcgatatcagaatcaatggacgattctcaacatctatcatctccgacatcggttctcaactaccaaacatatgtctcggaggaaccaatcgatagtcttatcaaaccggttaaacaagagtttcttgaaccagaacaagagccaataagctggcatcttggagaaggtaatactaatactaatgatgattcatttccattggacattacatttctcgacaactatttcaatgaatcattaccagacatctccatcttcgatcaacctatgtctcctattcaaccaacagagaatgatttcttcaacgaccttatgttattcgatagcaacgcagaagaatactactcctccgagatcaaagagattggttcatcgttcaacgatcttgatgattctttgatatccgatctcttacttgtgtgatatttttgccattaacgaaacaccggtttggttgc

SEQ ID NO: 4034 - DNA, 594 bp, Artificial Sequence
  P1036 (35S::G181)
aacaatggacagagaagacataaatcctatgttaagccgcctagatgtcgaaaacaacaacaccttctcttcctttgtagacaaaaccctaatgatgatgcctccatcaacattttccggtgaagtggaaccttcatcttcttcttcttggtatccagaaagctttcatgtgcatgcgccgccattaccacctgagaatgatcaaataggtgagaaagggaaggagctgaaagagaagagatcgaggaaagttccaaggattgcgtttcatacgaggagcgatgatgatgttcttgatgatggttatcgttggcgaaaatatgggcagaaatctgtcaagcacaatgctcatcccaggagctattacagatgtacgtaccacacatgcaacgtgaagaaacaagtgcagagattggcaaaagatccaaacgtcgtcgtaacgacctacgaaggcgttcataaccatccttgtgagaagctcatggagactcttaatcctcttctcaggcaactccagttcctctccagtttctctaatctttgaatatataatggcttaattaatggtgtaattacttaaaggtgattaaggtg

SEQ ID NO: 4035 - DNA, 1002 bp, Artificial Sequence
  P1038 (35S::G185)
agtaacaatactttaaactatttacaccactttaatcttattctccactctttgaacgtaatggagaagaaccatagtagtggagagtgggagaagatgaagaacgagatcaacgagctaatgatagaaggaagagactatgcacaccagtttggatcagcttcatctcaagaaacacgtgaacatttagccaaaaagattcttcaatcttaccacaagtctctcaccatcatgaactactccggcgaacttgaccaagtttctcagggtggaggaagccccaagagcgatgattccgatcaagaaccacttgtcatcaagagttcgaagaagtcaatgccaaggtggagttcaaaagtcagaattgcccctggagctggtgttgatagaacgctggacgatggattcagttggagaaagtacggccagaaggatattctcggagccaaatttccaagaggatactatagatgcacgtatagaaagtctcaaggatgtgaagccactaaacaagtccaaagatctgatgaaaatcagatgctccttgagatcagttaccgaggaatacattcttgctctcaagctgcaaatgtcggtacaacaatgccgatacaaaacctcgaaccgaaccagacccaagaacacggaaatcttgacatggtaaaggaaagtgtagacaactacaatcaccaagcacatttgcatcacaaccttcactatccattgtcatctaccccaaatctagagaataacaatgcctatatgcttcaaatgcgagatcaaaacatcgaatattttggatctacgagcttctctagtgatctaggaactagtatcaactacaattttccagcatctggctcggcttctcactcagcatcaaactctccgtccaccgtccctttggaatccccgtttgaaagctatgatccaaatcatccatatggaggatttggtgggttctattcttagttatctacttaagggagggacggaactttt

SEQ ID NO: 4036 - DNA, 847 bp, Artificial Sequence
  P1047 (35S::G1537)
ggtcttaaaaccctagttctccataaaaaaaatatccttgaacacaaataaatggaaaacgaagtaaacgcaggaacagcaagcagttcaagatggaacccaacgaaagatcagatcacgctactggaaaatctttacaaggaaggaatacgaactccgagcgccgatcagattcagcagatcaccggtaggcttcgtgcgtacggccatatcgaaggtaaaaacgtcttttactggttccagaaccataaggctaggcaacgccaaaagcagaaacaggagcgcatggcttacttcaatcgcctcctccacaaaacctcccgtttcttctacccccctccttgctcaaacgtgggttgtgtcagtccgtactatttacagcaagcaagtgatcatcatatgaatcaacatggaagtgtatacacaaacgatcttcttcacagaaacaatgtgatgattccaagtggtggctacgagaaacggacagtcacacaacatcagaaacaactttcagacataagaacaacagcagccacaagaatgccaatttctccgagttcactcagatttgacagatttgccctccgtgataactgttatgccggtgaggacattaacgtcaattccagtggacggaaaacactccctctttttcctcttcagcctttgaatgcaagtaatgctgatggtatgggaagttccagttttgcccttggtagtgattctccggtggattgttctagcgatggagccggccgagagcagccgtttattgatttcttttctggtggttctacttctactcgtttcgatagtaatggtaatgggttgtaacgaaggtttaatg

SEQ ID NO: 4037 - DNA, 618 bp, Artificial Sequence
  P1048 (35S::G1538)
gcatctcataggactcaacctcaccaaagtcatatcctattgcatcactctcctttaaacacagtcagagaaaacagcaactcttgtctgaaaaactagagagagaaaatggatcatggtaggttaatggatgatcaaatgatgctaggctctcaagtgtacccctacacgacccaaccccaaaattcacactgcatcatcgttaaccagatcgatggaggcgaagaatcaaaaccggtgaagcggaggaggaagaggaggagtaaaggttcatcagccaccaacgaagaagacgtggcggagatcggagggatgttgaggaagaggaagttgaccgatgaacaagtgaacatgctcgaatatagcttcgggaacgagcataagctggagtcagggaggaaggagaagatcgccggagagttaggtcttgacccgagacaggtggctgtttggttccagaaccgccgtgcacgttggaagaacaagaaactagaggaagagtacgccaaactcaaaaaccaccacgacaacgtcgtactcggccaatgccaactcgagtctcaggtataaattttatgttttttcactataaaacagagtaaatttggtgattcttaa

SEQ ID NO: 4038 - DNA, 1008 bp, Artificial Sequence
  P1051 (35S::G1543)
ggttgatgagataccaaacgcatcttaatattttctccttaatttactttggttatgtctttctatgataaaactactatttacgtacatatgcacatacacatataaactatatgctctatatcatatggattacgcatgcgtgtgtatgtataaatataaaggcatcgtcacgcttcaagtttgtctcttttatattaaactgagagttttcctctcaaactttaccttttcttcttcgatcctagctcttaagaaccctaataattcattgatcaaaataatggcgattttgccggaaaactcttcaaacttggatcttactatctccgttccaggcttctcttcatcccctctctccgatgaaggaagtggcggaggaagagaccagctaaggctagacatgaatcggttaccgtcgtctgaagacggagacgatgaagaattcagtcacgatgatggctctgctcctccgcgaaagaaactccgtctaaccagagaacagtcacgtcttcttgaagatagtttcagacagaatcatacccttaatcccaaacaaaaggaagtacttgccaagcatttgatgctacggccaagacaaattgaagtttggtttcaaaaccgtagagcaaggagcaaattgaagcaaaccgagatggaatgcgagtatctcaaaaggtggtttggttcattaacggaagaaaaccacaggctccatagagaagtagaagagcttagagccataaaggttggcccaacaacggtgaactctgcctcgagccttactatgtgtcctcgctgcgagcgagttacccctgccgcgagcccttcgagggcggtggtgccggttccggctaagaaaacgtttccgccgcaagagcgtgatcgttgatttgtgtatcttaattatttgagtatggtttagaagtcaacgaaggtctgctattgagcctacaaaatattaacgatcacatgatttcgtgtaaatactaagagactctgttccgc

SEQ ID NO: 4039 - DNA, 983 bp, Artificial Sequence
  P1056 (35S::G1380)
caaacacacacagatctcttcttcatcacattacttctggctttacatcttttttcttctccatgaggaaagggagaggctcttccgtcgttggacccgcccttccagtaaccgccggtggatctgtgaaggagccgaggtatagaggcgttaggaagagaccttggggtcgattcgcagctgagatccgtgatccattaaaaaaatctcgtgtctggctcggtactttcgattccgccgtagatgctgcacgcgcttacgataccgccgcacgtaacctccgtggtccaaaggccaagaccaatttcccgatcgattgttctccttcttctcctctccaacctctcacctacctccacaatcaaaacctctgttctcctccggtgattcagaaccagatcgatccgtttatggaccatcggttatacggcggaggtaatttccaggagcagcagcagcagcagattattagtcggccggcgagtagcagcatgagcagcaccgttaaatcttgtagcggaccgagaccgatggaagccgcggcggcgtcttcgtcggtggcgaaaccgttacatgcgattaagagatatccgagaactccaccggtagctccggaggattgtcatagcgactgcgattcttcgtcgtctgttattgacgacggagatgatatcgcatcttcgtcttcccgccggaaaacgccgtttcagtttgatcttaatttcccgccgttggatggcgttgacttattcgctggcgggatagatgatctccactgtaccgatctacgtctctgatttgctgctttacaaaaaaaatccgttgattacacacaaaaaaaattctcaaattttacaaaatgataactttatgctcttttgtttttccattttcctttgatatcatattgaaagagaaaaaaaggaagaacaaaaaaaaaagattgagcgtgatgattttatcatcaacgaagatgatgacga

SEQ ID NO: 4040 - DNA, 803 bp, Artificial Sequence
  P1057 (35S::G1419)
ttcatcatctatggcttcttcacatcaacaacagcaagaacaagaccagtcagctttagatctcataacccaacaccttcttactgatttcccttccttagacacctttgcctccaccatccaccactgcaccacctcaactctaagccaacgcaaaccacctcttgccactatagcagttcctactactgcaccggtggttcaagagaatgatcaaaggcattacagaggcgtcaggagaagaccatggggtaagtatgcggctgagatcagagacccaaacaagaaaggtgttcgtgtctggttaggcacttttgacacagccatggaagctgcaagaggttatgacaaggcagcttttaaactacgaggaagcaaagctattcttaacttcccacttgaagcaggaaagcatgaggacttgggagacaacaagaagactatttctttaaaagcaaagaggaagagacaggtgacggaggatgaaagccagctgatcagccgtaaagctgttaagagggaagaagctcaggttcaggctgatgcttgtccattaacgccatcaagttggaaggggttttgggacggagcagacagtaaagacatgggaatattttccgtgcctctgttatctccttgtccatctcttggacactctcaactcgtagttacttaagcttcagagggtcaaactggaaaaaatcaacattggattgttttcaaagcttctagattagctgattgtaaaaaaatgttttactatattcattcattcttcttaaatgcaattctttctacccttc

SEQ ID NO: 4041 - DNA, 727 bp, Artificial Sequence
  P1059 (35S::G1902)
gaagttgataaatgttcaaggaaacataaaaaagagaagatttttgaataaaggttgaagaaaaatgcaggatccagcagcatattaccagacgatgatggcgaagcaacaacaacaacaacaaccacagtttgcagagcaagaacagttaaagtgtcctcgttgtgactcaccaaacactaaattctgttactacaacaactacaatctctcacagcctcgtcacttttgcaaaagctgtcgtcgttactggactaaaggcggcgctctccgtaacgttcccgtcggtggtggttctcgtaagaacgcaaccaaacgatccacttcttcttcttcttctgcttcctctccttccaacagtagccaaaacaagaagacgaaaaacccggatccggatcctgatccacgtaattctcaaaaaccggatttggatccgacccggatgctttacgggtttccgatcggtgaccaagacgtgaagggtatggagattggtggaagctttagctcgttgttggcgaataatatgcagcttggtcttggaggaggagggatcatgcttgacgggtcgggttgggatcatccgggtatgggtttgggtttgaggagaaccgaaccgggtaataataataataacccatggaccgatctggctatgaacagagcggagaaaaactgaagaagaaaagaagagaggggtattttggtaaattatagcaacctgatt

SEQ ID NO: 4042 - DNA, 1243 bp, Artificial Sequence
  P1060 (35S::G1903)
cttcatatctctagaagtttcataattagttatgtctaaatctagagatacggagataaagttgtttgggaggacaatcacatctcttttagatgtgaattgttatgatccgtcgtcgttgtcccctgttcacgatgtttcttctgatccaagcaaggaggattcgtcttcttcttcatcttcttgttctccaactattggaccaatcagggttccggttaaaaaaagtgagcaagagagtaacaaattcaaagatccatatatattatccgatctaaacgaaccaccaaaagcagtatctgagatttcatcaccaagaagttccaagaacaactgtgatcaacagagcgagatcacaacaacaactaccacaagtactacatcaggagagaaatcaacggctctcaagaaaccggacaagcttattccatgtcctagatgtgaaagcgcaaacaccaaattctgttattacaacaactacaacgtgaaccagccacgttacttctgcaggaactgtcagaggtattggacagctggtggatctatgaggaacgttcctgttggctcaggtcgtcgcaagaacaaaggatggccttcttcaaaccattacttgcaagtcacttctgaggattgtgataataataactcggggacgatccttagtttcggttcttcggagtcttcggttacagagactggtaagcatcagtcaggtgatacagcaaagataagtgctgattcagtttctcaagaaaataaaagctaccaagggtttcttcctccgcaagtaatgttacctaataattcttctccttggccttaccaatggagtccaacgggtcctaacgctagtttctaccctgtccccttctactggggatgcacggttccgatataccctacctcagagacttcatcatgtttaggaaaacggtcaagagatcaaactgaaggaagaatcaatgatactaatacaacaataactactacaagagcaagattggtctcagaatctcttagaatgaatatcgaagctagtaagagcgctgtgtggtctaagttaccgacaaaacccgagaaaaaaacgcaaggattcagtttgttcaatggatttgacacaaagggaaacagcaacagaagtagcttggtctccgaaacttctcacagtctacaagcaaaccctgcagcgatgtctagagctatgaacttcagggagagcatgcaacaataatcagacactaat

SEQ ID NO: 4043 - DNA, 1551 bp, Artificial Sequence
  P1073 (35S::G1672)
ggtaccgatcactcccgtctttatcaaattcttcttcctcttacattttccctatccaatcgatctcacgcagatctgatcaatttctcatcaaatcatttagagatcaaaagaaaactatgaagaatagtaaatgtaacctcatagattcaaagctcgaagaacatcatcatctttgcggatcaaaacattgtcctggatgtggtcgcatgattcaagctgctactaaaccaaattgggttggattgccggcaggagtgaaattcgatccgacagatcaagaacttatagaacatttagaagcaaaagtgaagggaaaagaagaaaataagaaatggtcgtcgtctcatccacttatagatgaatttattcccaccattgatggagaagatggaatatgttacactcatcctcagaagcttccaggggtgacaagagatggcttgagcaaacacttcttccacaaaccatcaagagcttacacaaccggaacaagaaaacgacgtaaaataattcaaaccgatcacgactctgagttaaccggatcatcagaaaccaggtggcacaaaacgggcaaaacaagaccggttatgatcaacggtcaacaaagaggatgcaagaagatattagtactctacacaaacttcggcaagaatcgtcgaccggagaaaacaaattgggtgatgcatcaatatcatttagggattaatgaggaagagagagaaggagaacttgtggtctccaagatattttatcagacacaaccaagacagtgtgttagtaatactaattggtctgatcaccatggttccaaggacgtgatcggaattggtgtcggagatgagatttccagcgtagctgccacgttgcagagtcttggctccggtgacgtcgtttctagggttaatatgcatccccatacaagatcctttgatgaggggacagccgaagcttcaaagggaagagagaaccagcatgtgtctggcacgtgcgaggaagtacatgatgggatcataacatcatcaatgtcatctcatcatatgattcatgatcatcataatcaacatcatcaaatcggagatagaagagaatttcacatgtcatcatcatatcccatgacccctactatcacatcacaacatgagtcaatcttccatgttacaagtactatgccctttcagcggcagcaattaaggggtcggtcgtctggttcgggattagaagacctaattatgggttgtaccacagctacgtgtacagaagacaataatcacaaatgattaaattcgcaggagcattcagaagcaaaccctcagcgaaatgcagagtggttaacgtttccacaattctggaaccaagccgaatcagatgatcaaaaccgaagattttaacagaaccaaaaggaagcagagaaatcttgcaaaaagctcctgcttagctgttgatcaatgccggaaatgctgagctatgactgactagtctctgccatttaacttacaatatcaccagaggttgcgatgaatgttgattcgctcaaaggagagcggccgc

SEQ ID NO: 4044 - DNA, 1121 bp, Artificial Sequence
  P1074 (35S::G1677)
cagtactaattctgtgtgtgttaatggttctagttatggatgatgaagagagtaacaacgttgaaagatatgacgacgtcgtattgccagggtttaggttccatcccactgatgaagaactcgtaagtttctacttgaaacggaaggttttacacaaatctcttccctttgatctcatcaagaaagtcgacatttacaaatacgatccatgggacctcccaaagcttgcagcgatgggggaaaaagagtggtacttttattgtcctagagacaggaaataccgcaacagcacaagacctaaccgagtaactggaggtggcttctggaaagcaaccggaacagaccggcctatatactcattggactccactcgatgcatcggtttgaagaaatcacttgtgttctaccgtggtcgagctgctaaaggagtcaaaaccgattggatgatgcatgaatttcgtctcccttctctctctgactctcatcactcatcatatcccaattacaataacaagaagcaacaccttaacaataacaacaacagcaaggagcttccttcaaacgatgcttgggcgatatgtagaatatttaagaagacaaatgcagtatcctcacaaagatcaatcccacaatcttgggtttatccaacgattcctgacaacaatcaacagtcacacaacaacaccgcaactctcttagcttcatcagacgttctcagccacatatcaacaagacaaaactttattccttctccagtcaacgaacccgcaagcttcacagaatcagctgcttcttacttcgcgtctcagatgctcggagtcacgtacaatacagccagaaacaacggaacaggggatgctctgtttctgagaaacaatggaacaggggatgctctggttctgagcaacaatgagaataactacttcaacaacttgactggagggttgactcatgaggttccgaatgtaagatcaatggtgatggaggagactacggggagtgagatgtcggcgacgtcgtattccactaacaattaagatcatagtactattaacacttgaattagtgtagacgttgatcatcgctaatatgtattaatttttcttgtcttactataaacg

SEQ ID NO: 4045 - DNA, 1410 bp, Artificial Sequence
  P1076 (35S::G1399)
agattcgtggaggatctctactgatttgtcggaatctctcactacagaatcacttgatcttatgtccggatggaggagagagaaggaaccaacatcaacaacaacatcactagcagtttcggcttgaagcagcaacatgaagctgctgcttctgatggtggttactcaatggacccaccaccaagacccgaaaaccctaacccgtttttagtcccacccactactgtccccgcggccgccaccgtagcagcagctgttactgagaatgcggctactccgtttagcttaacaatgccgacggagaacacttcagctgagcagctgaaaaagaagagaggtaggccgagaaagtataatcccgatgggactcttgtcgtgactttatcgccgatgccaatctcgtcctctgttccgttgacgtcggagtttcctccaaggaaacgaggaagaggacgtggcaagtctaatcgatggctcaagaagtctcaaatgttccaattcgatagaagtcctgttgataccaatttggcaggtgtaggaactgctgattttgttggtgccaactttacacctcatgtactgatcgtcaacgccggagaggatgtgacgatgaagataatgacattctctcaacaaggatctcgtgctatctgcatcctttcagctaatggtcccatctccaatgttacgcttcgtcaatctatgacatccggtggtactctaacttatgagggtcgttttgagattctctctttgacgggttcgtttatgcaaaatgactctggaggaactcgaagtagagctggtggtatgagtgtttgccttgcaggaccagatggtcgtgtctttggtggaggactcgctggtctctttcttgctgctggtcctgtccaggtaatggtagggacttttatagctggtcaagagcagtcacagctggagctagcaaaagaaagacggctaagatttggggctcaaccatcttctatctcctttaacatatccgcagaagaacggaaggcgagattcgagaggcttaacaagtctgttgctattcctgcaccaaccacttcatacacgcatgtaaacacaacaaatgcggttcacagttactatacaaactcggttaaccatgtcaaggatcccttctcgtctatcccagtaggaggaggaggaggtggagaggtaggagaagaagagggtgaagaagatgatgatgaattagaaggtgaagacgaagaattcggaggcgatagccaatctgacaacgagattccgagctgatgatgatcatacggtttcttttcgcggatttgttaggtttgatggatttcagattttggttgattgtttttattaacacagaatgtttagaagctgctatctttaggttcccatcctcttgtgatt

SEQ ID NO: 4046 - DNA, 938 bp, Artificial Sequence; identical to SEQ ID NO: 1115
  P1079 (35S::G1667)

SEQ ID NO: 4047 - DNA, 1065 bp, Artificial Sequence
  P1080 (35S::G635)
ccttccttgtatgattttctataatccagcatggagatcatgcgtccaggggtctcagaaaacactttgaaaggaaaaataagaatcacaacgcggtgcatgtggcttgacaaaggaagacttttagatgcacttcacaaagcagctcatgctgctctatcaagttgtcctgtgacatgtcccttgtctcacatggaaagaacagtctccgaagtcctgaggaagattgtaaggaagtacagtggtaaaaggcctgaagtcatcgctatagccactgagaatccaatggctgtccgagctgatgaggtcagtgcgagactgtctggtgatccaagtgttggttctggagttgcagctttaaggaaagttgttgaaggaaatgacaaaagaagtcgggcgaagaaagcaccttcacaagaagcttcccccaaagaagtagatcgcactttggaagatgatatcattgatagtgcaagactactggctgaagaagaaactgcggcatcaacatacacggaagaagttgatacgcccgttgggagttcttcagaagagtcagacgatttttggaaatcattcatcaatccatcatcgtcaccttcaccgagtgaaacagaaaatatgaataaggtagctgatacggagcctaaagcagagggtaaggaaaacagcagagacgacgatgaattagctgatgcttcagattctgaaaccaagtcatcaccaaaacgtgtgaggaagaacaaatggaaaccggaggagataaagaaggtaatcagaatgcgaggagagctgcacagtagatttcaagtggtgaaaggtagaatggcattgtgggaagagatctcttcaaatctatcagctgaaggaatcaatcgaagcccgggacaatgcaaatctctctgggcatcacttattcagaaatacgaggagagcaaggctgatgagagaagcaagacgagttggccacattttgaggatatgaacaacattttgtcagagctaggcacacctgcgtcttaagtaatgtgatttagatgacattatcttcccaaaagaatcatc

SEQ ID NO: 4048 - DNA, 2646 bp, Artificial Sequence
  P1083 (35S::G1082)
gggtttggaatcatattattgagtgttatgggttgtacaagttctaagcttgacgatcttccggcggttgctctttgccgtgaacgctgtgctttcttagaagctgctattcatcaacgttacgctttagctgaatcacacgtggcttacactcattcgcttcgagaaatcggtcactctctccatcttttcatcaatcaccaccaccgtttcgtcgcttccggcggcgctaacgtcggtgattctcctcgacttaatcttcctcctcagagaaaaggtgaccttgacgacgaagcaacaaattccccaaaaaaacaaaagcttgcttcttctcaccacaaccacaaccacgctcactcgggttccggttctgattcgggtcatctcgaattcgattcagattccgacgaagatgaagaagacgacgacgacttggatttggattcgttgcatcaccactctcctccccaccaccatctcggcaatttccctattcccgaatcagcaccaatgggcggatacatggaacaacaaccgggttatataaacccgtacccgaatccagatatgatggggcatccttactctggaggaggaagttatatgcacatgaattacatgaagaacaaatccatgcctccttcagttgtctatgagcaaagaccaactagtcctcaacgagtctacataggcgaatcatcatcttcatatccatatcctcctcaaaattcatattttggatactcaaatccagtacccggacccggaccaggatactacggttcttcttctgcttctacaactgctgcagcaacaaaaccgccaccacctccaccgtcgccgcctaggtctaacggttgggattttttgaatccctttgatacttattatcctccgtatactccgagtcgagattcgagagagttaagagaagaagaaggtataccggatttagaagacgatgattcacattacgaagttgttaaagaagtttacggcaaaccaaaattcgccgccggtggtggtcaccaaccaaatcccgccgccgtacacatgatgagggaagagtccccgtctccgccgcttgataaatccggtgctagtactagcggtggaggtgatgtcggagatgcatctgcgtatcagtctagaccaagtgtgtcggtggagaaagaagggatggagtatgaagttcacgttgttgagaagaaggttgttgaagatgaggaacggcggagtaatgccacggcgacacgtggtggtggtggaggaggagggccacgtgcggtgcctgaagttgcgaaagagattgagaatcaattcgtgaaagctgcagagtcaggaagtgagattgctaagttacttgaagttgggaagcatccttatggtcgtaaacatgctgcttcgaagatgttgcacggtgttactccttcgttaccttctacctctggaggaacttcttcgtctgctgctgctgctgttgtgccacctacttatgcagatattgaagaagagcttgcttcgaggtcgaggaatctttcttcgacgttgcacaagctccatctttgggagaagaagctttatcatgaagtcaaggccgaggagaaactgcgtctagctcacgagaaaaagcttaggaagctaaagcgtttggatcaaagaggtgccgaggctatcaaagtagataaaacgcggaaattagtgagagatatgtccacaaaaatacggattgcgattcaggttgtcgacaaaatatccgtgacgattaataagataagagacgaagacctgtggccgcaactgaatgcattgattcaagggcttacaagaatgtggaaaacaatgcttgaatgtcatcaaagtcaatgtcaagctattagggaagcacaaggtttaggcccgataagagcaagcaagaaactaggcgatgaacatctagaagcgacgagtttgcttggacatgaacttattaattggatattgggattctctagctgggttagtgcgcagaagggttatgtaaaagagttgaataaatggctcatgaaatgtcttctgtatgaacctgaggaaacacctgatgggatagttcccttttcacctggtaggattggggctccacctatctttgtcatctgtaaccaatggtctcaagctctggataggatatctgagaaggaagttattgaggcaatgcgtagtttcactacaagtgtgcttcagctttgggaacaagatcggttagatacgatgatgacggggcatggtgattcagagaagaaagtcaggaacatggacagagaagaacagaggatacagagagagattcaagcattggaaaagaaaatgattcttgtggcaccgggtgatggtaacagtctttcgatatccggcaacgttgtttaccaaagcgatactagcagcgatagtttacaaggtagtttgcaacggatttttgaagctatggagagattcactgctgaatcgatgagagcttatgaggatctcttagagcgcaccaatgaagaaactgcaccacgggaacttgaggaagaagaggaggagtaaaaaagcaaaacaggaagaagaggtttgcttgtcaattcaatttgaatcccatgatcgagctgtttgctgatcttgcaa

SEQ ID NO: 4049 - DNA, 1088 bp, Artificial Sequence
  P1084 (35S::G1051)
attcagatttgctttctttggtaatcttttggatcaagatccatctattttttcttcaatggcacaactccctcctaaaatccccaacatgacacaacattggcctgatttctcttcccaaaagctctctcctttctctaccccaaccgcaaccgctgtcgccaccgctacaaccaccgtacaaaacccctcatgggtcgacgaattcctcgacttctcagcgtctcgccgtggcaaccaccgtcgttccatcagcgactctatcgcattcctcgaagctccaacagtcagcatcgaagaccaccaattcgacaggttcgatgacgaacagttcatgtcgatgttcaccgacgacgacaaccttcatagcaatccttcccatatcaacaacaaaaataacaatgtggggcccacgggatcttcctcgaacacatccacgccgtccaatagcttcaacgacgataacaaagaattaccaccgtccgatcataacatgaacaataatatcaacaacaactataacgatgaagtccaaagccaatgcaagatggagccagaagatggtacggcgtcgaataacaattccggtgatagctccggcaaccggattctcgatcccaaaagggttaagagaatattagcaaatcggcaatcagcacagagatcaagggtgaggaaactgcaatacatatcagagctcgaacgtagcgtcacttcgttgcaggcggaagtgtcagtgttatcgccaagagttgcattcttggatcatcaacgtttgcttcttaacgttgacaacagcgctctcaagcaacgaatcgctgctttatctcaagacaagcttttcaaagacgcacatcaagaagcattgaagagagaaatagagagacttcgacaagtgtataatcaacaaagcctcacgaatgtggaaaatgcaaatcatttatcggcgaccggagccggtgctactccggccgtcgacatcaagtcgtccgttgaaacagagcagctcctcaatgtctcataaattaaccatcatgcatcatcatcaacatttctctcttttagcttcttggcaaaagttcttgact

(The sequence listing continues in the following parts.)

What is claimed is:

1. A recombinant host cell comprising a recombinant nucleic acid construct comprising a heterologous promoter operably linked to a nucleic acid molecule encoding a polypeptide; wherein the nucleic acid molecule comprises a nucleotide sequence that has at least 95% sequence identity to the nucleotide sequence of SEQ ID NO:669, or wherein the polypeptide comprises an amino acid sequence that has at least 95% sequence identity to the amino acid sequence of SEQ ID NO:670.

2. A transgenic plant having an altered trait as compared to a control plant, wherein the transgenic plant comprises a recombinant nucleic acid construct comprising a heterologous promoter operably linked to a nucleic acid molecule encoding a polypeptide; wherein the nucleic acid molecule comprises a nucleotide sequence that has at least 95% sequence identity to the nucleotide sequence of SEQ ID NO:669, or wherein the polypeptide comprises an amino acid sequence that has at least 95% sequence identity to the amino acid sequence of SEQ ID NO:670.

3. The transgenic plant of claim 2, wherein the transgenic plant is a eudicot.

4. The transgenic plant of claim 2, wherein the transgenic plant is a legume.

5. The transgenic plant of claim 2, wherein the transgenic plant is a monocot.

6. The transgenic plant of claim 2, wherein the transgenic plant is a transgenic seed comprising the recombinant nucleic acid construct.

7. A method for conferring to a plant an altered trait as compared to a control plant, the method comprising:
  (a) providing the recombinant nucleic acid construct comprising a heterologous promoter operably linked to a nucleic acid molecule encoding a polypeptide; wherein the nucleic acid molecule comprises a nucleotide sequence that has at least 95% sequence identity to the nucleotide sequence of SEQ ID NO:669, or wherein the polypeptide comprises an amino acid sequence that has at least 95% sequence identity to the amino acid sequence of SEQ ID NO:670; and
  (b) transforming a target plant with the recombinant nucleic acid construct to produce a transgenic plant having the altered trait as compared to the control plant.

8. The method of claim 7, wherein the method further comprises the step of:
  (c) selecting a transgenic plant that ectopically expresses the polypeptide.

9. The method of claim 7, wherein the method further comprises the step of:
  (c) selfing or crossing the transgenic plant with itself or another plant, respectively, to produce a transgenic seed.

10. The recombinant host cell of claim 1, wherein the nucleic acid molecule comprises a nucleotide sequence that has at least 95% sequence identity to the nucleotide sequence of SEQ ID NO: 669.

11. A recombinant nucleic acid construct comprising a heterologous promoter operably linked to a nucleic acid molecule encoding a polypeptide, wherein the nucleic acid molecule comprises the nucleotide sequence of SEQ ID NO: 669.

12. The recombinant host cell of claim 1, wherein the polypeptide comprises an amino acid sequence that has at least 95% sequence identity with the amino acid sequence of SEQ ID NO:670.

13. A recombinant nucleic acid construct comprising a heterologous promoter operably linked to a nucleic acid molecule encoding a polypeptide, wherein the polypeptide comprises the amino acid sequence of SEQ ID NO:670.

14. The transgenic plant of claim 2, wherein the polypeptide comprises an amino acid sequence that has at least 95% sequence identity with the amino acid sequence of SEQ ID NO:670.

15. The transgenic plant of claim 2, wherein the nucleic acid molecule comprises the nucleotide sequence of SEQ ID NO: 669.

16. The transgenic plant of claim 2, wherein the polypeptide comprises the amino acid sequence of SEQ ID NO:670.

* * * * *